United States Patent 10,696,975 (GENES AND USES FOR PLANT ENHANCEMENT) - sequence listing, part 7

SEQ ID NO: 27327 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHSVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDVFKTHPMNLLNERTLKGTFFGNYKPRTDLPGVVEKYMNKELEVEKFITHS

SEQ ID NO: 27328 - protein, 625 aa, Oryza sativa
MGARASRHRQSPDQSQSQSPSPHHKHHHHHQTTRAPKPKPKPQPPPPQQPRSQPPPPPRHQPQQAPQQAAAEDGVGRVLGRPMEDVRATYTFGRELGRGQFGVTYLATHKPTGRRYACKSIAARKLARPDDLDDVRREVHIMHHLTGHRNIVELRGAYEDRHSVNLVMELCEGGELFDRIIARGHYSERAAAALCREIVSVVHSCHSMGVMHRDLKPENFLFLNKREDSPLKATDFGLSVFFKPGEQFRDLVGSAYYVAPEVLKRLYGAEADIWSAGVILYILLSGVPPFWAENEDGIFDAVLQGHIDFSSEPWPSISSGAKDLVKRMLRQDPKERLTAAEILNHPWIREDGEAPDKPLDITVISRMKQFRAMNKLKKVALKVVAENLSEEEIVGLKEMFKSLDTDNSGTITLEELRAGLPKLGTKISESELRQLMEAADVDGNGSIDYVEFISATMHMNRLEKEDHIYKAFEYFDKDHSGFITVDELEEALTKYDMGDETTIKEIIAEVDPDLADVDGNGSIDYVEFISATMHMNRLEKEDHIYKAFEYFDKDHSGFITVDELEEALTKYDMGDEATIKEIIAEVDTDHDNRIDYIEYLENIGGDLVFKYAECCSAISKIMDAG

SEQ ID NO: 27329 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKAVQQVLIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 27330 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECGHVGWGVAVLVGVPSKDDEFKTHPMNLLNERTLKGAFFGNYKPRTDLPGVVEKYMNKELEVEKFITHS

SEQ ID NO: 27331 - protein, 304 aa, Triticum aestivum
NKFVQKSRLVPVRNSRDIVDPRVRSLAVVGVTPCLLQLVGLLVIPESPRWLAKIGHSGALEEALQKLRGKETDISEEAADIEDFTEKLQHLPQSKMLDLFQKDYIHAVTVGVGLMVLQQFGGVNAICFYASEIFVSAGFSSVNTGMLAMVAVQIPMTALGVLLLDKAGRRPLLMVSKEHHWAKDLNVALALTGILIFSGSFSLGMGGIPWVIMSEIFPIHMKGSAGSLVTLVSWLGSWIVSYAFNFLLLWSSYGTFFMFASICGLTVVFVERLVPETKGRTLEEIQASMNSSLTPVSSGINRAA

SEQ ID NO: 27332 - protein, 214 aa, Aeropyrum pernix K1
MVAAVRVIGGETPLARYVLKVLRDRTTGFPEFRRYVRIAGSILAVYIAGELGWVEEEVETPLGAKAKELAPAGPVYLVGILGASLPMVEGFASMMPEARIALVAARRVEEPGRLKIEVYYSRLPRMFDGPAVVLDPMLATGKTVAEAVRLARDRGASKVVIGSIIASRQGVEYISSLYGDTPIYTLALDPELDENYFIVPGLGDAGDRALGVEP

SEQ ID NO: 27333 - protein, 497 aa, Pseudomonas aeruginosa UCBPP-PA14
MSVPVRHLIAGAFVEGLGAQRIPVSNPLDNSTLAEIACASAEQIEQAVASARETFASWKETPVSERARVMLRYQALLKEHHDELAKIVSSELGKTFEDAKGDVWRGIEVVEHACNVPSLLMGETVENVARNIDTYSITQPLGVCVGITPFNFPAMIPLWMFPLAIACGNAFILKPSEQVPLTSVRLAELFLEAGAPKGVLQVVHGGKEQVDQLLKHPQVKAVSFVGSVAVGQYVYHTGTAHNKRVQSFAGAKNHMVIMPDADKAQVISNLVGASVGAAGQRCMAISVAVLVGAAREWIPEIRDALAKVRPGPWDDSGASYGPVINPQAKARIERLIGQGVEEGAQLLLDGRGYKVEGYPDGNWVGPTLFAGVRPDMAIYREEVFGPVLCLAEVDSLEQAIRLINESPYGNGTSIFTSSGAAARTFQHHIEVGQVGINIPIPVPLPFFSFTGWKGSFYGDLHAYGKQGVRFYTETKTVTARWFDSDSVAGTNFSIQMR

SEQ ID NO: 27334 - protein, 441 aa, Aspergillus oryzae
MGSIGYPDVQPLEIFSKRGQNAVELGSKRIIWDVISDMWNPDTNPSGILSIGMAENTLLHNTLLQYIEANFRLSAEHLTYNNGSMGSNALRKAVSHFLNRHFNAFRPVEPSHILMTNGCSSAIEHLSWAFVNPGEGVLLGMPYYSTFIADISLRPEAVVIPVKMGNVDPLSIESVDLYEKAAVEFEASTGRRVRAVILCNPHNPLGRCYPRETIDKFMEFCQSRQMHLISDEIYALSVWENRVDKDIPFTPFESILSRDITRLIDPSLVHVLWGMSKDFGANGLRVGAIISQSNPELHIAQKCLSLYSFVSGMSDQITASILSDDHFTDKYIEMNRERLSLSHQFLVHALNKHKIEYLRGCNAGFFLWVNLGAKYLAAHPEEEGRATDLTDRIFQKLLDNKVYVAHGTAYGSENPGWFRLVFAHPIPWLMEAMARIVCAIQ

SEQ ID NO: 27335 - protein, 152 aa, Zea mays
MAAYMRVTHRDEEGKKVTEKMPVPETRRPDTAKHFERKLEEQGLHRFERHPANAPRGVGIGAPPPKSGRGGKYTWEGPGGLVEDQLDPAPPAIDPNDPNYEEAEEGGAADVDDEAAAREVVVGEVEVAKVAESRDGVARVDVAPGLLQDQKQ

SEQ ID NO: 27336 - protein, 370 aa, Picea sitchensis
MAGILRACASVAALEQGKQVHADIIKIGFELDVSVSNGLVDMYGKCGRIEDAQEVFSKLLEPDVASWNAMISGLAQHGCGKEAVLLFEQMLQTGVKPNQITFVVVLSGCSHAGLVDEGRNYFDSMTRDHGISPKAEHYSCMVDLFGRAGCLDEALNFINQMPVEPNASVWGSLLGACRVHGNIELAERAVEQLIELTPENPGTYVLLSNIYAAAGRWDDAGKVRKMMKDRSVKKEPGCSWIEVQNKVHPFIVGDSSHPQIEEIYETLETLTLQMKAAGYIPNTNFVLHDVEEEQKEWILGHHSEKLAIAFGIISTPPGTTIRVVKNLRVCGDCHTATKFISRIVSREIVLRDTHRFHHFKDGQCSCGDYW

SEQ ID NO: 27337 - protein, 178 aa, Campylobacter jejuni RM1221
MNLPNILAIFRMVLAPLLFFLLIHHFENIHQSWINYFAALTFSLAALSDFFDGYIARTWKQTTKLGGILDPLADKMLVLAAFLGLLLTGKANEWVIYIILVREFFITGFRVVMISENLNVNASFAGKLKTAFQMTAIGFLIMEWIGGEILLYIALILTLYSGFEYIYTYIKAQKKGEK

SEQ ID NO: 27338 - protein, 452 aa, Corynebacterium diphtheriae NCTC 13129
MIMDSSFSDHRGIPIADLDHSEHVRSQTEAMAWELVSFIANSPSSFHAAQQGAQLLQEAGFHQVDETADWDSTLGGHFMIRGGALMAWYVPTSADTSSGFRIIGAHNDSPGFKLKYHPDLMSAGWQQASVEVYGGPILASWFDRELVLAGRIGLIDGSTRTVTTAPVLRIPHLAIHLDRDANTSLSIDRQRHTQPIFAVGEPDLSIMDVIATAAGVNKEEIISHDLITADAQPGEIFGATSDFLAAGRLDNLSSVFPGLKAFVEAAEDNVLGRAPMKDILVFAAFDHEEVGSATTTGAAGPILEDVLTRTAAGLGADAEKTKQMITRSTCISVDAAHSIHPNYAHQHDPLNHPVMGGGPTLKVNANQRYASNTETEAMWVRACMKAGSSHQVFVGNNSVPCGSTIGPITATRLGIPTVDVGVPLLSMHSARELASTTDIYWLSRCLHAYLVG

SEQ ID NO: 27339 - protein, 367 aa, Acinetobacter sp. ADP1
MSHFMGFNCGIVGLPNVGKSTLFNALTKAAIAAENFPFCTIEPNTGIVPVPDARLDKLAAIVKPQRILPTTMEFVDIAGLVAGASKGEGLGNQFLANIRETDAIAHVVRCFEDENVIHVNGKIDPLDDIATINTELALADLDTVAKALLRLTKVAKSGDKEALATKAVLEKIQPLLDEGKPARAADLSDDERKLIRGFGLMTLKPTMYIANVAEDGFENNPHLDAVKKLAAEENAIVVPLCNQIEAEISLLEDEDRAEFLEAMGMEEPGLNVVIRAGYALLGLQTYFTAGVQEVRAWTVKVGATAPQAAGVIHTDFEKGFIRAECVAYDDFVQYNGEAGAKEAGKWRLEGKTYVVQDGDVLHFRFNV

SEQ ID NO: 27340 - protein, 531 aa, Bradyrhizobium japonicum USDA 110
MTLLRDPLLNKGTAFTEAERAALGLRGLLPPCVLTMETQVDRVLTNLRMLPTDLEKYVALNALHDRNEALFFRVVVDNIDEIQPIIYTPTVGLACQKYGLIFQRPRGMFISSRDRGQIAEILKNWPYPARLIVVTDGERILGLGDLGANGMGIPVGKLSLYSACAGVHPEHCLPIVLDVGTNNEELLNDPYYLGLRERRLTGEAYDSFVDEFMVAARKTFPGVLIQFEDFANHSAFKLLHKYRDEACVFNDDIQGTAAVALAGLFSGLRISGGKLKDQKILFLGAGEAATGIADLVVSAMMAEGATEAEALRRNWLVDSRGLVVSGRDGLSGHKLRYAHAGQAPISDFLTAIKTLKPTAIIGVAAVGGAFTPDVLKAMAGLNEHPIVFALSNPTSKAECSAEDAYRYTEGRALFACGSPYDPVKLNGRTFVPRQGNNSYIFPGVGLGVIATRSRLVTDEMFMAAAHSLADCVGKEDLAQGSLYPALPRIREVSARIAAAVADVAYQRGLADGPAPNDVKALVQSQMYEPKY

SEQ ID NO: 27341 - protein, 247 aa, Kluyveromyces lactis NRRL Y-1140
MRPLEAERFLGCRGYSFIKWVQALTHSTLVEIFLFKMSKTGSSSRAAWQYTKSAINYTIITVILVYVLYKLFTNHGEDINFGKFLMKTSPYMWANLGIALCIGLSVVGAAWGIFITGSSIIGAGVRAPRITTKNLISIIFCEVVAIYGLIMAIVFSSKVTVANSATMFDKSNLYTGYSIFWAGITVGVSNLICGVAVGITGATAAISDAADSSLFVKILVIEIFGSVLGLLGLIVGLLMAGKAVEFQ

SEQ ID NO: 27342 - protein, 279 aa, Prochlorococcus marinus str. NATL1A
MNLFSDLLSSENSKIPINNGPVIKQRRGVEIKSSREIAIMRKSSKIVATVLSEIRDLVKPGMSTLDLDNYAEKRIRDHDAKPSFKGYHGFPGSICSSINNEVVHGIPSKKKIINDGDLLKVDTGAFYNGYHGDSCITICVGNTSDKANELSRVAREALMLGIKQIRPQNKLLDIAGAIEDYVKANGFSVVEDYTGHGVGRNLHEEPSVFNFRTNDLPNVTLREGMTIAVEPIINLGSKHCKTLRDGWTVITKDGNLSAQWEHTVLVTKNGCEILTDRGD

SEQ ID NO: 27343 - protein, 1126 aa, Capsicum frutescens
MAAFLLPFLVFLSTLCSAQQNPQTLSEVQALTSFKLRIHDPLTALSDWDSSSPFAPCDWRGVFCVNGKVSELRLPHLQLTGPLTNQIGNLRTLRKLSLRSNSFNGTVPASLSKCTLLHSVFLQGNAFSGKLPVEIFNLADLQVFNVAGNQLSGEIPGEVPRSLRYFDLSSILFTGDIPRYLSDLSQLLLINLSYNRFSGEIPASIGRLQQLQYLWLAYNDLVGTLSSAIANCLSLVHLSAEGNAIRGVIPAAIAALPKLQVISLSRNNLSGSLPASLFCNVSIYPPSLRIVQLGFNGFTDIVKQESAKCFSSLQILDLQHNQIHGEFPLILTNNSALTSLDVSWNLFSGKIPSAIGNLWRLELLRMGNNSFEAGLPFEITNCSSLKVLDLEGNRMTGKIPMFLGYLRSLKTLSLGRNQFSGSIPSSFRNLTNLENLNLGGNGLNGSLPEEVMSLSNLSILNLSGNKFSGSMPIGIGNLQQLSVLNLSKNGFSGTIPSSIGTLYKLTVVDLSGQNFSGEIPFDLAGLPNLQVISLQENKLSGNVPEGFSSLLGMQYLNLSSNSLSGHIPSTFGFLTSLVVLSLSNNHINGSIPPDLANCSALEDLDLHSNSLSGQIPADLGRLSLLSVLDLGRNNLTGEVPIDISNCSSLTSLVLDLNHLSGNIPESLSRLSNLTVLDLSTNNFSGEIPANLTMLSSLVSFNVSNNNLVGQIPVMLGSRFNNSLDYAGNQGLCGEPLERCETSGNGGNKLIMFIAVAASGALLLLSCCCLYTYNLLRWRRKLKEKAAGEKKHSPARASSRTSGGRASGENGGPKLVMFNNKITLAETIEATREFDEEHVLSRTHYGVVYKAFYNDGMVLSIRRLSDGSLSENMFRKEAESLGKVKHRNLTVLRGYYAGPPNLRLLVYDYMPNGNLATLLQEASHQDGHVLNWPMRHLIALGIARGLAFLHSSSMVHGDIKPQNVLFDADFEAHLSEFGLGKLVVATPTEPSTSTSVGTLGYISPEAALTGETTRESDAYSFGIVLLELLTGKRPLMFTQDEDIVKWVKRQLQRGQISELLEPGLLELDPESSEWEEFLLGIKVGLLCTAPDPLDRPTMADIVFMLEGCRVGPDIASSADPTCQPSPA

SEQ ID NO: 27344 - protein, 250 aa, Bacillus cereus G9241
MAIAKQLGYAETAFISESEIADYKFEYFTPKEEVDLCGHATIGSFVILMHLNKLCQNRYTIETNSGVLTITIKDDIIFMEQNKPIFYDVVSPNEFIDCFDMKAIDDKYPIQIVSTGLKDILIPIKNETRLHTLQPNFEKIKEISKYYNVVGMHLYTFNDNRIICRNFAPLYDINEEAATGTSNGALACYLYEQHNLQKEVYVFEQGYSLRSPSEILVKLATNSNNKVEKVYVGGKGYYCETKYLNVENID

SEQ ID NO: 27345 - protein, 503 aa, Ralstonia eutropha JMP134
MEQSKAGTLIGAFAAFFPDATEIGSYVGGRLVAGTGQDIELFDPATGEKSLSYRDAGPAIAQQACIAAREAQKHWWSLTHAARGRILYAVAAKVREHNEPLAVLESMSQGKPIRDSRREVEMVAEMFEFYAGWADKFYGHVIPVPTTHLNYTRREPFGTILHIAPWNIPILSFGWQVAPTVAVGNAVLLKPSELTPFTSLAVASLAEQAGVPVGLINVLAGYGHTTGQAAIADDVVKKVVFVGSPATGIRIAEAAAKRVIPCILELGGKSANIVFDDANLDLAAIGAQAAVFSGSGQSCTAGSRLLIQRKVYQQVVDKVAEGARKLRLGHPLETSTEIGPINNRNQYEHIKRMIARGVEEGAQLAAGTTSFEDRGYFVPPTLFAGVSNQMDIARTEVFGPVIAAIPFDTEEEAIAIANDSEFGLAGAVWTNDVARAHRVAAQVDAGTFWINGYRAVHVGSPFGGYKNSGYGRTSGIEALYEYTQTKSVWVQTAASAVTAIGRA

SEQ ID NO: 27346 - protein, 497 aa, Euphronia guianensis
VDPTRSGPEVSRLVKKKSNLGRIAQIIGPVLDVTFPRGKMPNIYNALVVKGRDAAGQQINVTCEVQQLLGNNRVRAVAMSATDGLMRGMEVIDTGAPISVPVGGATLGRIFNVLGEPVDELGPVDSRTTYPIHRPAPAFIQLATKLSIFETGIKVVDLLAPYRRGGKIGLFGGAGVGKTVLIMELINNIAKAHGGVSVFGGVGERTREGNDLYKEMKESRVINEQNLAESKVALVYGQMNEPPGARMRVGLTALTMAEYFRDVNKQNVLLFIDNIFRFVQAGSEVSALLGRLPSAVGYQPTLSTEMGSLQERITSTKEGSITSIQAVYVPADDLTDPAPATTFAHLDATTVLSRGLAAKGIYPAVDPLDSTSTMLQPDIVGKKHYKTAQRVKQILQRYKELQDVISILGMDELSQEDRLTVARARKVERFLSQPFFVAEVFTGSPGKYVGIAETIRGFNLILSGELDSLPEQAFYLVGSIDEATAKATTLKMENNLK

SEQ ID NO: 27347 - protein, 573 aa, Oryza sativa Japonica Group
MLNGWVVLHDQTTSRRLADRKTAKFQKNITKRGSVPETTVKKGNDYPVGPLVLGFFIFVVIGSYLILLSSCEQIVCKERISYDRDRSVLIGGGGRRAMASGGDDAAAPLLASKHGGEPRRNTFAFACATLASMTTILMGYNLALMSGAELFIREDLGLADEQVEVLSGSMNVFMLASILAAGTVADAAGRRGTLVLANALLMAGALAMSLGGSYAALMAARFVTSVGVGFAVVVAPVYAVEISPASSRGVLSSLPEIFINAGILLSYVSNYALAGLPLRLGWRVMFAAGVVPPVFLAAGVLAMPESPRWLAMRGRDAEARAVLARTSDTPAEADLRLEEITRAVAAQAGVAGGVWRQLLVRPTPTVRRIMTNVLSLHFFQQASGIDVIVLYSPLVFKQAGMASNTSVLAATVAVGVVKTCSILVATLLSDRVGRRPLLLWSAAGMAVALASLALTLCVGAGAPSPARAAAGVASAAAYVAAFSVGLGPLAPSYGSEIMPLWLRAQGAGVGVAVNRVTCGVLSMTFISVAGGITMAGCFFVYAGAAVAAWVFVYVRLPETRGRSLEDMDVLFTK

SEQ ID NO: 27348 - protein, 388 aa, Blastopirellula marina DSM 3645
MLRVFSHAQKSCGNSMQMNYRRGHRQPMNALRNLTRRIGETAYSSITSQKSTEVADGILQAIGRTSLVRFRRYLDRQDVTLYAKLESQNPGGSAKDRPARQMLEAAIKEGEISSNATIIESSSGNMGIGLAQACRYHGLRFICVVDPNAQPQNVAIMRALGAEIELVTKRVNGDFLAARLARVCRLLEEIPQSYWPNQYANPQNPIAHEQGTIREIDELLKGEFDYLFVATSSTGTAQGCRNYLQSRGRDVKVVAVDAMGSVLFGGTSGERKIPGLGAGREPKLARGQSFSQIVRVKDVDCVVGCRRAAEREALLVGGSSGGVLETVRFMQDELAGKRCVAILHDSGTRYLDTVFDDAWVQETLGVSSQEIEYLKNAKAFSFASGLTQ

SEQ ID NO: 27349 - protein, 263 aa, Triticum aestivum
  misc_feature (18)..(18): Xaa can be any naturally occurring amino acid
MAKDVEQVTEPGEYSAKXDYHDPLPAPLIDPDELTKWSLYRAAIAEFIATLLFLYITVLTIIGYKRQSDTKIPGNTECDGVGILGIAWAFGGMIFILVYCTAGISGGHINPAVTFGLFLGRKVSLVRALLYMIAQCAGAICGAGLAKGFQKSFYNRYGGGVNTVSDGYNKGTALGAEIIGTFVLVYTVFSATDPKRNARDSHVPVLAPLPIGFAVFMVHLATIPVTGTGINPARSFGPAVIFNNDKAWDDQWIYWVGPFVEHR

SEQ ID NO: 27350 - protein, 182 aa, Thermosynechococcus elongatus BP-1
MGAATAASGQRLRNFVIAVVAILISFALLAGLGSDNQPLTLAEQAKHATPWEEAQVNGKPTLLEFYANWCSTCRSMAKDLGELKAQYRDRVNFVMLNVDNSKWLPEIEQFNVDGIPHFVFLNRQLEPQAVAIGLQPKEVMAKNLEALSNDLPLPYGQLTGEMSQLPSPLARQRSDDPRSHGG

SEQ ID NO: 27351 - protein, 482 aa, Galearia filiformis
EKKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPAGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLVETIRGFKLILSGELDSLPEQAFYLVGNIDEATAKATNLEMENNLK

SEQ ID NO: 27352 - protein, 636 aa, Ralstonia solanacearum GMI1000
MTYELLNTIDAPAELRRLDRRQLGTLADELRAFVLESVAQTGGHLSSNLGTVELTIALHYVFNTPDDRIVWDVGHQSYPHKILTGRREQMATLRQLDGISGFPRRSESPYDTFGTAHSSTSISAALGMALGAKTQGENRVAIAVIGDGAMSAGMAFEAMNNAGVYRNLPLVVVLNDNDMSISPPVGALNRYLARLMSGQFYAATKKGVEKLLSVAPPVLEFAKRFEEHAKGMLVPATMFEEFGFNYIGPIDGHDLESLVPTLQNIRQRALEGGRPQFLHVVTKKGQGYKLAEADPILYHGPGKFNPQEGIKPAARPAKVSYTQVFGQWLCDMAAADKRLVGITPAMREGSGMVEFEQRFPDRYYDVGIAEQHAVTFAGGLACEGLKPVVAIYSTFLQRGYDQLIHDVALQNLPVVFALDRAGLVGADGATHAGAYDMAYLRCIPNMMVMAPADENECRQLLSTAFAQDCPTAVRYPRGAGTGVVVQPTLEPLPVGKAEVRRASTAPAGQRVVILAFGSMVAPAAAAAERLDATVVNMRFVKPLDAACVLEMARTHDYVVTVEEGCVMGGAGSACLEALAAAGVATPVLQLGLPDRFVDHGDHAALLALCGLDANGILASIRERFAVQPRAVQPRVA

SEQ ID NO: 27353 - protein, 299 aa, Ralstonia solanacearum GMI1000
MSDFAHWMASVVARTESALERALPGESVAPQRLHAAMRYATLGAGKRVRPLLAHAAGALGEASPEALDGVSCAVEMIHAYSLVHDDMPCMDDDDLRRGRPTVHRAYDEATALLVGDALQTQAFIALAELGAVSPATRAGLVGELARASGSLGMAGGQAIDLQSVGVALSQDALETMHRMKTGALLRASLRMGALCAGVNAAALEQVDAYAGAVGLAFQVVDDILDVTADTATLGKTAGKDEANDKPTYVSILGLERARALADALHAAAGAAVAQLSRELGEARTARLAGMADLIVWRGH

SEQ ID NO: 27354 - protein, 482 aa, Hevea sp. Gillespie 4272
EKKNLGRIAQIIGPVLDVAFPPGKMPNIYYALVVKGRDTAGQEINVTCEVQQLLGNNRVRAVAMSATDGLTRGMEVIDTGAPLSVPVGGATLGRIFNVLGEPVDDLGPVDTRATSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSRGKYVGLAETIRGFKLILSGELDSLPEQAFYLVGNIDEATAKATNLEMENNLK

SEQ ID NO: 27355 - protein, 401 aa, Deinococcus radiodurans R1
MQTAGPITREALRTQFPSLAGGRAYLDNAAGGLLPTRSIQAVTEHLTRFGATNAMPGHAPGQQIGQLKARAREGTALFLNAEAPDVALGPSATALAFRLAAAFARLWGPGDEVIVSGLEHEANASPWRELERVGVTVKVWHARAPEMRLHPDDLAALLSPRTRLVAVTAASNVLGVAPDIAAITAQVRAAGGWTVVDAVHAAPHLLPDVQAWGADFVTFSPYKVFGPHLGGLWIRPELRPQLPWPRLSFVEDGDITGIEHGTPQYELLAGWLGTLDYLRELGGGDTLTRAALVAAFEQIAALERPVTEALLTGLLARPYVTVYGPQTLEGRVGTVAFQVQGEAPLDTALRLSAQGVDVAAGHFYAVQPLRDLGLYPDGVARASLAHYTSEEDVARLLAALG

SEQ ID NO: 27356 - protein, 568 aa, Kluyveromyces lactis NRRL Y-1140
MSASVSSGSEKNNYIIGAQEVKNKVDVVTSLRTITSRRVGDVNYINAKAAHDDTELLAEIGYKQELQRHFSKIQVFGVAFSIMGLLPSIASVLSLALPGGSVSLVWGWGIAGAFVLTNGLAMSELASAIPTSGGLYYYTYYYAPPKVKNLLSFVVGNSNSLALIAGLCSINYGLAGEILSIVVVGSDGNFNITNASTYGVYAACIVATAVVTSVATVAVSKLQTFSIVSNLLLICIFFVALPVGVARSNHMEFNDAKYIFGNFQNLSDWNDGWQFMSAGFQPLIWVIGGFDSCIHMSEEAKNATASVPFGIIGSISVCWVLGFFICIVIAACSSQDVAAIVETKFHQPLAQILFDALGKRWTIAIMVLIAFCQFLMAASILTAISRQIWAFARDDGLPFSSWIKVVNIKLSSPLRATWVGAGAALAIGCLCLIGPVASSALFSLAVSANYFSWMVPNLLRMTYGKDVFTPGAFFMGKYLSPVVNWISIVFEIFMILLVFFPADQHGITPDTMNYSVVFIGAVWVLPTIYYLVYKYKFYSGPKSNLTDEEYEEKVGQDVLDAILSKHQD

SEQ ID NO: 27357 - protein, 485 aa, Pseudomonas putida KT2440
MESGGLTIPCDILVFGGTGDLALHKLLPALYHLFREARLNPAVRVIALARRNLPRIDYLKLAERHCRAQIARSDFDEEVWQRFSARVDYFPMDASQSADFGRLARYLGEPGGLTRIFYLATAPNLFVPIANHLRIAGLADTEARIVLEKPIGHSLESATAINEAIGTVFEERQVFRIDHYLGKETVQNLMALRFANALLEPVWRNNQVDHVQISVCETLGVENRGAYYDRAGAIRDMLQNHLLQLLCLVAMEPPAQFEAEAVRDEKVKILRALKPITGQDVQDKTVRGQYGAGRIGGQEVPAYYFEKDVDNDSDTETFVAIEAHIDNWRWAGVPFYLRTGKRMARRASQIVIQFKPVPHELFSGGQVNQLLIQLQPDERISLRMMTKSPGKGMRLEPVDLDLNLAQVFSQTRRWEAYERLLLDVLEGDSTLFMRRDEVEAAWAWVDPIIKGCEEHFQAPRPYPAGSFGPEQANSLLARHGRHWHG

SEQ ID NO: 27358 - protein, 524 aa, Chlamydia muridarum Nigg
MGKSFLDCESLIALQEIATNPVDLTLPGTLSQDRIQQYALSAEGFTYSYATERVDDRSLNALRMLAEERELIKQMESMQQGAVMNYIEGFQSESRSVLHTATRAWVRDHDLKDEAASIANHSEREAHRLAEFLYAARSKFSTLVQIGIGGSELGPKAMYFAMQGICPSDKRIFFVSNIDPDNAAEVLKEVDLKQTLIVVVSKSGTTLEPSVNEELFKRAYQDKGLSVADHFVAVTAEGSPMDDKTHYLEVFHLWDSVGGRFSATSMVGGVVLGFAFGYEVFFEFLQGAASMDAHALTPIMEKNLPLLSAMLGIWNRNVLKYPTTAVIPYATGLKYFTAHLQQCGMESNGKSISRQGKEVHFATSPIIWGDVGTNCQHSFFQSLHQGTDIVPVEFIGFLQNQRGIDCVLSGSSSSQKLFANLVAQSLALAQGRDNDNPNKRFKGNRPSSILVAQQLSPRIAGGLLAFYEHKFAFQGFCWGINSFDQEGVSLGKELATQIIGLMSGAAPIEFPEARELLRLFNVLQ

SEQ ID NO: 27359 - protein, 442 aa, Burkholderia xenovorans LB400
MTSRPVIDDLSSFWMPFTANRQFKAAPRLLESAKGMYYRSTDGREVLDGCAGLWCVNAGHGREEIIAAITQQLSTLDFAPTFQMGHPLAFEAATKVAELMPEGLDRIFFTNSGSESVDTALKIALAYHRSRGEGQRTRLIGRERGYHGVGFGGISVGGIAPNRKTFSGALLPAVDHLPHTHNLEQNAFSKGQPAWGAHLAEELERIVTLHDASTIAAVIVEPVAGSTGVLIPPQGYLQKLREICTKHGILLIFDEVITGFGRVGKATASEYFGVTPDLITMAKAINNAAIPMGAVAASRTVHDTIVNSGAQGAIELFHGYTYSAHPAATAAAIATLDLYRREGLFERAATLAPTFEAAAHSLRGAKHVKDVRNIGLIAGVELESRDGAPGARAYEAFVKCFEAGVLVRFTGDILAFSPPLIINEEQIAHIFKTVGDVLATVQ

SEQ ID NO: 27360 - protein, 167 aa, Methanopyrus kandleri AV19
MLVKGGCELSKRRVLSVLVKDRPGVMQRVSGLFRRRGFNIDSIAEGPSEREGLARMTLTVKGNEQTIEQVVKQLNKLVDVIKVSELDPERTVERQLALVKIRTKDRARAAELARAAGAEVVDVGRETITVEIVGEPQDVESLLELMKDIGNIVEIARTGIVAMERET

SEQ ID NO: 27361 - protein, 358 aa, Aspergillus oryzae
MRAVVYTGKDTISVEERPKPSLLEPTDAIVKVQHTTICGTDLHILQGHVQTCTPGRILGHEGVGIIESLGTGVTRFSVGQPVLISCITSCGSCNFCRKRMPSQCTSGGWILGNTIDGTQAEFVRIPHASFSLHALPNGLDPKVAVTLSDVLPTAYECGILNGQIQPGSTVAIIGTGPIGLMALQMARNLFGPSMTAVVGRGQPRLDTAKEMGADHAISVLGGQADAVASALAVTSNQGFDVVIEAVGTTDSFELAQALVGPGGTIASLGVFGTPCALHLEDLWHRNICIRTRLVDACTTPDLLKIVESGKISPHFLVSHNFSFDQIYKAYETFQTPSKSGSLKVVISMAELQPANPRL

SEQ ID NO: 27362 - protein, 261 aa, Pseudomonas aeruginosa UCBPP-PA14
MQLEFHQVDAFSSRPFSGNPAVVYRLGAWLADELMQMIATEHNLSETAFVVREGEAWRIRWFTPSVEVALCGHATLAAAHVLFEVYDEPGERLEFISRSGALRVNREDERLVLDFPAQYPSEVGSTVELEQALGLPPVDVLGSTDKLLVLLESEEAVRACRPDFAALARLPWRGVIVTARGMQKDFVSRFFAPAMGVDEDPVTGSAHCSLIPYWAQRLNKLSLTAQQCSARGGELWCRLEGERVSIAGHAVLVASGRIRLG

SEQ ID NO: 27363 - protein, 117 aa, Brassica napus
IQVQSKACEASKFVAKHGTSYYRQLLEKNNHFIQEPATVDKCQELSKQLLYTRLASIPKRYETFWKELDYAKNLWKNRSDLKVEDAGIAALFGLECLAWYCAGEITGRGFTFTGYYP

SEQ ID NO: 27364 - protein, 561 aa, Thiobacillus denitrificans ATCC 25259
MNPHSRFLPATPNLPRRRFLQGLAAGGILLGAPSLILPASAREAGTAAGSAPVLSGTEFDLTIAETAVNFTGKPRMATTINGSIPGPTLRLREGDTVTIRVHNRLTEDTSIHWHGILLPFEMDGVPGISFKGIPPGQTFTYRFKVKQTGTYWYHSHSGMQEQTGMYGTIIIDPARGNSVGADRDYVVQLSDWTDEHPMRVLHKLKVQGDYFNFNQPTAGDFFRDVSKEGLKAAIDKRRMWNEMRMSPTDLADVSAHTYTYLMNGAAPAGNWTGLFRPGGKVRLRFVNSAAMTFFDVRIPGLKMTVVQTDGQDVEPVTVDEIRIGVAETYDVIVSPKDEAYTIFAQSMDRTGFARGTLATRAGLVAAVPSPDKPVALEMQDMMGDMTGLARAHHARTEYGPSVDMRVDTPRTDLDDPGVGLRDNGRRVLTYDHLHSVGGPLDARGPGREIELHLTGNMERYAWSIDGVEFEKSTPVHFRHNERLRVVFVNDTMMTHPMHLHGMWSELESPEGKFQVRKHTIAVQPAQRVSFLVTADALGRWAWHCHLGLHMDMGMFREVVVA

SEQ ID NO: 27365 - protein, 348 aa, Zea mays
  misc_feature (17)..(17): Xaa can be any naturally occurring amino acid
DPQTTLEEVVSKTFTTXAETMLNARTLKEWIVSSLGPQAVAKHMIAVSTNLKLVKEFGIDPNNAFAFWDWVGGRYSVCSAVGVLPLSLQYGFPIVQKFLEGASSIDNHFYSSSFEKNIPVLLGLLSVWNVSFLGYPARAILPYSQALEKLAPHIQQETGEIDFGEPGTNGQHSFYQLIHQGRVIPCDFIGVVKSQQPVYLKGETVSNHDELMSNFFAQPDALAYGKTPEQLHSEKVPENLIPHKTFKGNRPSLSLLLPTLSAYEVGQLLSIYEHRIAVQGFIWGINSFDQWGVELGKSLASQVRKQLHGTRMEGKHVEGFNHSTSSLLARYLAVKPSTPYDTTVLPKV

SEQ ID NO: 27366 - protein, 187 aa, Methanopyrus kandleri AV19
MILIIDNHGQYVHLIRKNFDYMGVPAEIIPNTTDPEDVRERASGVVISGGPSRERAGNSREIIEELTGEVPILGICLGHQLMAEVFGGKVDWAAGREEYARTEVEILDHEGIFEGLPDKIVAWASHRDEVKEVPDEFVVTARSDRCEVEAMRHEELPLYGVQFHPELKFTEYGPDILKNFAKLCGEL

SEQ ID NO: 27367 - protein, 608 aa, Caulobacter crescentus CB15
MADHDDLSPDSAPPWDEAPAERDENTADIFGDAPAPAAEARPVVETPPEGEKGDAYTVLARKYRPRTFEDLIGQEAMVRTLANAFSTGRIAHAFMLTGVRGVGKTTTARLLARALNYETDTVKGPSVDLTTEGYHCRSIIEGRHMDVLELDAASRTKVDEMRELLDGVRYAPVEARYKVYIIDEVHMLSTAAFNALLKTLEEPPPHAKFIFATTEIRKVPVTILSRCQRFDLRRVEPDVLVKHFDRISAKEGARIEMDALALIARAAEGSVRDGLSLLDQAIVQTERGQTVTSTVVRDMLGLADRSQTIALYEHVMAGKTKDALEGFRALWGFGADPAVVMLDVLDHCHASAVSKALGPDALSMPKEQAARLAAIGAHTSAGTLSRLWQMLLKAHDEVRRAPDAMAAAEMALIRLVYAADLPGPEEALKALRDGAPVGGGGPGGGVAIGGGGAGGATASAQSPVMMAAPGAQAMPVLASFDDVMALIAAKRDIGLRLDVEQYVRPINFRPGAITFEAAPGAPGNLAGRLVRFLKEHTGQPWLVAAEGGGGAESLMERQKREEREALEAIKQDPFVASVLSAFPGAEIVEIRKILTPETAPLEPDEEEG

SEQ ID NO: 27368 - protein, 243 aa, Campylobacter jejuni RM1221
MLYILANGSMATALAYGLKDDYEICIVGRSIEKLQALAKEGFKTLLYKDFNIEGKDVILAFKPYALENIAQMLKGQARILISVLANVDFEKLQTIKAQNYVRIIPNTAAKYKASTTPYILKNSHFENEILDILKTFGSAYKLDNEIQMNAAMAISGCAPAFLALIAESIANAGVYEGLSKELSLNLTRSLFKSSSALLEHEHPAIIKENICSPGGVTIKGIKILEQKGIRGSFFEAINASSAK

SEQ ID NO: 27369 - protein, 492 aa, Kluyveromyces lactis NRRL Y-1140
MFRLGRNSTVGRLARGKWYSQISKNAENSQVTTLDNGVKVATSNVPGHFSALGLYVNAGSRFEDKNLKGCTHIMDRLAFKSTDHISGRDMTETLELLGDNYQCSSSRETMMYQSSVFNPDVEKMFHLMSETVRYPRITEEELEEQKTTALYEIDGVWQKHDLILPELLHQTAYSGETLGSPLLCPKELIPSISKYYLTDYRNKFYNPENIVAAFVSVPHDDAVQLTEKYFGDMKSKYPPVTKKPAKYTGGEYCIPPGPVFGGLPELYHMQLAFEGLPIDHPDIYALATLQTLLGGGGSFSAGGPGKGMYSRLYTHVLNQYYYVENCVSFNHSYSDSGLFGVSISCIPQAAPFAAEIIAQTLSNVFANDKLKLTKEEVSRSKNQLKSSLLMNLESKIVELEDLGRQVLLHGRKIPMKEMMENIEKLTVDDIKRVAETVFTGKVNNPGNGNGKVTVVMQGERESFGDIETVLRFYGLGNYPKLDVPKMKKQGWF

SEQ ID NO: 27370 - protein, 512 aa, Gerbera hybrid cultivar
MTPLTLLIGTCVTGLFLYVLLNRCTRNPNRLPPGPTPWPVVGNLPHLGTIPHHSLAAMAKKYGPLMHLRLGFVDVVVAASASVAAQFLKTHDANFADRPPNSGAKHIAYNYQDLVFAPYGPRWRMLRKICSVHLFSTKALDDFRHVRQEEVAILARALVGAGKSPVKLGQLLNVCTTNALARVMLGRRVFDSGDAQADEFKDMVVELMVLAGEFNIGDFIPVLDWLDLQGVTKKMKKLHAKFDSFLNTILEEHKTGAGDGVASGKVDLLSTLISLKDDADGEGGKLSDIEIKALLLNLFTAGTDTSSSTIEWAIAELIRNPQLLNQARKEMDTIVGQDRLVTESDLGQLTFLQAIIKETFRLHPSTPLSLPRMALESCEVGGYYIPKGSTLLVNVWAISRDPKIWADPLEFQPTRFLPGGEKPNTDIKGNDFEVIPFGAGRRICVGMSLGLRMVQLLTATLIHAFDWELADGLNPKKLNMEEAYGLTLQRAAPLVVHPRPRLAPHVYETTKV

SEQ ID NO: 27371 - protein, 257 aa, Bacillus cereus G9241
MYFEYKNRKVFYNIEGSGPVILFLHGLGGNTNNWLYQRQYFKKKWTVISLDLPGHGKSEGLEIPFKEYANVLYELCDYLRLQKVVICGLSKGARVGIDFAIQYPDFVSSLIIVNAFPYLEPEDRKKRLAVYDLLSLHDNGKTWADTLLKAMGVANNEVIVRGFYQSLQSIHPMHIQRLFAELVDYDQRPFLSNVLCPALIIRGRNDDFVPEKYVREFEKYLKNITFIEFKNSGHLPYLEQPTSFNVTVETFLNCAPN

SEQ ID NO: 27372 - protein, 448 aa, Triticum aestivum
MTREAMRKKAKAVPEWLNSPLWSTPPLASTLADPFGTDFSPPPAPSPEPSPSVPPPPMREQAVDSHAGREGETREEDGAGAALRAHLLADFKAALSKKVVNMGELRRLACLGVPDGGGTDVRPLVWKLLLGYLPTERSLWPYELEKKRSQYSAYKDEFLLNPSEKLRRIEESKLSRKKELTGERNGLLPRSEVTNEEHPLSFGKSSLWNQYFQESEILEQIDRDVKRTHPDKSFFSAKSNQESLRRILIIFSRLYPSVRYVQGLNEVLAPLFYVLKNDLDTSNSTSAEADTFFCFVELISGFKNNYCKHLDNSRVGIRATLSKLSQLLKKHDEELWRHMEVITKLANILRHAISQVYPQYYAFRWITLLLTMEFSFNVCIHIWDAMLGDPEGSPDTLLRICCAMLILVRKRLLVGDFTANIQLLQHYPQTNIDHLLHIANRLRGTMPS

SEQ ID NO: 27373 - protein, 243 aa, Idiomarina loihiensis L2TR
MRVIKLGGSLLEQPDEMRALFASLSDTENNTVIVHGGGALAQQWLSTAGLKSEKHEGLRVSPEQHMPYIVGALAGCANKQLMSWAIAAGAWPIGLTLHEAGISCRRQSAELGQVGTCELFESGLITNLLKCGYLPLISSIGFGKQGEWFNVNADDAAVAVAANLDADLLFLTDVDGVLDSEGRLIEQLDSRSIDELTKSGVIRYGMLVKVRSALNAAKRLRRCVRIGSWNLISKTHSGTQISE

SEQ ID NO: 27374 - protein, 316 aa, Idiomarina loihiensis L2TR
MMKHCLSGLELTPANTLQLLALAQEQKAHPEKYRQTLAGRSVVTLFEKPSLRTRLSFDIGLQKLGGHAVYLNEQGKGMGVRESVADYARNLSCWADAIVARVMSHHTLQELAQHASVPVVNSLCDRFHPCQALADFLTLQEHYGKVKGLKLVYLGDGNNVSHSLMLTAAALGTDCTIICPRGYEPDAELVKKAKKQAEESGADIVVTHDIAAVAGADALYTDTWVSMGDDKPLSEVRDTFQPYQINSQLVEHSGATSVLHCQPAHRGYEITSDVMDGPLSRCFQQAENRLYAQNALLTLLLNPTAAALPEFMEKAS

SEQ ID NO: 27375 - protein, 294 aa, Burkholderia vietnamiensis G4
MLKVTKAVFPVAGLGTRFLPATKASPKEMLPVVDKPLIQYAVEEAIEAGITEMIFVTGRSKRAIEDHFDKSYEIEAELEARGKEKLLSLVRSIKPSHVDCFYVRQAEALGLGHAVLCAEKLVGDNPFAVILADDLLDGPTPVLRQMIDVFDHYHASVIGVEEIAPADSKSYGVIDGKRWEDDLFKLSGIVEKPEPAQAPSNFGVVGRYVLKPKIFKHLRGLKPGAGGELQLTDAIQSLLTDEQVLAYRYDGTRFDCGSKLGYLKATVEFALRHPEVAADFERYLLARMSEQLVV

SEQ ID NO: 27376 - protein, 299 aa, Zea mays
QHRPRFFLPLLWSIVGVSRSVICSICVLLCGRLVLGYAYPAYDCYKTVELNRPEVEQLRFWCQYWILLAFLTVLERVGESFVSWLPMYSEAKLAFIVYLWCPKTRGTAYVYESFFKPYIAKHETEIDRNLLELRTRAGDMAVLYFQRVTNYAQTRSYEILQYIASQSPTQRQAHQQQQRPPPPRTRQVNPAPPPVPAPSAPPMPPQPAQAQVPPTPPRPLVPVVPPGAVPPAPPPPAPEATATNGLQDTETMQVDPPRASLSGPPPPLPPEETLIEEAIRLTRGRLRRRLAGGSGPPQN

SEQ ID NO: 27377 - protein, 389 aa, Prochlorococcus marinus str. MIT 9211
MDLQVAASKQGVDKQAAAAKKAAAERQAAAAKKAAAERQAAAAKKAAADKKAAAERQAAAAKKAAADKKAAAERQAAAAKKAAAERQAAAAKKAAADKKAAAERQAAADKKAAAAKKAAADKKAAAERQAAAAKKAAAAKKAAAERQAAAAKKAAAERQAAAAKKAAADKKAAAERQAAAAKKAAADKKAAAERQAAAAKKAAADKKAAAERQAAAAKKAAAERQAAAAKKAAADKKAAAERQAAADKKAAAAKKAAADKKAAAERQAAAAKKAAADKKAAADKKAAAERQAAAAKKAAADKKAAADKKAAADKKAAAAKKAAADKKAASNAQQKPIQKLKTVSEKKREEKNELLKISVYLDTGKVIGLVSIGVFASAILMTAFAFIAR

SEQ ID NO: 27378 - protein, 447 aa, Yarrowia lipolytica CLIB122
MLRTIRSQSMRMASASSRRMLSSAASTSMLRQTLKAPSMTAQVTRPTVMTFKPVLLSRGYADVVEVPPMAESLTEGTLTAFEKDIGDFVEADEEIATIETDKIDVAVNAPFAGTITEFLVKPDDTVTVGQPLLKIERGEGSSSGGSKPPKEKKEEKTEEKEEPAPKEESAPAPKKEEAPKKEESAPAPKKEEKKPAPKEEKKTDATEGLGGFRKEERVKMNRMRLRIAERLKESQNTAASLTTFNEVDMSSLMEMRKLYKDEMLKKTGTKLGFMGAFSKAAALAMRDVPAVNAAIEGPNGGDTIVYRDYVDISVAVATPKGLVTPVVRNVDQLDVMGIEKAIHDLGVKARDNKITLEDMAGGTFTISNGGVFGSLFGTPIINMPQTAVLGLHGVKDRAVVVDGQVVSRPMMYLALTYDHRVLDGREAVVFLRTIKELIEDPRKMLLM

SEQ ID NO: 27379 - protein, 404 aa, Deinococcus radiodurans R1
MSDSITLSTIPDLLAELRAGRPVILVDDENRENEGDLLMPAATATPQWVNFMAREGRGLICVTLTPERARRLDLTPMVGAGAYGQGTDPNGTAFTVSVDHSSNSTGISAYDRAATIAALLEDTSQPTDFRRPGHIFPLVARPGGVLRRAGHTEAGCDLARLAGFAPVGVICEIMGDDGEMSRLPDLLAFGEKHGLKVGSIEALIAYRMEHDPFMEPVAEAELPTRFGDFRLIGFQDTLSGAEHVALVMGEVTPEPLLVRVHSECLTGDAFHSLRCDCGPQLDAALQAIAEEGRGAVIYLRQEGRGIGLLNKIRAYALQDGGADTVDANLQLGLPADARDFGIGAQILHLLGARKLRIMTNNPRKLHSLSGFGLEVVERVPLHVGEDPHNAGYLRTKREKLGHLR

SEQ ID NO: 27380 - protein, 469 aa, Burkholderia vietnamiensis G4
MKITIIGTGYVGLVTGACLAEIGNDVFCVDVDQRKIDILNGGGVPIHEPGLKELIDRNRASGRLQFSTDIEASVAHGDIQFIAVGTPPDEDGSADLQYVLAAARNIGRYMTGAKVVVDKSTVPVGTALHVRDAIATELTRRGVRHEFSVVSNPEFLKEGAAVDDFMRPDRIVIGTDSDEAGERAREQMKRLYAPFNRNHERTRYMDVRSAEFTKYAANAMLATRISFMNELANLADRVGADIEAVRRGIGSDPRIGYDFLYAGVGYGGSCFPKDVRALVQTAAEYGQSLRILEAVEAVNDAQKKVLLEKISERFGEDLSGLTFGLWGLAFKPNTDDMREAPSRDLIAGLLKRGASVRAYDPVATEEARRVLALDLGDDPGAHARLQFVATSEEAAAGADALVIVTEWKVFKSPNFAALVELLNEPVIFDGRNLYEPEAMGELGVEYYSIGRPHSVRTSKSVRTLKAARG

SEQ ID NO: 27381 - protein, 305 aa, Rhodospirillum rubrum ATCC 11170
MAKYALCVGVSDYSNWRHGADGPSDLAFGVTSAEQFRDLLIHAFAFPEANIRMMRNGWASKGNILQGFKELVDAAQPGDVVCIFFSGHGGLIPGVAAGGQPEPDLFYETIVPHSGAMITDYEFNALSNRLSPSQVNLTIVLDSCHSAGMSAIEGAPRPRGFLGAAPAGFSFCRALKRAGLCVAGRDAMACVPGDLAKLTIAPADQFVEQARATLISACRTDQSSWDAPSLNGSVFMTAMVDIVRQSGLAISNTAFVAELAARAQTLMASAINAIPRYATEKSEPQLYGQRNRMAETVLAGFTDSR

SEQ ID NO: 27382 - protein, 155 aa, Deinococcus radiodurans R1
MQRIEATLLAHDLKFALVSTRWNHLIVDRLVEGAELAFVQHGGKTENLDHFLVPGSYEVPLVARRLAETGRYDAVVCLGAVIKGDTDHYDFVAGGAANGILNTSLHTGVPVAFGVLTTDTVEQALNRAGIKAGNKGGEAVLAMIETANLLKQIER

SEQ ID NO: 27383 - protein, 440 aa, Synechococcus sp. RS9917
MPALSSTMTEGKIVEWLKQPGDKVARGESVLVVESDKADMDVESFNEGYLAAVLMPAGSTAPVGETIGLIVESEAEIAAAQAKAGGGGGAATPAAAPAPATAHATAPTPAPPAAPAPAPAAAVVPPALEQPAALANGRIVASPRAKKLAAQMGVELTKVRGSGPNGRIQAEDVERAAGRPVTPPRVGEGTAVAIVAGAASAAPTAPASPAGNSFGAPGETVAFNTLQQAVNRNMEASLAVPCFRVGYTITTDKFDAFYKQVKPKGVTMTALLAKAVAVTLARHPQVNAATTAAGMAYPADVNVAIAVAMEGGGLITPVLRQADRTDLYAMSRQWADLVKRSRSKQLQPEDYSTGTFTLSNLGMFGVDRFDAILPPGTGAILAVAASRPTVVAGNDGSIAVKRQMQVNLTADHRVIYGADGAAFLKDLAELIETRPESLAM

SEQ ID NO: 27384 - protein, 272 aa, Shewanella sp. MR-7
MTEAYQNRFGGIGRLYGQKALAQFAASHVVVIGIGGVGTWAAEALARSGIGQITLIDLDDICVTNTNRQIHALTSTIGESKVAVMAQRIRSINPDCQVNEVEDFITVDNLGEYLLGSKAGGNIGYVVDCIDAVKQKAALIAWCKRQKIKIVTVGGAGGQTDPTQIQLTDLAKTYQDPLLAKVRNILRREYNFSKNVQRRFAVDAVFSSEQLVYPQADGSVCSSKATADGSMRMDCASGFGAVTMVTGTFGFVAASRVLARLAQLANEPGASE

SEQ ID NO: 27385 - protein, 210 aa, Deinococcus radiodurans R1
MSGPGTPFVIGVAGGSGSGKTTVTRRVIETVGREGVAVLNQDNYYRDQSDIPFESRLHTNYDHPAAFDWALLREQLDALLAGVPIEMPEYDFTQHTRAAHTTRVLPGRVVVLEGFFALYDEELRSRMGLKVFVDADADVRFIRRLLRDTQERGRTPESVIEQYLGFVRPMHLSFVEPTKRYADVIIPHGGMNEPALDMLAARIRVMAQRD

SEQ ID NO: 27386 - protein, 282 aa, Zea mays
MEKHINLEVRFLLNLRYKAITTSQRRRSATSMAVRSVKVGNLSSGAKEHDIKEFFSFSGEVESIDIQSNEHSAYVTFKDPQGAETAVLLSGASIADQSVVIEMAPNYTPPAAPHAETQSGGVAESVVQKAEDVVSTMLAKGFILGKDAVGKAKAFDEKLGFTSTATAGVASIDQKIGLSQKITAGTSLVTEKIKGVDQSFQVTERTKSAFATAEQTVSSAGTAVMKNRFVLTGVSWAAGAFNRVAKAAGEVGQKTKEKVEAEQPPQPSQSEQKPPEGYFPLH

SEQ ID NO: 27387 - protein, 289 aa, Ralstonia solanacearum GMI1000
MQRVTKAVFPVAGLGTRFLPATKASPKEMLPVVDKPLIQYAVEEAMAAGITEMIFVTGRSKRAIEDHFDKAYELEAELEAKQKTALLEVVRSIKPAHVDCFYVRQPEALGLGHAVLCAEKLVGNAPFAVILADDLLDGNPPVMKQMVDLYEHYNCSVIGVEEIEREQSRSYGVVDGRPWEEDGSVIKMSGIVEKPAPEAAPSNLGVVGRYILTPRIFDHIRNIKPGAGGELQLTDAIQSLLSAEQVLAYRYDGVRYDCGSKLGYLKATVELALKHKEVAEEFREYLASR

SEQ ID NO: 27388 - protein, 174 aa, Coprinopsis cinerea okayama7#130
MSELFNANPVVFSTTKPSSSRLAEKSAQSLWLYDNSDTEEEGNEVEEIDQDEVFGMIQELKLITAKLRSFSSDLIRSIYDPEHPNTLEELRVVSASQVTVGHNRIKVEFTPTASQSESAYSEAFQVGTRSILWSNQVLTRLNDKERVAAALENPPLVETVEKCLANTCAHDHAH

SEQ ID NO: 27389 - protein, 327 aa, Erwinia chrysanthemi
  misc_feature (327)..(327): Xaa can be any naturally occurring amino acid
ADKLPNIVILATGGTIAGSAATGTQTTGYKAGALGVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVINDRIGSARYITKTNASTLDTFRANEEGYLGVIIGNRIYYQNRIDKLHTTRSVFDVRGLTSLPKVDILYGYQDDPEYLYDAAIQHGVKGIVYAGMGAGSVSVRGIAGMRKALEKGVVVMRSTRTGNGIVPPDEELPGLVSDSLNPAHARILLMLALTRTSDPKVIQEYFHTX

SEQ ID NO: 27390 - protein, 316 aa, Coccidioides immitis RS
MGSSDKGRAGQTGAARSSSPKIHYPFWFGGSASCFAAAVTHPLDLVKVRLQTRGPGDPTGMMRTIVHICRSNGFLGLYNGLSASLLRQITYSTTRFGIYEELKSRVTQSSSSPPSLLTLIGMASFSGFVGGLVGNPADVTNVRMQRDAALPPEKRRNYRHAFHGMSQMLRTEGAASLFRGVWPNSLRALGMTAAQLASYDEFKQICMGHFGMADNITTHLTASVMAGFVATTLCSPIDVIKTRIMGASSAESSGHTIVGFLRDIFKKEGFSWMFRGWIPSFTRLGPHTVATFLFLEQHKKIYRALKRPDSDTKATL

SEQ ID NO: 27391 - protein, 306 aa, Coprinopsis cinerea okayama7#130
MGYTLCVLGCGTMGIAVLSGVIASLDSAKGVSQANGVKPQKWEIHTPGTVTPTAETPDPTIPKKFIACVNRESSAKKLAETFSALGPRGQSVEVVAKQNLESVQRSDVVLLGCKPQVAQVILGEPGMKEALDGKLLISILAGVTMSQLEAMVLPTTRIREGMTVVSNLPPSPHSDNDTEIILKIFSSIGRCRFLEEKHFDACTALGGSGPAFACLFLEAMADGGVMMGLPRAEALELAAQTLQGAARMVLGGSMHPAQIKDSVTTPGGCTIAGLLALEDGKVRSTIARGIQAATERASELGQPANK

SEQ ID NO: 27392 - protein, 434 aa, Methanopyrus kandleri AV19
MWRTVKMGGSTTKFGFFTLVGYTALLLSLGAIVARLSEDRGLPDIPFLLLLGFLLGPIAGIVRPEYAQKAFPFVGTLGLIIILLDGGFEIGIDVLRRVASLVAKLDSITLLITAGISSLIFNLVFGLKPFSPIGFLYGSITCATDPATLIPVFSKVELPINISTALIAESVFNDPLGVVLTKMSLSVMGLSSHQNPILLFISLAAGGAALGLATGVVLERLLAREPFGEYVVPITLGAALALWYICEELLPGLLGYELSGFMAVAVLGMYLGNNLIKHDYLKDDRTFLKDFFEELSTVVRIMVFTLLGACVSISLLKTFWLKGLVCALSNVFIARPAGVIIGTYIPPKEDLNLKERIYLALEGPRGVVPAALVGTIYSKIVSNPHAVPVAIASEMPPKTLASAILVTTFLTIFISVVLEATWAQPLAKRLLKEE

SEQ ID NO: 27393 - protein, 512 aa, Pseudomonas aeruginosa UCBPP-PA14
MSQAHTPSAPLAEVYDVAVVGGGINGVGIAADAAGRGLSVFLCEQHDLAQHTSSASSKLIHGGLRYLEHYEFRLVREALAEREVLLAKAPHIVKPLRFVLPHRPHLRPAWMIRAGLFLYDHLGKREKLPASRGLRFTGSSPLKAEIRRGFEYSDCAVDDARLVVLNAISAREHGAHVHTRTRCVSARRSKGLWHLHLERSDGSLYSIRARALVNAAGPWVARFIQDDLKQKSPYGIRLIQGSHIIVPKLYEGEHAYILQNEDRRIVFAIPYLDRFTMIGTTDREYQGDPAKVAISEEETAYLLQVVNAHFKQQLAAADILHSFAGVRPLCDDESDEPSAITRDYTLSLSAGNGEPPLLSVFGGKLTTYRKLAESALAQLQPFFANLGPAWTAKAPLPGGEQMQSVEALTEQLANRYAWLDRELALRWARTYGTRVWRLLDGVNGEADLGEHLGGGLYAREVDYLCKHEWAQDAEDILWRRSKLGLFLSPSQQVRLGQYLQSEHPHRPRVHAA

SEQ ID NO: 27394 - protein, 457 aa, Zea mays
MGERAKEWLLAAGAGAAVGALSAAAVIDLLSRSKRRERYARDLLESNGMTTGNTRSSKHLGSLGSSALLSDEVVSEQLTRNIQFFGMDSQKKVTESYVVVIGLGGVGSHAASMLLRSGVGRLLLVDFDQVSLSSLNRHAVATRDDVGTSKALCLKKHFSMIYPECQIDAKVQLYDASSEEEILSGQPDFVLDCIDNIDTKVSLLAACVRRGLKVLSAMGAGARADPTRIRVADLRESSNDPLSRSVRYRLKKEHGIEGGIPVVFSLEKPKAKLLPFQASKEEETPSDYQIVPGFRVRIIPVLGTIPAIFGQVMASYVVTQLAGLDFQTEPVVNLDLDHYRILHQRLIEHEELMYGTAEQVLVDAEEVMYIVKELWRGRSARDQSQDTGRKMWRSVNELMLVRWDKSKAAGISNLILVKFSEADAHESTTLDRIKEQEPEFYSMVSRVLKRAEMEFAL

SEQ ID NO: 27395 - protein, 393 aa, Chlamydia muridarum Nigg
MKRNPNFTSLTQNYLFSDLRNRIAQFHSENPQHQVINLSIGDTTQPLDTSVAEAFSQAIARFSSPSTYCGYGPDFGLPSLRQKLSEKLYHGCVNAEEIFISDGAKVDLFRLLSFFGPNQIVAVQDPSYPAYIDIARLTGAKEIVSLPCLQENDFLPVFPENTHIDILCLCSPNNPTGTALNKNQLRAIVRYAIEHNILILFDAAYSAFISAPSLPKSIFEIPDARFCAIEINSFSKSLGFAGIRLGWTVIPKELTYEDGQPIIRDWKRFLSTTFNGASIPAQEAATAGLSTLSKLEAVHYYKENSHLLKTSLLKAGFQVFGGEHAPYLWVKPTIETVPYRDLFDFFLQEYHIAITPGIGFGLCGSGFVRFSSLGKREDVLVACERLQMTPALQ

SEQ ID NO: 27396 - protein, 301 aa, Rhodospirillum rubrum ATCC 11170
MTKRAVVAGINDYRNWNSVGFGNLSWCLTDAQSFAEDVLVHGRGFRPDDITVLLDRDATRTNILEHLRRLLARADLGDVICLYFSGHGDRAQVPGTPSEWHETIVPYDGAAMISDHEINALIAGLEFNRLNLTLVLDSCHSGGVYDPAPPQGSKVAQWGEDKLGALVSTCKTILPTICAQTVDPFVNNIQAILRAVDSATMTVDGAKDTAETAKATLFSACDFDETAKENPTLRHGFMTKALLDTVTQSAFKMPNRLLASDLRGKVAAFVSQFGTSQQTPCLRGRPVRQDEDFLTEWTFSI

SEQ ID NO: 27397 - protein, 299 aa, Picea sitchensis
MVSDEELVGRLETLLRHVDFSTITTADSIRQKLEGEFGVKLGDKEAFISHHINLYIQCHRPLVSAWVHNEHRYHPQLEAKVEEAGRNEENAHMEVKEQNIEEPIKESTLLEGRKRGRPGGLNKICGVSPELQAIVGEPALPRTQIVKQLWTYIRANNLQDPSNKRNIICNDALRMVFDTDSTDMFQMNKLLAKHIWALDSRDDGSEPNAKRTANRNTSGPASPVPISDSLALFLGTDKIETSHEEVVKRLSDYIKENELQDPLDKGKIICDAKLQKLFSCENFVDFEMTKLLAPHFLKG

SEQ ID NO: 27398 - protein, 541 aa, Thiobacillus denitrificans ATCC 25259
MSEQILRVTGMTCDHCAASVKQALLRVAGVTRADVSCPDAMARVEVGVDTPVAALLNAVRARGYGAEVGGDATSKASTKLNVTIIGAGSAGFAAAIRAAEEGAEVTVIEASTIGGTCVNVGCVPSKILIRAAHVAHLQARHPFPGLVRHAPLLDRTALVAQQQARVEELRHAKYERILETNPGIKLLRGFARFEDAKTLVVRQPDDTEKRLTPDRILIAPGRSPRIPDVPGLAGTPFWTSSEALIATETPAHLIVHGGSVVALELAQAFLRLGSRVTLVARGKLLSREDPAIGEGLNAVLEEEGMRVLTDTDVKAVRFDGTTFELETSAGTLSGDRLLVATGRKPNTAGLALDRTGVTTDTSGAIVVDDHLRTSVPHIYAAGDCTNAPQFVYVAAAAGTRAAINMTGGDAALDLSVVPAVVFTDPQVATVGLTEAQANKLGMETDSRTLTLDNVPRALANFDTRGFIKLVSEKKTGRLLGAQVLAGEGGEIIQTAALAIQNRMTVADLAGQLFPYITMGEGLKLCAQTFTTDVKQLSCCAG

SEQ ID NO: 27399 - protein, 588 aa, Rhodospirillum rubrum ATCC 11170
MTPHADRRTLFIAATTALPGLSAVSQGLVRAFERQGLRVAFAKPVADHAAVGGDGAPSADLAGPIPARRAEAMIRAGQRDGLLEEIVERAERARGDSAVLVVEGPLPDADHPLLAELGRDLGRSLAAEVIAVVSGDRPSPTDVLETVADTLYHQGAAALSGVVITSIREGQQGDALKAALAGLNLPCPLVALFPGESERSLLGLIGGAAPGRARGLGEDDASVVWLIEHIADHVARGHLTDPSPTHRAAMPPPLFRHRLVGAARAADRRIVLPEGDEPRTLRAAAICAKKGIARCLLLGDPSRIRALAQANAICLPDTIEILDPELVRGRYVEALVEMRRAKGLTAVQATAQLEDTVVLGTVMLALGEVDGLVSGAVHTTASTVRPALQLIKTAPGASIVSSVFFMLMPDQVLVYGDCAINPNPTAEQLADIAIQSADSALAFGIEPRVAMISYSTGSSGVGDDVEKVRAATALAKLKRPGLMIDGPMQYDAASVESVGRQKAPDSPVAGRANVFVFPDLNTGNTTYKAVQRSANVVSVGPMLQGLRKPVNDLSRGALVDDIVYTIALTAIQADQGEPRTPHTLATAV

SEQ ID NO: 27400 - protein, 195 aa, Prochlorococcus marinus str. NATL1A
MANLDQAPSRTMPNLLHILPAFANESELRVNTIVELNSNTINKYELITETGHLKLDRVGYSSLAYPFAYGCLPRTWDEDGDPLDIEIVNVTEPLVPGSIVEARIIGIMTFDDGGEVDDKVIGVIADDKRMDHIQSFEQLGKHWINETTYYWEHYKDLKKPGTCTVNGFFGVEKAVQIIKSCEERYLSEIDPNLIN

SEQ ID NO: 27401 - protein, 493 aa, Saccharomyces servazzii
MSQEAVADFGLIGLAVMGQNLILNVADHGFTVCAYNRTVSKVDDFLANEAKGKSIVGAKSIEEFIAKLKRPRKIMLLVKAGKPVDYIINDLLPHLEKGDIIIDGGNSHFPDTNRRYEELTKKGILFVGSGVSGGEDGARYGPSLMPGGAEEAWPHIKDIFQSISAKADGEPCCDWVGPAGAGHYVKMVHNGIEYGDMQLICEAYDIMKRIGGFSDKEISDVFATWNKGVLDSFLIEITRDILAFNDKDGKPLVEKILDSAGQKGTGKWTAINALDLGMPVTLIGEAVFARCLSALKSERILASKQLAGPTIPADAIKDKKQFVDELEQALYASKIMSYAQGFMLIREAAKTYGWKLNNPAIALMWRGGCIIRSVFLGEITKAYRENPDLENLLLNKFFSDAVTKAQTGWRKTIGLATTYGIPTPTFSTALAFYDGYRSERLPANLLQAQRDYFGAHTFRVLPEEACETLPEGKDIHINWTGHGGNVSSSTYDA

SEQ ID NO: 27402 - protein, 257 aa, Kluyveromyces lactis NRRL Y-1140
MLSTPILLACIIVMISAAFVLIVQKTSANVIPGASKYTNRAPTFIIAGLPQTGKTALFNLLTTDSVKPSVMSQEPNVAEDYMLPTSHKNFKFKLIDFPGHDKFRSELLQTIKDSSQLKGLIYVIDSTINPKELVSTAELLYEILSVTELRPDGVDILLACNKSESFVARPPSKIKGALEKEITEIMKRKAKSLKANSKKSLSDDANDDDDDEVAVLQQNSAGFEFDRIDGNVDAKEGSVLKNDIDKWECWIDERAMN

SEQ ID NO: 27403 - protein, 579 aa, Saccharomyces servazzii
MFSRTDKNVDTLAGDISQLSFDSPSSKLAYNANNNMTPLRQRDNNRFGVGAGMNMGTPTPSPTKSTVYDQENDSSAMMVDDEDNDDITNSPKKLPMDFYKKSSSNKTQRLVSVCKMYFLDYYCDMFDYVISRRQRTKKVMEYIEQQKVLNNVPVERLNTEWFGYLQQEHDVLRKRRLKPKHKDFEMITQVGQGGYGQVYLARKKDTKEVCALKILNKKLLFKLNETNHVLTERDILTTTRSEWLVKLLYAFQDPESLFLAMEFVPGGDFRTLLINTKYLKSAHARFYISEMFCAVNALHELGYTHRDLKPENFLIDAKGHIKLTDFGLAAGTVSNERIESMKIRLEEVKNLEFPGFKEKSIEDRRKIYHHMRETDVNYANSMVGSPDYMALEVLEGKKYDFTVDYWSLGCMLFESLVSYTPFSGSSSNETYENLRHWKQTLRRPRLDNGRPAFSDRTWDLITRLIADPISRLRSFEHVKRMPYFSDIDFDNLRNMSPPFIPQLDSETDAGYFDDFTNEADMAKYADVFKRQNKLSAMVDNSAVSSKLVGFTFRHRSGKQGSSGILYNGSEHSDPFATFY

SEQ ID NO: 27404 - protein, 260 aa, Synechococcus sp. RS9917
MAQALLWPLLDEGVIAAKDVLAVVGHDASVQRLRGRCPAELTLLAATDPAAAAVWASAIQLLAIKPQQLDAVAASVPAVAPEASPLLISVLAGVSLERLQRAFPGRRCVRAVPNTPCLVRAGLTGLAWGQGVTVADRERVKAFFSPVSEVLELAEDRLDAFLALTSSGPAYVALVVEAMADGAVAAGLPRDLSHHLAHRTLAGTAALLQEQELHPSQLKDMVASPGGTTMAALRRLEQAGVRSALIEAVVAAAEHGRQLR

SEQ ID NO: 27405 - protein, 304 aa, Prochlorococcus marinus str. NATL1A
MNKEIQQANHSKNINKPFTDKDSIRVSVLSEALPYIQRFANKRIVIKYGGSAMADKTLQNAVFRDLALLSSVGVQIVVVHGGGPEINQWLEKLGIKPVFLDGLRITDTETMDVVEMVLTGRVNKQIVSGINNHGRLAVGLCGIDGGLIEARTLGGGSHGLVGEVAKVNTKILSPLLEEGYVPVISSVANSSDGRSHNINADTVAGELAAALGAEKLILLTDTPGILRNENDPSSLIEKIRLSEARELIDQGIVKAGMKPKVECCIRSLAQGVNAAHIIDGRTPHSLLLEVFTDAGIGTMVMGRG

SEQ ID NO: 27406 - protein, 144 aa, Saccharomyces servazzii
DVYTKTLKSDGIVGLYRGFGPSVVGIMVYRGLYFGLYDSLKPVLLTGTLENSFLASFLLGWCVTIGASTCSYPLDTVRRRMMMTSGQTVKYKNARDCMKQIVAKEGASSLFKGCGANIFRGVAAAGVISLYDQLQLILFGKKFK

SEQ ID NO: 27407 - protein, 247 aa, Herminiimonas arsenicoxydans
MFSRIKEDIANIIARDPAARSVWEVITCYPGLHAIVMQRWAHWFWVNDLKWLGRFTSHIARWLTGIEIHPGAKIGRRVFIDHGFGVVIGETAEIGDDCTIYQGVTLGGTSLSKGAKRHPTLGNGVIIGAGAQVLGAFTVGEGAKVGSNAVVVKEVPAGATAVGNPARIILKDDTRDQAAARMFASYGVTPNGDDPLSKALHGLIDNAATQEHQIEKILAALKCAGIDCETLPAAEKFDQEQMNKLVE

SEQ ID NO: 27408 - protein, 221 aa, Synechococcus sp. RS9917
MDPHELSRRWQSVMAALPPSARLLAVSKGHPAAAIRDLAALGQVAFGESRVQEALRKQEELADLTQLQWHFIGRLQANKVRQVLRAFGTIHSLDSLALCERVSRIAGEEGCQPRVMLQVKLRPDPKKGGWDPEELRQVWPDLQRLPHCSIVGLMTIAPLGLAPEERLALFRDCRQLADDLGLSECSMGMSGDWAEAVSAGATWVRLGSALFGERSVQQSVA

SEQ ID NO: 27409 - protein, 235 aa, Gibberella zeae PH-1
MPATIPQNNFDSIPDSIEAFRNGEFLVVLDDPSRENEADLIIAAEDVTTEKMGFLIRHSSGYVCVPLSPELTKSLDLPQMVPNNQDPRGTAYTISVDSADPSVTTGISATDRALACRTLADPKARPDSFRRPGHVLPLRARPGGVRQRPGHTEAATEFCRLAGKAQAAAICEIIDDGEETPGQALVQNHGMLRGEACITFARKWGLKVCTIADLVAYVEKTEGKLESNGAETEGN

SEQ ID NO: 27410 - protein, 466 aa, Pseudomonas putida KT2440
MKSYDVVIIGGGPGGYNAAIRAGQLGLSVACVEGRSTLGGTCLNVGCMPSKALLHASELYEAASGDEFAHLGIEVKPTLNLAQMMKQKDESVTGLTKGIEYLFRKNKVEWIKGWGRLDGIGKVVVKAEDGSETALQAKDIVIATGSEPTPLPGVTVDNQRIIDSTGALSLPQVPKHLVVIGAGVIGLELGSVWRRLGSQVTVIEYLDRICPGTDTETAKTLQKALAKQGMVFKLGSKVTQATAGADGVSLTLEPAAGGTAESLQADYVLVAIGRRPYTKGLNLESVGLEADKRGMLNNEHHRTSVPGVWVIGDVTSGPMLAHKAEDEAVACIERIAGKPHEVNYNLIPGVIYTRPEMATVGKTEEQLKAEGRAYKVGKFPFTANSRAKINHETEGFAKVIADAETDEVLGVHLVGPSVSEMIGEFCVAMEFSASAEDIALTCHPHPTRSEALRQAAMNVDGMAMQI

SEQ ID NO: 27411 - protein, 1261 aa, Coccidioides immitis RS
MVRLREIPRTATFTWSPGSAAPFIATGTRAGAVDADFSNETFLELWNLDLDNDKLGQELEPVAKISTESGFHDIAWAESEDHTRGVIAGALENGSLDLWDADKLLNGASDALISSASKHTGPIKALQFNPRHSNLLATGGGKGELFISDLNNVDQAFRLGSGAARVDDIECLDWNKKVPHILVTGSSAGFVTVWDVKTKKESLTLNNLGRKAVSAVAWDPEKPTKLITSIPLETDPLILVWDLRNSNAPERVLRGHESGVLSLSWCAQDPDLLLSCGKDNRTICWNPQTGNAYGEFPVVTNWTFQTRWNPHNPNMFATASFDGKIVVQTIQNTRQDASQAGNNQEQAVNDEDFFAKAQTRPQISTFSLPKAPKWLERPVTASFGFGGRVVSAGLSSGSRSSKITISHFDVDPNVGSATENFESSVKTGDFRGICESRIASSQCEEEKTDWKVIETLLSDNPRKQLVNYLGFSNEVDEAADSLSKLGLDKKEANGEGQLSPKSEGVKKHKRITSIFETNVEGESFLDEIASSKGAKTNNPFQIYTGSESEADRAITRALLLGQFEKALDVCLQEDRMSDAFMVAVCGGQKCIEKAQEAYFSKQSEGPSFVRLLASVVGKNLWDVVHNAGLANWKEAIAAICTFADDKEFPDLCEALGDRLEESYRSKKAKQARKDASFCYLASSKLEKVVSIWIQELKENEAYSIQNATDDTSFSIHVRALQSFIEKVTVFRHVSKFQDPERQKSSDWKLSSLYEKYLEYADVVASHGRLDVAEKYLDLLPASYPEAEVARSRIQFATKKPASKAATGRAPAPRHPPTAPTLTGTFQPAQIPTHKGPAPGSVNQFAPPALSKPTNPYAPTTTTSYTSAGGTTYTPTTGYQPPQPRQSNVIPPPQPLAPPPQSGPAGLAPPPRASSQSPSVAAPYTRATNIPAWNDLPEGFGRAATPRRSTPVTGSSVISSPFPNTPSLTQPGSHTSPPPSTMPAPRDSVPPPPPKGPAPPRMASPSTAGIPHGLQPAERPPSRTHVYSPPLAQQTSPGMAVPPPIPRGPSPYNAPPTVPPPTNRYAPAQVSQPTGQLHGQPPIAPPPHSSMPPPPGPYAPQPFQQAPAQSPYAPPPTGPQAPPPPVSQQGSRPSTAQSQKKAPPAQKYPPGDRSHIPANAQPIYEILSSDMQRVKARAPAAFKAQVNDTERRLNILFDHLNNEDLLQPSTIESMAELAHAIQVKDYETAQAIHLDILTNKTDECGNWMVGVKRLIGMSRATP

SEQ ID NO: 27412 - protein, 620 aa, Roseovarius nubinhibens ISM
MQDTASGAYQVLARKYRPETFADLVGQDAMVRTLKNAFQADRIAQAFIMTGIRGTGKTTTARIIAKGMNCIGPDGNGGPTTEPCGQCEHCTAIMEGRHVDVLEMDAASRTGVGDIREIIDSVAYRAASARYKIYIIDEVHMLSTSAFNALLKTLEEPPEHVKFIFATTEIRKVPVTVLSRCQRFDLRRIEPEVMIALLRRIADAEQAQISDDALALITRAAEGSARDATSLLDQAISHGAGETTAEQVRAMLGLADRGRVLDLFDLILKGDAAGALTEISTQYADGADPLAVLRDLAEVTHWVSVVKITPEAAEDPTIGPDERARGQQMAEALPMRVLTRMWQMLLKALEEVAAAPNTMMAAEMAVIRLTHVADLPSPEDLLRRLQSTPQPPAPGPNSGPGPNGPGPGAGAPSGGAQGSAQAPSGAPSSYRQDTDAMPTGGSGYAPTASASGSGSGSGSGSGSAQTATALAADQALARYPSFEHVIELIRANRDVKLLVEVENCLRLAAYRPGRIEFAPTEDAAPDLAQKLGSALQRWTGNRWAVTVVAEGGDETIAEKRDAARLALEAEAKKHALVQAVIANFPSAKILDIRTPDAIAQEVQADALPEVDEEWDPFEDD

SEQ ID NO: 27413 - protein, 80 aa, Triticum aestivum
MAPTVMGSKDTYDAPFQGLKSTDGLPVRRRSNGASLGSVSNGGRIRCMQVWPMEGIKKFETLSYLTPLSTEALLKQVEYL

SEQ ID NO: 27414 - protein, 481 aa, Pseudomonas putida KT2440
MHPIAPHWLNFIDGQWTDSEQHLSIHNPGTTDLVATIAQASVADAECALQAARRCADSNALNRVRPAQRVTWLLEVAAQIRAITDEGAWVLCQENGKSLRDARDEFIEAARYFEYYAGMADKIEGKSIPLGDGYIDFTVYDPLGVSLQIVPWNFPVSICARSLAPALAAGNAVVIKSPELSPLGLCVLMQAIERAGLPQGAVNLICGRGREVGAYLAGHRDVDQIVFTGSVGTGQSILRSAAEHAIPSVMELGGKSAALVFPDADREQLISSVKSGIFFNAGQVCSAMSRLLVHRSIYDEVVADVVAMAEGLTVGLGQDNPDHTPVISAAQLEGIEALCRRAQQQGAVVATGGEAISGLSGHYMAPTVLRDVTAQMEIAQTEVFGPVLAVIPFDSEEEALAIANGTVFGLVAGVFTQDLNRALRCARRLCTGQVFVNEWYAGGIETPFGGVGLSGFGREKGQEALYSYVRTKNLAVRIKGE

SEQ ID NO: 27415 - protein, 613 aa, Alteromonadales bacterium TW-7
MSAIYIAGIALCSVLAQWVAWAFRVPAILFLLLTGLLLGPFSGVLDPDALLGDLLFPVVSLSVAVILFEGALTLHFRELKGIGKVVRNLCSIGMIATCVVISLSAYWLLELNWRVAAVLGAVLVVTGPTVIAPLLNSMRPTQDIDRILRWEGIVIDPIGALFAVLVFEAVMLVGQGEVLSHTIVALVKTVGVGLTIGVAAGWVTTQLMRREWLPFELHKFGILALVLISFSVSNYLSHESGLLAVTVFGIWLANQDDLEIDSVLEFKEDLSMILISTLFILLAARLQLSDLMMLDSDVFIFLAIVLFVARPLCIAISTFGTDLPIKSRLVLAWIAPRGIVAAAVGSVFALSMMEAGVADAEKMVPLIFTVIIITVVLQSLTAIPVAKLLGVRQPSPNTILIIGANHVSRAIGRGLKEQNIPVHLSDPAWENCKMARMDGLPCYYGNPQSEHAERYLPLTTIRSVLALSPNRHHNALGVQYFSHLLNEKNVFSLRSSTTHAKANKDSATFLSRQILFGDEGSYARLSSVIAKGGKVSATRISDEFSWEQYLEMNPEAIPLFILKGDKDNDDDTPAKVTPFTLNMDKPPQEGERIVALHPPKMSLLKDPQPKDKE

SEQ ID NO: 27416 - protein, 244 aa, Coprinopsis cinerea okayama7#130
MNIIETLFGRTVTPAERLRQHQRSLTKAQRELDRERSKLEQSEKKLIADIKKSAKAGQMNACKVMAKDLVRTRRYIQKFYQMRTQLQAVGLRIQTLRSNQQMAEAMRGATRAMGAMNRGLNLPAIQKIMNEFERESSMMDMKEEMMSDAVDDVMEDDLEDEEEEGDKILKEVLDEIGVDLSQQLTDAPIGLAVSNPIANRTPVALGDGGGHSAGGDSGNSGGDGGVSMSDEDALQARLDALRKG

SEQ ID NO: 27417 - protein, 262 aa, Roseovarius nubinhibens ISM
MSGELSPIDQAKFVAAKKAVEYVEDGMRVGLGTGSTAAWMVRCLGEMVREDGLRIKGVPTSTRTAALAQELGIDVVSLDEAKWLDLTIDGADEFDGELNLIKGGGGALLQEKIVATASDQMIVIADVGKEVESLGHFPLPIEVIPFGWQTTRALVEEMLVSMDVLGRDVTLRMSGDRPYVTDEGNHILDLHLGRIGNPRQLSMVLNQVPGVVENGLFIDICDIVCVGYGDGRVEVRDINDGTVRQDRLDFVESDNLFSDLSD

SEQ ID NO: 27418 - protein, 452 aa, Roseovarius nubinhibens ISM
MMSFDYDLFVIGGGSGGVRAARVAAQTGAKVALAEEDRYGGTCVIRGCVPKKLMVYASEFPGAIKQAAEYGWTVHAGGFDWGAFRSKLHAELDRLEGVYRKILGSNGVETYDARATVKDAHTVRLSTGEEKTAKHILVATGGRPVKPDMPGAEHGITSNDIFHLEELPKSVLIIGGGYIACEFAGILNGMGVQVTQYYRGAQVLRGFDDEARGLVADEMIRGGVDLHLGTNILELEPRDGGIWTKATNGSEKIFDKVLFATGRAPNTEGLGLEELGVELGRGGEVKVDEYSQTAVPSIYAIGDVTDRVNLTPVAIREGMAFVETVFKGNPTPVDHELIPTAIFTQPEMGTVGLSEEEAREKEEIEVYATSFKPMRESFAGQEERVLMKLIVSRANRKVLGCHIVAPGAGELIQMVGIAVKMGATKEDFDRTVAVHPTMSEELVTMKEPVRRA

SEQ ID NO: 27419 - protein, 317 aa, Aspergillus oryzae
MPQYNAPTTAEEVANDCRASIANKTILVTGVTLGSLGAGFATAIANYAPSLIILAARDVTKAQQTATEISIINPSVKTRILHLDLGSQVQIREAAKEVLEYEEHIDVLVNNAGVMAPPFSLTQDGVESQFGINHIGHFLFTNLIMSKLVTPGKSSRVVNISSDGHRLGPIRFDDWNFDDGNTYDPWLAYGQSKTANMLFSVSLAQKLGTKGLISVSLHPGVVSTQILRHDVDESVKALDETAICYYYIRYESVAANLTEIISEFASSRLQKALSEAYRTIRRLRPIVERDRRDGSGACYRELKQHLSPGTFKATSGL

SEQ ID NO: 27420 - protein, 410 aa, Chlamydia muridarum Nigg
MPSLHVELKNTKTFTSSEIRGFMFEFRFPKIGETASGGIVVRWLKQVGDSIQKDEPLIEVSTDKIATELSPSQAGVLEECLVQEGEEVSPGDVLARLREISPVDTSVPTSVEESPIKEESLVNRENQWLSPAVLGIVQREGLDLQELQKISGTGENSRITRKDVERYLSDKREARAPICSKEENRIPMSPLRRAIASSLRQSSEEVPHASLVVDVDVTDLMNLISLERERFAAAHGVKLTITSFIIQCLAKSLEQFPLLNGSLDGDTIVLKKAVNVGVAVNLNKEGVVVPVIHNCQDRGLVSIAKALADLSSRARASKLDASEAKGGSVTLTNFGMTGALIGMPIIRYPEVAILGIGTIQKRVVVREDDSLAIRKMMYVTLTFDHRVLDGIYGGEFLTALKNRLESVTMS

SEQ ID NO: 27421 - protein, 329 aa, Triticum aestivum
  misc_feature (211)..(211): Xaa can be any naturally occurring amino acid
MAVRSLLLPLALLALAASSAAVAQLEIGFYSKTCPDAEKIVREEMAKIIAAAPSLAGPLLRLHFHDCFVRGCDASVLLESTEGNVAEKDAKPNKSLRGFGSVERVKAKLEAACPGIVSCADVLTLMSRDAVVLAKGPFWPVALGRRDGRVSSATEASKELPPASGDVPLLAKIFASKGLDLKDLVVLSGAHTLGTAHCPSFADRLYNSTGXNDAYGLVDPSLDSEYADKLRLKCKSVDDRTMLSEMDPGSFKTFDTSYYRHVAKRRGLFRSDAALLFDNTTRDYVQRIATGKFDGEFFKDFSASMIKMGDVGVLTGAEGEIRKKCYAPN

SEQ ID NO: 27422 - protein, 242 aa, Nicotiana benthamiana
MASMIESAWTYLISNFSDFQLTCLGGFVLHESIFFLSGLPFILFERAGWFGKYKIQKKNNSPEAQEKCITRLLMYHLCVNLPILLGSYPVFKFMGTRSSLPLPSWKVISTQIIFYFILEDFVFYWGHRILHTKWLYKHVHSVHHEYATPFGLTSEYAHPAEILFLGFATIIGPAITGPHLITLYLWVSLRVLETVEAHSGYHFPWSPSNFLPLYGGADFHDYHHRLLYTKSGNYSSTFVYMD

SEQ ID NO: 27423 - protein, 820 aa, Aeropyrum pernix K1
MERRLILWLDEISKDLLPLVGGKAAGLGEMIKAGIPVPPGFVVTSEAYRRFVFETGIAGFIKHILEETIVSGRPEEYEKASELIRSKFVRTPMPPYLRRAIVDAYRKLGTLVGVEEPRVAVRSSATVEDLPEASFAGQQETYLNVKGEEEVVEKVKTAWASLWTARALSYRDSLNIDHETALMAVVVQKMVSSRSSGVMFTIHPVTGEEDKIVIESIWGLGEYIVGGKVTPDRFVVSKSDLEILEVRISRKDKALFYDPDLNENVEIKIPESGEELEDLRRKHPAVAEVVEKYGIRPDAPSLSEKEVKELARLAIKVENHFARPMDIEWAIDFELSPPENILLLQARPETVWSRKKEEAEAKPPEEEAVPEGEVLVRGVPASPGVASGRVKVALTVEEAAKKMEKGDVLVTKMTDPDWVPYMKMASAIVTDEGGMTAHAAIVARELGIPAVVGTGDATKKLKDGMLVTVDGSRGVVYAGAVKTEEAREEEARPELGAAVAEVLSEVYPVTATKIYMNLGHPEEIDRYKHLPFEGIGLMRIEFIISSWIGYHPMYLIEQGRGVYFIDKLAEGVAKVASAIYPRPVVVRFSDFKTNEYRRLKGGEKYETLDERNPMIGWRGVSRYIHPNYEPAFRLEVRAIKKVREEWGLKNVWVMFPFVRTTWELERALKIMEEEGLSRGRDFKVWIMVEVPSTVFLADEFAKMVDGFSIGSNDLTQLVLGVDRDSGFLAKMGYFDERDPAVLRSIEILIEKAHSQGATVSICGQGPSVYPELVEFLVRRGIDSISVNPDAVVRVRRQVASIERRIMLERLEELGSRLSRL

SEQ ID NO: 27424 - protein, 275 aa, Escherichia coli CFT073
MANPTVIKLQDGNVMPQLGLGVWQASNEEVITAIQKALEVGYRSIDTAAAYKNEEGVGKALKNASVNREELFITTKLWNDDHKHPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIVENFDVWDFRLDKDELGEIAKLDQGKRLGPDPDQFGG

SEQ ID NO: 27425 - protein, 609 aa, Magnaporthe grisea 70-15
MTKIPLARYIFQRLRQYGVDHIHGVPGDNLLHALDHIVPAGSRWVGCCNELNAAYAADGYARVRGMGAVFTTMGVGELSAANAIAGSQAERVPVVHLVGVPSREAMMGQSQYPNVMHHALQPGGGMEPFREIGRLLTQGRDEFRSSAAVYEGATAADFASKFDSMLRRSFVQRKTMYFPLRADLVDHQVDSSWLEKSLDGPDGEQGSKPPAEEWDFLKELRSAEKPVILVDRGLGMDAFKDEINELVALSGIPTFCMPSGAGMIDNRLPNYHGVHSGPFGRINSMTWVGSADLVLAIGPMFSDTNTFGWMTVPRPSAKNPNMKLMILASHTTRPKRAMPGQTTPVMLLQTNRDILRRAIEMLKKEPIKGKAIPFMKDWRVGERRWMVGDQRINQSILYQKLDKYLRPYDTILIGNATPLLGARDFVLPEGARVIASGQWFSIGHMLPAAMGAALAKRGLKGDAGRGRTILLDGDGSFQMTAQELGTIIRQRLDVTIFIFNNGGYAYERLIHGPDEEYNDIAPWKYLELPSAFGAEHARAMHGYNTQTHLVRTWDDLDRLFMDGRFNIGPGLKLVELRLGRKDVPARFRNLFREDEEEERLTRRIRSDPE

SEQ ID NO: 27426 - protein, 181 aa, Glycine max
MRNINSVKEEFLKKWIWGLRKYSSQKKNMSLMERKKAIKLSADLAMASTRNKTTRWSRALIANASRDGNNNKVLAEHVTSSPQRPVAGKSFTARIRSCRNMLRRNRAVHSRAKDRVVASSVAKRLVQKRTRRLKSLLPGGESMDGVSLVEETLDYIQSLRAQVEVMRSLVTASEIKILNPS

SEQ ID NO: 27427 - protein, 260 aa, Triticum aestivum
  misc_feature (141)..(141): Xaa can be any naturally occurring amino acid
MANLFLKQAKHYAAARPDYPAELFQFIASKTARHDLAWDVGTGSGQAAVSLAKLYKNVVGTDTSAQQLSYAPALPNVRYAHTPADLPLDGIHAAVAPPGSVDVVTVAQAFHWLDLPRFYAQARSLLRAHGVLAAWCYTEPXVGAAVDAVFWRLYAGSQPHWAPNRKMVDDEYRSADFPFDPVDGETHTGPFEFSTDRRMDLDDYFTYIKSWSAYQTAKDNGVELLDDATVQDFADAWGGDREEVKTVRYPIFLRIGKVRP

SEQ ID NO: 27428 - protein, 243 aa, Oryza sativa Japonica Group
MAAGGGGGDELKLLGLWASPYVLRAKFALSFKGLSYENVEEDLHNKSELLLSSNPVHKKVPVLIHNGKPICESQIIVEYVDEAFPDAGESLLPSDPYDRAVARFWAAYINDKFMPAWQKASLGLTEEEKAEAVKQMLAAIENLETAFKELSKGKPFFGGDTAGYLDVTLGAVVGWARAGEVLFGRKLFDATRSPLLAAWMERFVALDAVKAVLPDNAELIEYGKMRMAHYAKLAAALAAANKK

SEQ ID NO: 27429 - protein, 488 aa, Micrantheum hexandrum
GPGVPTIEKTNQGRIVQIIGPVLDVAFPRGKMPNIYNALVIVKGRNSTGQQINVTCEVQQLLGNNRVRTVAMSATEGLMRGMEVIDTGGPLSVPVGGATLGRIFNVLGEPVDELGPVDTRTTSPIHRSAPAFIQLDTKLEIFETGIKVVDLLAPYRRGGKIGLFGGAGVGKTVLIMELINNIAKEYGGVSVFGGVGERTREGNDLYKEMKQSRVINEENIAESKVALVYGQMNEPPGARMRVGLTALTMAEYFRDVNKQDVLLFIDNIFRFVQAGSEVSALLGRMPSAVGYQPTLGTEMGSLQERITSTKEGSITSIQAVYVPADDLTDPAPATTFAHLDATTVLSRPLAVKGIYPAVDPLDSTSTMLQPNIVGKEHYETAQSVKQTLQRYKELQDIIAILGLDELSEEDRLTVARARKIERFLSQPFFVAEVFTNSPGKYVGLAETIRGFNLILSGELDSLPEQAFYLVGNIDEATAKAANVEMEND

SEQ ID NO: 27430 - protein, 144 aa, Prochlorococcus marinus str. NATL1A
MISAFHRLSIRLVRAALAICLGFCLIFFQFASEVNAAKTLMTGDFAKDTIAVSSTLKETITLPKEDKGLSEAEKEAVFLISDYISRYRNRSQVNTSTTFTTMQTALNALSGHYKTFANRPVPENLKERLNKELSKAEKLAVRDS

SEQ ID NO: 27431 - protein, 388 aa, Chlamydophila caviae GPIC
MHLHEYQAKDLLVSYDIAIPPYRVASSVEEGQQALKELAIDAGVVKVQVHAGGRGKNGGVVVAKSPSDILAAVDKLLRMRFVSNQTSGEALPVEKVLITPLVNIAAEYYLAVIMDRKNRCPAIMLSKAGGVDIEEVAQKYPDQLLTVPLTPFARLYNYQIRQIIKFMNWEGDIRKQGAQLIKKLVQCFYDNDASLLEINPLVLTQEGDLLVLDAKITIDDNALYRHPKLEVLYDPSQENVRDVLAKQIGLSYIALDGNIGCLVNGAGLAMSTLDILKIHGGSAANFLDVGGSATEQQVQEAVSLVLSDENVEVLFINIFGGIMDCSAVASGLVAVMQTRENLIPTVVRLEGTNVDLGKDIVQRSGIPCQFTDSLNEAAQLAVALSKQG

SEQ ID NO: 27432 - protein, 417 aa, Herminiimonas arsenicoxydans
MALIVHKYGGTSMGSTERIKNVARRVAKWHDAGYQIVVVPSAMSGETNRLIGLAKELMPHPNPRELDMLASTGEQVSVALLAMALHSIGKEAVSYTGWQAGIKTDSAFTKARIQSIDDVKVKKDLDAGRIVIITGFQGVDEDGNIATLGRGGSDTSAVAVAVALEAKECLIYTDVDGVYTTDPRVVSEARRLNTVTFEEMLEMASLGSKVLQIRSVEFAGNYKMPTRVLSSLTDPMMSLEEEAKSGTLISFEEDTKMEQAAITGIAFSRDEAKITVLGVPDRPGIAYQILGPIAAANIEVDMIIQNQSVDGKTDFTFTVPRADYAKAVDVLNDSVKAHIGAASIQGDTKVSKVSVVGVGMRSHVGIASQMFRTLSEEGINIQMISTSEIKISVLIDEKYMELAVRALHKTFDLEKSN

SEQ ID NO: 27433 - protein, 1080 aa, Eucalyptus grandis
MESEGETGGKSMKILGGQVCQICGDNVGKSVDGESFVACSVCAFPVCRPCYEYERKDGNQSCPQCKTRYKRHRGSPAILGDQEEDADADDSVSDFNYSENQNLNRKTEERILSWHMQNGQNEDVSAPNYDKEVSHNHIPRLTSGQEVSGELSAASPERLPVASPDVGAGKRIHSLPYVADANQSPNIRVVDPVREFGSSGLNNVAWKERVDGWKMKQEKNVAPMSTAQATSERGVGDIDASTDVLVDDSLLNDEARQPLSRKVSVPSSRINPYRMVIVLRLIILSIFLHYRITNPVPNAYALWLISVICEIWFAISWILDQFPKWFPVNRETYLDRLAIRYDREGEPSQLAAVDIFVSTVDPLKEPPLVTANTVLSILAVDYPVDKVSCYVSDDGTAMLTFEALSETSEFARKWVPFCKKYSIEPRAPEWYFALKIDYLKDKVHPSFVKDRRAMKREYEEFKVRINGLGAKATKIPEEGWIMQDGTPWPGNNTRDHPGMIQVFLGQSGGLDAEGNELPRLVYVSREKRPGFQHHKKAGAMNALVRVSAVLTNGPFLLNLDCDHYINNSKALREAMCFLMDPNLGKHVCYVQFPQRFDGIDRNDRYANRNTVFFDINLRGLDGIQGPVYVGTGCVFNRTALYGYEPPHKPKQRKSGFLSSLCGGSRKKSRSSKKGSDKKKSSKHVDPTVPIFSLEDIEEGVEGAGFDDEKSLLMSQMSLEKRFGQSAVFVASTLMENGGVPQSATPETLLKEAIHVISCGYEDKSDWGSEIGWIYGSVTEDILTGFKMHARGWRSIYCMPKRPAFKGSAPINLSDRLNQVLRWALGSVEILFSRHCPIWYGYGGRLKWLERFAYVNTTIYPITAIPLLMYCTLPAVCLLTNKFIIPQISNVASIWFISLFLSIFATGVLEMRWSGVGTDEWWRNEQLWVIGGVSAHLFAVFQGLLKVLAGIDTNFTVTSKASDEDGDSAELYMFKWTTLLIPPTTLLIINLVGVVAGISYAINSGYQSWGPLFGKLFFAFWVIVHLYPFLKGLMGRQKRTPTIVVVWSILLASIFSLLWVRIDPFTTRVTGPAVEQCGINC

SEQ ID NO: 27434 - protein, 234 aa, Zea mays
  misc_feature (121)..(121): Xaa can be any naturally occurring amino acid
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGXSELEGVVFEVVITFALVYTVYATAADPKKGSLGTIAPIAIGFIVGANILAAGPFSGGSMNPARSFGPAVAAGNFAGNWVYWVGPLVGGGLAGLVYGDVFIGGSYQQVADQDYA

SEQ ID NO: 27435 - protein, 355 aa, Aspergillus nidulans FGSC A4
MADHLALPSFLTDNSVVSALLDTYTSFSERRAALGLPNPGTVENVGREVQKDVLLSNFMFSGLRADLTKMFSMAPLFRVSHAFSMGGSGNMAPYAFSAMYGTSSVFMQGNFGSDGGLAALYNYRWTPKLVTKTNVQIMPGAEQGLIQLDNDYTGDDFSLSLKAFNPSYLDGGLTGIFVGSYLQSVTPKLALGFEAIWQRQGLNTRPESAVSYSARYKSDDWIASAQLQAQGVFTASYWKKISERVEAGVDMNLQFAPNAAAMMMGGPSKDGTTAIGAKYDFRASTFRAQVDSAGKVSCLLEKRIAMPIALTFAGEIDQAKQSAKVGLAVSLEIAGEEVMEQTEKADPSTMVTPPF

SEQ ID NO: 27436 - protein, 88 aa, Brassica napus
MASQQEKKQLDERAKKGETVVQGGTGGKSFEAQQHLAEGRSRGGTTRKEQLGTEGYQQMGRKGGARTGKADDEDEGEEMDEPTSRTRT

SEQ ID NO: 27437 - protein, 522 aa, Kluyveromyces lactis NRRL Y-1140
MLLRTTTAGTRLAFKSQTAAFAHALRYYSHLPLKVKVDLPNGISYEQPTGLFINNQFVPSKQGKTFEVLSPSTEEEITHVYEGREEDVDAAVEAADKAFKSGVWSKVDPLVRSQCLSKLADYIEKDLDTIASIESLDNGKAISSAKGDVQLVVNYLRSAAGYADKVDGRVIDTGSTHFSYTVREPLGVCGQIIPWNFPLLMWAWKIAPALATGNTVVLKTAESTPLSALYVSQYIPKAGIPDGVVNIVSGFGKIVGEAITTHPKIKKVAFTGSTATGRHIYQNAGVNLKKVTLELGGKSPNVVFADANLKSAVQNSLLGIYYNSGEVCCAGSRLYVEESIYDDFLKEIKSASEALKVGDPFDAETFQGAQTSQNQLDKILKYVEIGKNEGATLITGGERIGDKGYFVRPTIFADVEESMRIVKEEIFGPVVTVTKFKTIDELIEKANDSEYGLAAGIHTSNINTAIQVSNRLNAGTVWINTYNDFHHCVPFGGFNASGIGREMGSEALDNYTQVKAVRVKLE

SEQ ID NO: 27438 - protein, 669 aa, Pseudomonas putida KT2440
MQSKTTRRSFVKGLAATGLLGGLGMWRAPVWAVTSPGQPNVLTGTDFDLYIGELPVNITGTVRTAMAINGSIPGPILRWREGDTVTLRVRNRLQQDTSIHWHGIILPANMDGVPGLSFHGIAPDGMYEYKFKVQQNGTYWYHSHSGFQEQVGVYGALVIDAKEPEPFTYDRDYVVMLSDWTDEDPARVLSKLKKQSDYYNYHKRTVGDFVNDVSEMGWSAAVADRKMWAEMKMSPTDLADVSGYTYTYLMNGQAPDGNWTGVFKPGEKIRLRFINGSAMTYFDVRIPGLKMTVVAADGQHVKRVAVDEFRIAVAETYDVIVEPEDEQAYTIFAQSMDRTGYSRGTLAVREGMQAAVPAVDPRPLISMSDMGMDHGSMAGMDHGNMAGMDHSKMAGMDHGNMAGMDHSKMAGMDHGNMTGMDHSKMAGMDHGSMAGMDHSKMAEMDHGGMAGMDHSKMAGMDQGGMADMDHSKMAGMDQGGMADMDHSSMEGMGGAMQSHPASETNNPLVDMQTMSPTPKLDDPGIGLRNNGRRVLTYADLRSTFIDPDGREPGRTIELHLTGHMEKFAWSFDGVKFSDAEPLRLKYGERLRITLVNDTMMTHPIHLHGMWSDLEDEDGNFMVRKHTIDMPPGSKRSYRVTADALGRWAYHCHLLFHMEMGMFREVRVDE

SEQ ID NO: 27439 - protein, 232 aa, Synechococcus elongatus PCC 6301
MDPVTHMKHEVAKAAASRVQSGMVVGLGSGSTAALMIQYLGDRVRNGELTNIQAVPTSFQSSVLANEYGIPLTTLNEVDRIDIAIDGADEVDPQRNLIKGGGACHTREKLVDARAEQFIVVVDSSKLVEALGTTFLLPVEVLPEAYIQVGKALEKLGGKPELRMAVKKAGPVVTDQGNLVLDVKFDRIDQPAELEKAINNIPGVLENGLFVGLTDLVLVGEVDGDRVSVREF

SEQ ID NO: 27440 - protein, 445 aa, Acinetobacter baumannii
MSVTSVNPATNATNEYYLTRQSQMESNVRSYPRKLPLAIAKAQGCWVTDVEGTQYLDCLAGAGTLALGHNHPAVIQSIQDTLASGLPLHTLDLTTPLKDAFTEALLAYLPGGKEEYCLQFCGPSGADATEAAIKLAKTYTGRSSVISFSGGYHGMTHGSLAMTGNLSAKNAVNGLMPGVQFMPYPHEYRCPLGLGGEAGVDALTYYFENFIEDVESGVTKPAAVILEAIQGEGGVVTAPVKWLQKIREVTEKHNIVLILDEVQAGFARSGKMFAFEHAGIEPDVVVMSKAVGGGLPLAVLGIKRKFDAWQPAGHTGTFRGNQLAMGTGLVVLETIKEQNLAQNAQERGEFPCIGNVRGRGLMIGVEIVDERKPADRIGSHPADSQLAAAIQTACFNNNLLLEKGGRNGTVIRLLCPLIITQEECVEVIARFKKAVAEALVAVRGA

SEQ ID NO: 27441 - protein, 565 aa, Coprinopsis cinerea okayama7#130
MQYKPSDVDKIIREAHEKQRETAKVSKGQSVKDREEGFIYAGRYGTNPAPQHHLSSKGISADDAYRLIHDELALDGSTVLNFASFVHTWMPPQALKLVQENISKNLIDADEYPATQEIHKRCLSILADLWHAPSPKDAVGTATTGSSEAVEIGGLALKKRWQERMKKAGKNIHEPGPNIVMGANAQVALEKFARYFDVECRLVPVSKESRYCLDTKAAMDYVDENTIGVFAILGSTYTGHYEDVKAMSDLLDEYEKKTGIYVPIHGKSLVRTTHPSAGTDLHIVDAASGGFIAPFISPDLPWDFRLPRVVSINASGHKFGLTYVGVGWVLFRSEEHLPKELVFTLSYLGSTQYSFSLNFSRPAFPIIAQYFNLLHLGFEGYRAVMLDDLRNARTLSRALERIGSGGGKDEQGWFEVISDVHRAKGVHSGKGIDDPDVEAYEPSLPVVAFKFTEKFKEEYPEIEQRWVHIMLRAKGWIIPNYALAPNLDNEEILRVVVRECVTEVLVDRLIKDIVEIMNQFMESKPHGDTLQMIDMAHNKGARRGDDGPQKMKEEDHSSGTYNHPC

SEQ ID NO: 27442 - protein, 272 aa, Vitis vinifera
  misc_feature (150)..(150): Xaa can be any naturally occurring amino acid
  misc_feature (203)..(203): Xaa can be any naturally occurring amino acid
MMKKRHLLEKPWFLRLALVGLIAGVLFIYQFVQNSDHSLLCSFAGESPRADSSATQIQLSAILHYATSRIVPQQTLAEITVSFDVLQSLASCNFLVFGLGFDSLMWSSFNARGDTLFLEEDPKWVQTVLKDAPTLRAHTTICSSTYRSVXECMPPKAYLRGNNRCKLALSDLPDEVYDKEWDLIMIDAPRGYFPEAPGRMAAXFSAAVMARARVRPGVTHVFLHDVDRRVEKVYAEEFLCRKYLVGSVGRLWHFEIPPAANLSRASDSTGFC

SEQ ID NO: 27443 - protein, 370 aa, Zea mays
SGRARRSAPARRATVIRAAAGSYSDELVSTAKSVASPGRGILAIDESNATCGKRLSSIGLDNTEPNRQAYRQLLLTTAGLGEYISGAILFEETLYQSTTDGRKFVDCLKDQNIMPGIKVDKGLVPLPGSNNESWCQGLDGLASRCAEYYKQGARFAKWRTVVSIPCGPSALAVKEAAWGLARYAAIAQDNGLVPIVEPEILLDGDHGIERTLEVAEKVWSEVFFYLAQNNVLFEGILLKPSMVTPGADHKEKASPEAIAKYTLTMLRRRVPPAVPGIMFLSGGQSEVEATLNLNAMNQSPNPWHVSFSYARALQNSVLKTWQGRPENVEAAQKALLVRAKANSLAQLGRYTGEGESDEAKKGMFQKGYTY

SEQ ID NO: 27444 - protein, 399 aa, Archaeoglobus fulgidus
MIIEDVHYRVVFDSRGNETVECEVVAGEVVAKAMAPSGASTGSGEAVVVSPYRYEEIEEEVSKAIIGMSVFDQESVDEALRELDGTDNFSRIGGNFAITASLAVAKAAAEILGLPLYAYVGGVFAKELPYPLGNVIGGGRHAEGSTSIQEFLVIPVGAKTFFEAQRANAAVHKQLKKIFKERGIFAAKGDEGAWAAQISDEQAFEILSEAIQRVEDELGVKVRMGIDVAATELWDGERYVYSDRKLTTEEQIAYMAELADRYDLLYIEDPLHEKDFEGFAELTKQVKCMVCGDDIFVTNPEIIKKGIEVGAANTVLIKPNQNGTLSGTAKAVKIAKDNGYSVVVSHRSGETEDETLAHLAVAFNAKLIKTGVVGGERISKLNELIRIEELMDKPRMVMI

SEQ ID NO: 27445 - protein, 434 aa, Desulfovibrio vulgaris str. 'Miyazaki F' [sequence omitted]

SEQ ID NO: 27446 - protein, 343 aa, Roseovarius nubinhibens ISM
MRIAQDLAAAVGNTPLIRLRRASEETGCNILGKAEFLNPGQSVKDRAALYIIKDAVARGDLKPGGTIVEGTAGNTGIGLALVGASMGFRTVIVIPETQSQEKKDMIRLAGAELVQVPAAPYRNPNNYVRYSGRLAEEMARHSNEGVIWANQFDNVANRQAHIETTGPEIWEQTGGKVDGFVCAVGSGGTLAGVGMALQPKGVKIGLADPDGATLYNFYKHGEHKSEGSSITEGIGQGRITANLEGFTPDMAWNIPDSEALPIVFDLLAEEGLCLGGSSGINVAGAIRMAREMGPGHTIVTPLCDYGTRYQSKLFNPEFLREKGLPVPGWLSEAPRSIPGVFEE

SEQ ID NO: 27447 - protein, 498 aa, Oceanobacter sp. RED65
MSSQRTFEYWKEQAASLSINGQAFINGQSVDAKSGETFETISPIDGRVLANVASCDEADVNEAVKLARAAFDSGVWSQKAPAERKQVLLKFADLIEANQEELALLETLDMGKPISDALSADIGGTLRAVRWTAEAVDKVYDEIAPTSENEIGMITREPVGVVAAIVPWNFPMIMASWKFSPALAMGNSVILKPSEKSPLTAIKLGQLAKEAGIPDGVFNILPGFGHTAGKALALHMDVDTLVFTGSTNVAKQLMIYAGQSNMKRIWSEAGGKSPHVVFADAPDLDLAADAAAAAICFNQGEVCTAGSRLLVEDSIYDEFMEKVRQSLGKWKAGNPLDPETNVGAIVDEDQLNRVLSFIEKGKEEGANLTVGGNRVELAEGGYFLEPTIFEDAQPHMSIVKEEIFGPVLSVIRFKTDEEALQLCNDSIYGLASGVWTNNLTRAHRFAKGIKAGMVWINEYDQGDMTAPFGGYKQSGNGRDKSLHAFEKYSEVKATWIKI

SEQ ID NO: 27448 - protein, 310 aa, Candida glabrata CBS 138
MAALHKNTSTLKLNTGAHIPVIGLGTWQSSENEGYNATLEALKAGYRHIDTAAIYKNEEEIGRAIRDSNIPRNELFVTTKLWGTQHRNPTEALDQSLKRLGLDYVDLYLMHWPVALKTDLIKDGNLLQIPEREDGSRDVDLEDWNFVKTWELMQELPKEKARAIGVSNFSINNLKELLNSKGNKVVPAANQIEIHPLLPQDELINFCKEKGIVLEAYSPLGSTDAPILKEEEITEIAKKNGVNAGQLVISWHAQRGYVVLPKSVKPERIHGNQETFKLSDEDFATLSNYAKKHGERRVVSPNWGPFKPFV

SEQ ID NO: 27449 - protein, 463 aa, Oceanobacter sp. RED65
MFSGLMFYLFNINSAKHVQNNIQMTEVTMSTSKHDAFWMPFTANRQFKAEPRLMVSAEGMYYQTEDGRNVLDGTAGLWCVNAGHGRKRISEAVAKQIQQLDFAPTFQMGHPLPFELAERLVKHTPDGLNRVFFTNSGSESADTSLKIAIAYHKAKGNHGKTRLIGREKGYHGTNFGGISVGGLGNNRKSFGSLLTGVDHLKHAWKPGSEFTKGLPEDGAEMADELLDMIALHGAETIAAVIVEPIVGSGGVFMPPQGYLKRLRQITEQHDILLIFDEVITGFGRVGEAFASNRMGVTPDIMNTAKGLTNGAIPMGAVFLQDFIYDAFMQGPEEIIELFHGYTYSGHPVAAAAGLATLDIYEEENLFQKALQLESYWQESLHKLREHGVVKDIRNYGLVGAIELHSSEKFGERGYKIFNHCYWKQNALVRCTGDTIAMSPPLILEESHIDELMNALSKSLSNAL

SEQ ID NO: 27450 - protein, 495 aa, Oceanobacter sp. RED65
MNNITHFINGQITAASERNAPVYNPATGEQTGVVSLAPASLVEEAIANAKEAFEEWSKVTPLNRVRILFKFKMLLEERMDELAEAITKEHGKVFEDAKGEIIRGMEVVEFACGIPSALKGEITEQVGRDVDAYSVNQPLGVVAGISPFNFPAMVPMWMWPVAIACGNTFVMKPSEKDPTATLMVAEWLKECGLPDGVLNIVNGDKEAVDVLLTHPDIQAVSFVGSTPIAEYIYSTASAHGKRVQALGGAKNHMIVMPDADIDGAVNALMGAAFGSAGERCMAISVAVAVGDIADELVDKLAAKTKELKIGNGINRGLDMGPLVTKEHHAKVKGYVDLGVEEGAKLVVDGRDVKVDGGENGYFLGGCLFDNVTTDMKIYQEEIFGPVLCVVRVEDYATAAKMINDHEYGNGTSIFTRSGAVARKFAHDIQVGMVGVNVPIPVPMAFHAFGGWKRSLFGSNHVHGPEGVRFYTKRKAVTMRWPEGDLDAEFVMPTMK

SEQ ID NO: 27451 - protein, 338 aa, Escherichia coli CFT073
MKTLICQQPGVMEYVEKDIPTPADNEVLLKIKAVGICGTDIHAFAGRQPFFSYPRVLGHEICAEAVSRGSQCQTAQLGQRYSVIPCIPCGECAACREEKTNCCERVSLYGVHQDGGFSEYLAVREDNLVPLPDEVSDSAGALVECFAIGAHAVRRAEIKAEQNVLVIGAGPIGLATAAIARAKGAHVVVADIDCQRRQHVVDHLAINAFNPTQEDFIAALREAFGGELACVVLDATGNKASMSHDVNLIRHGGKIVFIGLYIGELVIDDPTFHKKETTLLSSRNATREDFALVIKLMRSNKIHENLMKNQAFDFFSVGEDYQRNVVENKNMVKGVITF

SEQ ID NO: 27452 - protein, 326 aa, Candida glabrata CBS 138
MSSVVTLNNGLKMPLVGLGCWKIPNDVCAQQVYDAIKIGYRLFDGAEDYGNEKEVGQGIRKAIDEGVVKREDVFVVSKLWNSFHHPDHVKMALKRTLSDMGLDYLDLFYIHFPIAFKYVPFEEKYPPGFYTGKEDEKNGHITEAHVPIIDTYRALEQCVEEGLIKSIGISNFSGSLVQDLLRQCKIKPVALQVEHHPYLTQEHLVEYCKDNGIQVVAYSSFGPQSYIELNHPLAKNTPNLFHHDTIKQIANNHNVATSQVLLRWATQRGIAIIPKSSKKERLQDNLMIDEKLTLTHKELEAISKLNKNLRLNDPWDWLDGKFPIFA

SEQ ID NO: 27453 - protein, 157 aa, Vibrio vulnificus CMCP6
MIAQGQTLPNATLSQLTKEGMVHHPVLELFAGKKVVLFAVPGAFTPTCSEAHLPGYIVLADQLKAKGVDLIACVSVNDAFVMKAWGEAQNAEEILMLADGDASFTKALGLEMDTAGFGGLRSQRYAMIIDNGVVTTLNVEAPKSFEVSNAETILAAL

SEQ ID NO: 27454 - protein, 543 aa, Corynebacterium diphtheriae NCTC 13129
MIVTNDFEVRVGARTLLNAPGQHLRVQPGDRIGLVGRNGAGKTTTMRILAGETQPYGGSVIRSGDIGYLPQDSREGNIDQTARDRVLSARGLDQIQASMERQQEIMETTEDEKKRDAAIRKYSRLEERYHALGGYEASSEAARICDNLGLPARILDQPLKTLSGGQRRRVELAQILFAASAGSGKSKTTLLLDEPTNHLDADSITWLRDFLSKHEGGLIMISHDVELLDAVCNKIWFLDAVRGEADVYNMGFAKYKDARATDEARRRRERANAEKKAAALKDQAARLGAKATKAAAAKQMLARAERMVGSLDDVRVADRVAHISFPEPAPCGKTPLNAKGLTKMYGSLEVFAGVDLAIDKGSRVVVLGFNGAGKTTLLKLLAGVERTDGEGGIVTGHGLKIGYFAQEHDTIDPQKSVWQNTIDACPGAGEQDLRGLLGAFMFSGDQLEQPAGTLSGGEKTRLALAALVSSRANVLLLDEPTNNLDPISREQVLEALRTYTGAVVLVTHDPGAVKALEPERVIVLPDGDEDLWSEDYMEIVELA

SEQ ID NO: 27455 - protein, 247 aa, Kluyveromyces lactis NRRL Y-1140
MPKLVLVRHGQSEWNEKNLFTGWVDVKLSAKGEQEAARAGELLKENNVNPDILFTSKLTRAIQTANIALEKADRLWIPVVRSWRLNERHYGALQGKDKAATLEQYGEEQFTTWRRSFDIPPPVIEDDSPFSQSNDPRYGDVDPSVLPKTESLALVIDRLLPYWQDSISSELLQGKTVMITAHGNSLRALVKHLEHISDADIAKLNIPTGIPLVFDLDENLKPTKPSYYLDPEAAAAGAAAVAAQGKK

SEQ ID NO: 27456 - protein, 401 aa, Aeropyrum pernix K1
MAGGYNRRVDLITGSPTRKIDAVRERLAREGRDVILLSTGQPGFLPPTFLRERLAQALLDEGFKRLYSYTPTPGYADVREAIAEDLAALGGPRMEPDDILVTAGGQEAMFATLSTILEPGDKVILMDPTYFGYRPIVEYLGGRVEWVRAPPSLGFQPDEERLKEAFTRDVKAVVLVSPDNPTGRLLSTESAKLVADLAVDTGAWIVYDEAYKTLVFEGEHVYLYKLAPDNTISINTFSKDPGFPGWRLGYLYGPGWIVGKIRLVSEELVYCPPSIAQVAAKIYLEDREGRLRHLEYAREFLKTRMEAMAGALEEMLPEAVFARPGGSMFITVDLSSYLSKASITSEDLSVKLLDEESVATVPGRYFGPSGDTMLRLSFATETPERIREGIGRLARLLERLA

SEQ ID NO: 27457 - protein, 432 aa, Campylobacter jejuni subsp. jejuni NCTC 11168
MYYCISFTHKNTDIALREKLSFSNEAKKGEFLKIISTHENIEECLVISTCNRVEIVAFVKMACAEFIVKSLALLCDVDKDILLEKADIFEDSGAIHHLFSVASSLDSLVVGETQIAGQLKDAFAFAVKNNFCGVHLSRAVHSAFKCAAKVRNETQISKNSISVASVAVAKAKELADLTQKKAVVIGAGEMGELAAKHLIAAGAKVIILNRDLQKAKDLCERLGVLSEYDSLENLKKYLNQYEFFFSATNAPNAIITNSLIEELSYKRYFFDIAVPRDIDINENENISVFAVDDLEIVVQKNLALREQEARMAYGIIGRETSEFFRYLNDLALMPIIKAIRLQAKEYADKQLEIALKKGYLKKSDKEEARKLIHQVFKAFLHTPTVNLKHLQGKMQSDTVINAMRYVFDLQNNLEGLNQYKCEFDMENNDEIY

SEQ ID NO: 27458 - protein, 426 aa, Corynebacterium diphtheriae NCTC 13129
MHTQFVTEAGELNSEAIRAEFPILARTVRGDKPLIYLDSGATSQRPLRVWKAEEQFVLHTNAPVHRGAYQLAEEATDAYEEARDAIASFVGADGFELAFTKNATEALNSVAYTLGDDRAGQYQVKAGDTVVVTELEHHANLVPWQELCRRTGATLKWYKVTPDGRIDLDSLELDESVKVVAFTHQSNVTGAVAPVAELVKRARAVDALVILDACQSVPHMAVDFHALDVDFAAFSGHKMCGPSGVGALYGKAEILEKLPPFLTGGSMISVVTMEETTFADIPQRFEAGTQMTSQVVGLGEAVKFLSEIGMDNISRHEHEITKYALEKLSKIKGLDIYGPRTAESRGAAVSFAVKRIHPHDLGQVLDDHGVCIRVGHHCAWPVHRELNAQSTARASFYLYNTIDEVDRLVEAIEAAKKFFGVSEEGK

SEQ ID NO: 27459 - protein, 466 aa, Oryza sativa Indica Group
MAVIALKCPDVEVVVVDISAPRIEGWNSERLPIYEPGLDDVVRQCRGRNLFFSTDVERHVADAGIVFVSVNTPTKTRGLGAGKAADLTYWESAARIIADVSRSDKIVVEKSTVPVKTAEAIEKILAHNSKGGNIRYQILSNPEFLAEGTAIQDLFSPDRVLIGGRETPEGRAAVAALKSIYARWVPDDRIITTNLWSAELSKLAANAFLAQRISSVNAISALCEATGADVAEVANSIGKDSRIGPRFLSASVGFGGSCFQKDILNLVYICECYGLPEVANYWRQVIRINDYQKSRFVNRVVSTMFNTVAGKKVAVLGFAFKKDTGDTRETPAIDVCKGLVGDKAVVSIYDPQVTEEQVQRDLVMNKFDWDHPRHLQPMSPSSAKHVAVSWDAYEAARGAHAVCILTEWDEFRRLDYQRMYDAMHKPAFLFDGRNVVDPDKLRRIGFVVYSIGKPLDHWLRDMPAVA

SEQ ID NO: 27460 - protein, 470 aa, Oryza sativa Indica Group
MEQNVLVSCSAGNAGPGTSTLSNVAPWITTVGAGTLDRDFPAYVSLGNGKNYTGVSLYAGKALPSTPLPIVYAANASNSTAGNLCMPGTLTPEKVAGKIVVCDRGVSARVQKGFVVRDAGGAGMVLSNTATNGEELVADAHLLPAAGVGAKEGAAIKAYVASDPSPTATIVVAGTQVDVRPSPVVAAFSSRGPNMLTPEILKPDIIAPGVNILAAWTGKAGPTGIAADTRRVAFNIISGTSMSCPHVSGLAALLRSAHPEWSPAAVRSALMTTAYSTYAGAGDANPLLDAATGAPATPFDYGAGHVDPASAVDPGLVYDLGTADYVDFLCALNYTSTMIAAVARSKSYGCTEGKAYSVYNLNYPSFAVAYSTASSQAAEGSGAAATTVTHKRTLTNVGAAGTYKVSAAAMPGVAVAVEPTELAFTSAGEKKSYTVSFTAKSQPSGTAGFGRLVWSDGKHSVASPIAFTWT

SEQ ID NO: 27461 - protein, 482 aa, Panda oleosa
EKKNPGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALAMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLVETIRGFKLILSGELDSLPEQAFYLVGNIDEATAKATNLEMENNLK

SEQ ID NO: 27462 - protein, 528 aa, Synechococcus sp. RS9917
MTNNTGFDLLVIGAGASGASVAYEAVRRGLRVALLEANDIGGGTSCRSTKLLHGGVRYLELAFKTADTAQLRLVREALLERGHWLQQAPFLAHRLELALPTDHWFSQAYYRIGLGLYDALAGRSGIGSSRLLSARQLHEALPQIRAQSSGGVAYSDGQFDDARLNLLLALTAERAGAVVRTGCRVTALERNSQGGITGALSCNSSGEEEHWTARAVVNATGIQADAIRHMADPDLPPRMLTSRGMHLVLEANLCPQGLGLLLPATDDGRVLFMLPFFGRTLVGTTDTPCPLEQAQAPSADETAYLLDYVRRWFPGLQEPRVSSRWAGGRPLLRPADASRSSSRVVREHEVETLACGLVSVMGGKWTTCRPMALDTLAAVEKQLGQPLAAANTLPLLGADTDPTRTPQRLTEQRQQLKELLPDTALQPQQIDHLQAAHGLEAVARVSEWPEADREPLSAVMPICRGELRHAIEREHARSVTDVLARRCRLAMVDEQEAQRLRPEVTALLERSRPDQPLSEREGSLNLQH

SEQ ID NO: 27463 - protein, 514 aa, Arabidopsis thaliana
FILLCLFSLLCHSLFFKKPKDSRSFVLPSSPPSLPIIGHLHLLLSVLTHKSLQKLSSKYGPLLLIRIFYVPIILVSSSSMAYEIFKAHDVNVSSRGIIALDESLMFGASGILNAPYGDYWKFMKKLMATKLLRPQVLERSRGVRVEELHRFYRSILDKATKNESVEIGKEAMKLMNNTLCKLIMGRSFSEDNGESNRVRGLVDETYALSEKIFLAAILRRPLAKLRISLFKKEIMGVSNKFDELLERILQERKENLEEKNNEGMDMMDVLLEAYGDENAEYKITWKHIKAFFVEFFIGGTDTSVQTTQWAMAEMINNANVLERLREEIVSVVGETRLIQETDLPNLPYLQAVVKEVLRLHPPSPVLIRKFQEKCEVKGFYIPEKTTLIVNVYAIMRDSDSWEDPEKFKPERFLTSSRSGEEDEKELKFLPFGSGRRGCPGANLGSIFVGTAIGVMVQCFDWKIKEDKVNMEETFEGMTLKMVHPLTCTPFFEPNLYLLLLISKFPCLILSFGAC

SEQ ID NO: 27464 - protein, 466 aa, Synechococcus sp. RS9917
MTSPPAAISRPLPDLTTLRQAVDRGDTRPEAWRRQQLEAIANLIETHEQEILQALADDLGKPELEGMVEILALRQELKLCRRQLRRWMRPRRVAVPLAQQPGRAEVIREPLGCVLIIGPWNYPFHLTLQPLISALAAGNTAVVKPSEQAPATAALISRLLPLHLPGDVVQVVEGDGAVAAALIDQGYDHIFFTGGGAIGARVLAGAARHLTPVTLELGGKSPAVVLEGADLAVTARRLIWGKGLNAGQTCIAPDHLLVQDSIREELLEALAQARREFYGDAPLQSPDLARIINPRQYERLERLLDGAKEAGQVLIGGESDTASRRIAPTVLQVSDDHDPLMAEELFGPLLPLLSVASLEEAIARIRRQAKPLALYLFGGHAQEQQALLNGTSSGGVCFNDVVMQVGVPDLPFGGVGPSGMGTYHGEAGFRTFSHERSVLRRPFALDVRLRYPPYRVKRDWLKRLLG

SEQ ID NO: 27465 - protein, 235 aa, Oryza sativa
MTLLVESSSSSRREKFQRDFLFIYFWILGSAADAVEYRSRGARRSKLFSGCAGVAEGGAARRGGMDTMRGALERARMLVGMEVDEESAPEEQSFFDDVTRNCALTTTQRLYGFAICLAAGLTCTFLSMLVFFNPVKFGVTFTLGNLMALGSTAFLIGPKRQFDMMLDSVRIYATAVYIASIIIALFCALFVHSKLLTLLAIILEFGALVWYSLSYIPFARSVVSKVMTSCFDTEF

SEQ ID NO: 27466 - protein, 423 aa, Methanocaldococcus jannaschii [sequence omitted]

SEQ ID NO: 27467 - protein, 486 aa, Elateriospermum tapos
VSALEKKNLGRIAQIIGPVLDVAFPPGKMPNIYNALVVKGRDTVGQEINVTCEVQQLLGNNRVRAVAMSATDGLTRGMEVIDTGAPLSVPVGGATLGRIFNVLGEPVDDLGPVDTRATSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNKQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSRGKYVGLAETIRGFKLILSGELDSLPEQAFYLVGNIDEATAKATNLEMENNLK

SEQ ID NO: 27468 - protein, 822 aa, Roseovarius nubinhibens ISM
MIGAAEPLAARLRLPYSVILAVLGVLIGVGATFFLHTELTDALNPVAEAILDLPIRSNVFLYVFLPTLLFQATLGMNLRRMIDDWVPILMLAVVAVVVATVSVGYALAWVSALPLAACLLIGAIVSTTDPSAVVSIFRSISSPRRLARIIEGESLLNDAAAIALFGLFMGFVMLGTPDPELGDALLRFPLLIAGGAITGWLCARVAVWIMALFGRHELAQISVSVALPYLAYIGAEQIVGASGVIAVVAAGLTLNLVAPGRLPPQSWTNLRELWGVLAHWAGALIFILAALLIPRLLEEVRIGDILLVAVVIVAAVVARMVILFGLLPLLARLRLSPPVDRPYRVAILWGGLRGAVTLALALAVTESFRVPDDIQRVVGILATGFTLFTLIVQGTTLRWVIGRLGLDRLSPIDEALSRQVVAVALQTVREDLASTTENYDLSRDIVRSEAKRFGERLDEAVKTAEDSADILDRDRIALGLIVLAGHERDTIIDRVRERTISARMAEKVMSDAERLIEGARSQGRSGYQRAARRSVAYGKGFRAAVWLNRRLGISAPLAQMTTDRFELMLSQRLILRDLGGFIDGRIRRIHGRRVAELLHELLSRRIEAVETALEGLRLQYPGYAEELERRFIRRTALRLEEREYMMMREDGLIGAEVYMSLMADLGARRAAAETRPKLDIALQRTALVRQFPLFAEFSDRALRQLARGLETRYANVGEAIIRKDSAAKRVFFIASGAVELESAGQTWRLGRGEMFGQMAILMQKSVRAEAKAIAPTTLLVLDEDRFRRLLGRSKALRKAVRESAEKRGIEPSALLPPAKDAS

SEQ ID NO: 27469 - protein, 224 aa, Oryza sativa Japonica Group
MAAAAVDPMALGLGTSGGGGGGESAVGGDGAEPVDLVEHPSGIVPTLQNIVSTVNLDCRLDLKKIALQARNAEYNPKRFAAVIMRIRDPKTTALIFASGKMVCTGAKSEDHSKLAARKYARIVQKLGFPAKFKDFKIQNIVGSCDVKFPIRLEGLAYSHGAFSSYEPELFPGLIYRMKQPKIVLLIFVSGKIVLTGAKYRKEIYAAFENMFPVLTEYRKTQQRW

SEQ ID NO: 27470 - protein, 196 aa, Arabidopsis thaliana
MGKAKKPQKFAVVKKMISHKALKHYKEEVLNPNKKDLTELPRNVPSVPAGLFFSYNSTLVPPYRVLVDTNFINFSIQNKIDLEKGMRDCLYANCTPCITDCVMAELEKLGQKYRVALRIAKDPHFERLPCIHKGTYADDCLVDRVTQHKCFIVATCDRDLKRRIRKIPGVPIMYVTNRKYSIEKLPEATLGGAPRY

SEQ ID NO: 27471 - protein, 653 aa, Coprinopsis cinerea okayama7#130
MLFEHHDHPEQSPKQAVVDDDHHHDRDRDPGSPGGTPQPPPRKLCVRHQRMADEGMNLKLQQSLDALSIEERESVNAIWSNFSSSSHPRRALILQGLLTMCCFSQLSLLTEQLAHLIRIDPFVVLPREIALKILSYLDATSLCRAAQVSTRWRALADDNVLWRAICEQHIGQKCHKCGWGLPVLEKKRALCYRSTPSNSHSPVSSPSISLPSTSTPASTSTDPTTSRKRPAADSSDLLSPPVKRQRSDEASSSQTQESVNSLTNTAPTPLPAPTLRPWKDVYSERMTIERNWRRGRCTVRTLKGHTDGVMCLQFNETLSHPAFPVLITGSYDRTVRVWNLETGQELFCLKGHTRAVRALQFDEVKLITGSMDNTLKVWDWRRGKCIRTLTGHTEGVVCLNFDSNVLASGSVDSTIRVWNMRSGTSFTLRGHTDWVNAVQLWDSQPQSVQQESGSGSLLDMSGCRSPNANAGNNNIDPGKMLFSASDDGTIKLWDLNMRTCVRVFTGHVGQVQSMKLLVEGCDSNRDEDGEEAAVDSGSSVASRDSPEPAPKRRKKPLLISGSLDNTIRLWDIETGKATGALFGHIEGVWSVASDKLRVVSGSHDRTIKVWSREDQKCIATLVGHQAAVSCIALGEDKIVSGGDDNDIKVWSFA

SEQ ID NO: 27472 - protein, 577 aa, Burkholderia xenovorans LB400
MKLFRNARSSVSGFALVALVSVSSAFLESTPALAKPPAKTQPAVLTASAIAVADKYSADAAEQIFKEGGNAVDAAVAIAFTLAVTYPEAGNIGGGGFMTLYVDGKPYFLDYRERAPLAATRNMYLDDKGEVIKGMSLYGYRAVGVPGTVDGMWQAQRRFGKLKWKQVLAPAIHYARDGFEVSQQLQERRDAAAKDFAGKTNFDTYFGNLKQGVDFKQPDLAGVLQRISDQGAKDFYQGKTADLIAASMRGHGLITKADLQQYKAVWREPVEADWNGYRVYTAPPPTSGGIGLVQLLKMKADLAPDFKDVPLNSAQYVHLIAEIEKRVFADRAQYLGDPDFYKVPVAQLTDDAYIAKRAAEVNPTAPSDTKTVQAGLGTSMPEKAETTHFSVIDKWGNAVSNTYTINGYFGSGVVADRTGIVLNDEMDDFSAKPGVANMFGVVGSDANSIEPKKRPLSSMSPTILTKDGKVSLVIGTPGGSRIFTSIFQVINNIYDYNMPLPQAVAAMRFHHQLLPPDTIFWEPYKPIDGELAKQIEAKGYTLKGQDFSGDIQAIKVNGDTPEAAADPRGRGVTRVIQ

SEQ ID NO: 27473 - protein, 137 aa, Brassica napus
MASNIMRPAFAYTVVYVKDVAKSVEFYSRAFGHNVRRLDESHRWGELESGQTTIAFTPRHQHETDDLTGKVQATHSDPERAPIEVCFCYPDVDAAFKRAVENGAVAVSEPEDKEWGQKVGYVRDIDGIVVRIGSHVK

SEQ ID NO: 27474 - protein, 1157 aa, Aspergillus nidulans FGSC A4
MSRITFNAPESRSENGARDSLELASLASSSPESALDLSRSSSPSGISSSRKLSLEDEDPLSNSNPHMTHLSSRPRPDRSYSISSAFDFGRNLFPLSQTADGYAPLGAPTQIDGDGGGIDGSLERNKTLTYINGLSLVVGLVIGSGIFSSPSQVNANVGSPGGALIAWLVAGLLAWTGAASYAELGGAIPLNGGAQAYLSKIFGELAGFLFTWCAVLVLKPGSAAIISIIFGEYVVRAILGAEVEQISPWINKGVAFGGLLVVICLNCLSTRLAARIGDLFMIFKFVALIGVAIIGIIVAATGLSAKGQANQEWKISWFEGTNMDISGWAMALYADRPTDTAQTNYVTGEFKNPNRDLPRVIHTAMPLVIVSYLLANVSYFFVLPHSTIEATNTIAVQFGDKVFGSIGALIFALIVSASCFGALNATVFTSGRLVYAAGKEGYLPTLFGNLWTQGSSSSMNRLQRQSWMSKLVRRVFGNGTWIGYTPINAMALNGILTLLYVIVGEFGTLVTFYGVAGYTFYFLTVLGLIVLRVREPQLERPYKTWISTPIIFCCVSLFLLSRAVISEPLQTLIVVAFIVAGVPVYIWRIYKRDELAGVEVEVPQLTLHYLTHTRMGSLQPWEQTVAKKRALRDQALNPYFVSDIDNRPPRVRSVSNRSCLEHDPLVQEITNIDNIPALVEQLRKGRFTAEQVTFAYIRRATVAHQLTNCITEVIFNDALAQARELDKVFKATGKLIGPLHGVPVTVKDQFNVKGYDSTIGYVGRSFSPASEDAVLVQMLKKMGAIILAKTNLPQSIMWAETENPLWGLTINPRDPALTPGGSTGGEAALLALHGSILGFGTDIGGSIRIPQSILGLYGFKPSSGRLPYRGVPVSTEGQEHVPSSVGPMARDINSIYYITRLLTSSRPWDLDPRCANLPWNESVFRGIQSRPLVIGLILDDGVVKIHPPIERAMRELAAKLEANGHELVTWNTSDHLKCISLMDRYYTVDGGEDVRRDVAVAGEPFIPHVEALVNRGKPISVYEYWQMNTERNNLQKKYLDGWNAARSPSGKPVDVLLSPTMPHVAVPHRSVRWVGYTKIWNLLDYPAITFPVDRVRADKDVLPPDYRPRNDLDAWNWSLYDAEAMEGQPVNLQVIGKRLEEESLLGAATVIERIWRS

SEQ ID NO: 27475 - protein, 534 aa, Vitis vinifera
MIFPSISVRAPLNPITPSVLKPPPKPSLFRVKPVHCSNHHQNPNAVDKSVKLTTHLIHHITVATELVNKKHGKKNSGDEERRESSFQVGSRQMLGLCGFGYGVQGFRCFPWLALNFHMAHNLRLDPSMMQIVQNIGNLPMVAKPLFGILSDAFYIGGAHRIPYIFLGGEALATLMLCVLLSNLGASITEVAQDALVAEYGQKHRKGGLQSYAFMAVAAGGILGNLFGGYFLQNTQPNTMFLVFAILLLFQVAVSLTTKEDSLGLPQPVDQNLVGKSIFEGVREQFSNLMTTISEDGICRPLAWVVASIAMVPILSGPIFCYQTQCLCLDPSTIGMSRVVSQLMLLSATVLYNQFWKRIPMRKLIGTVQILYASSLLLDLVLVRQINLSLGIPNQVFALCFSGVAETIAQFKLLPFSVLFASLCPSGCEGSLTSFLASAFCLSSIFSGVFGAGLASLIGIIGGDYSSLPVGILIQFLAALVPLGWMHLVPMVDPTAEKERKKGTSKRSRRNRRVGRVALDSIYVYRREREYEEQR

SEQ ID NO: 27476 - protein, 119 aa, Campylobacter jejuni RM1221
MKELNEEEKKVILNKGTEAPFSGKYNDFYEKGIYQCKQCGASLYKSEDKFKSGCGWPSFDDEIKGAVKRIPDKDGIRTEIVCANCNGHLGHVFEGEGFSAKNVRHCVNSISLEFVKTKD

SEQ ID NO: 27477 - protein, 215 aa, Magnaporthe grisea
MRTTLLRPLVPRQNIFSSSIPRTSFVKPNFVATPKSPINNTTRVRFYSSTMSKPNVFFDISFNGVTKRVEFKLYDDVVPKTADNFRRLCVGEPGVGGYKDSGFHRIIPDFMLQGGDFTRGNGTGGKSVYGEKFADENFQIKHTRPGLLSMANAGPNTNGSQFFITTVKTSWLDGKHVVFGEVVSGFEDVIKPIEALGSSSGTPKTKVTIVNAGTV

SEQ ID NO: 27478 - protein, 432 aa, Aeropyrum pernix K1
MASPPCTTEELSPPPGGSLVEYSGGSLRVPDNPVVAFIRGDGVGPEVVESALKVVDAAVKKVYGGSRRIVWWELLAGHLAREKCGELLPKATLEGIRLARVALKGPLETPVGTGYRSLNVAIRQALDLYANIRPVRYYGQPAPHKYADRVDMVIFRENTEDVYAGIEWPHDSPEAARIRRFLAEEFGISIREDAGIGVKPISRFATRRLMERALEWALRNGNTVVTIMHKGNIMKYTEGAFMRWAYEVALEKFREHVVTEQEVQEKYGGVRPEGKILVNDRIADNMLQQIITRPWDYQVIVAPNLNGDYISDAASALVGGIGMAAGMNMGDGIAVAEPVHGTAPKYAGKDLINPSAEILSASLLIGEFMGWREVKSIVEYAIRKAVQSKKVTQDLARHMPGVQPLRTSEYTETLIAYIDEADLNEVLAGKRG

SEQ ID NO: 27479 - protein, 484 aa, Candida glabrata CBS 138
MRTPFFKSKEMSKSHASEFIKFLDASPTPYHAVASIRQHLVSHGFKELSEKTAWHGKVEHNGKYYVTRNNSSIIAFSVGGKWKPGNPIAVTGAHTDSPALRIKPISKRVSEKYAQVGVETYGGGIWHSWFDSDLALAGRVFVNDKSSGKIVSKLVDLKRPLLKIPTLAIHLDREVNQKFEFNKETQLLPIAGLVKDEKNDKSKNDNNSGAIKSIVERHHKELLDLVAKELELKSVEDIEDFELILYDYQGPTLGGINDEFVFSGRLDNLTSCFTSMHGLTLAADTDLSNESGIRMMACFDHEEIGSSSAQGADSTFLPSVIERLSYLKADGTDAENPVTVPSYHETYSRSFFLSSDVAHAVHPNYASKYESQHKPLIGEGPVIKINANQRYMTNSPGLVLVKKVAEISKVPLQLFVVANNSPCGSTIGPILASKTGIRTLDLGNPILSMHSIRETGGSRDIDYQIQLFQKFFEQYTKLEDQIEV

SEQ ID NO: 27480 - protein, 182 aa, Idiomarina loihiensis L2TR
MKWNIPNILTSFRIVLIPVFLVVFYLPMEDARFWAAFIFWLAAITDALDGYIARRFNQFTKFGEFLDPVADKAMVVAALVVIVEDYNSAFITIPALTMICRELIVSALREWMAQSGHRAKVAVSNLGKWKTVAQMLALIGLLWNANVYIYWLSMFLFYSAFVLTVWSMWEYLRGAKSELTRN

SEQ ID NO: 27481 - protein, 482 aa, Ralstonia eutropha JMP134
MPDFDMVLFGGTGDLARRKLLPSLYEAHHAGLLHPRARILATGSQPLSQEDYIASLEQGVRPGLAHAPPESWAAFLARICYVQADARVPAHFDALAEKVLSRRPEVVVCYLATAPHLFVPICEQLARTGLNTPNVRIVLEKPLGHDLESSEAINAAVAKFFAEDQIYRIDHYLGKESVQNLMAIRFGNALFEPLWRREWVQDVQITIAEELGVETRGDFYDRTGALRDMVQNHLLQLLCMVAMEPPSSLSEDAIRDEKIKILKALKPITPQAVAEKTVRGQYRAGAIGGKPVPGYLDEKGIAADSRTETFVAIKAEIANWRWEGVPFYLRTGKRMQSRVAEIVVHFRDVPHAIFPRPLTLSPQNRLVIQLQPEESIRLYFLVKQPGDTLELTPTSLDLDFANSFKVRRAGAYERLLLDVIRGRLGLFVRRDEQVQAWRWVEPILDTWEESNVPPKPYTAGTWGPAASSALMSRDDSLWHEEA

SEQ ID NO: 27482 - protein, 443 aa, Aeromonas hydrophila
MSGSLLTRLQGYRVRDIAPKPPVAGKLTRVVGLTLEAIGCRAAIGALCRIDTQDGMLEAEVVGFSGDRLFLMPSEQLKGVIPGARVVPITEEHGIPVGMNLLGRVIDGIGQPLDGLGPILSSQTVQFAQHRINPLSRRPIHQPMDVGVRAINAVLTVGQGQRMGLFAGSGVGKSVLLGMMTRGSVADVVVVGLIGERGREVKEFIEDILGEEGRARSVVVAAPADASPLMRLKGCETALAIAEYFRDQGLNVLLLMDSLTRYAQAQREIALAVGEPPATKGYPPSVFAKLPALVERAGNGSDGQGSITAFFTVLTEGDDLQDPIADAARAILDGHIVLSRELADAGHYPAIDIEKSISRVMPMVTSPQHMELARTLKQFYSLYQQNRDLITIGAYSQGSDPRIDRAIVQKPYLDQFLQQGMREVIHYDEGLQSLQLVAMPLMR

SEQ ID NO: 27483 - protein, 476 aa, Podocalyx loranthoides
EKKNRGRIAQIIGPVLDVAFPPGKMPNIYNALVVKGRDTTGQQLNVTCEVQQLLGNNRVRTVAMSATDGLMRGMEVVDTGAPLSVPVGGATLGRIFNVLGEPVDDLGPVDTRTTSPIHRSAPAFIQLDTKLAIFETGIKVVDLLAPYRRGGKIGLFGGAGVGKTVLIMELINNIAKAHGGVSVFGGVGERTREGNDLYKEMKESGVINEENIAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRVLAAKGIYPAVDPLDSTSTMLQPKIVGDKHYETAQRVKQTLQRYKELQDIIAILGLDELSEEDRLTVARARKIERFLSQPFFVAEVFTGSGGKYVGLAETIRGFQLILSGELDSLPEQAFYLVGNIDEATAKATNLE

SEQ ID NO: 27484 - protein, 482 aa, Pogonophora schomburgkiana
EKKNLGRIAQIIGPVLDVAFPPGKMPNIYTALVVKGRDTVGQQINVTCEVQQLLGNNRVRAVAMSATDGLTRGMEVIDTGTPLSVPVGGATLGRIFNVLGEPVDDLGPVDTRTTSPIHRAAPAFIQLDTKLSIFETGIKVVDLLAPYRRGGKIGLFGGAGVGKTVLIMELINNIAKAHGGVSVFGGVGERTREGNDLYIEMKESGVINEENIAESKVALVYGQMNEPPGARMRVGLTALTMAEYFRDVNKQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEIFTGSPGKYVGLAETIRGFKLILSGELDSLPEQAFYLVGNIDEATAKATSLEMENNLK

SEQ ID NO: 27485 - protein, 461 aa, Kluyveromyces lactis NRRL Y-1140
MSAEPYEPEFQQAYNEVYNCLKDSTLFDKKPVYKKVLPVVSVPERIIQFRVTWENDKGEQEVATGFRVQFNSAKGPYKGGLRFHPTVNLSVLKFLGFEQIFKNALTGLSLGGAKGGLCFDPKGRSDSEIRRVCYAFMKELSRHIGQDVDVPAGDIQVGGREIGYLFGAYRHYKNSWEGVLTGKDLNWGGSLIRPEATGYGLIYYTEAMIKYASQGKESFEGKRVVISGSGNVAQYAALKCIELGATVLSLSDSKGSVISETGITAEHIYAIQDGRAAWKTLEQIVGEASVFSGSSVKYIAGARPWVHVGKVDVALPCATQNEVSGAEAEHLVANGVKFVAEGSNMGSTQEAIDVFEGVRLQTASASAPAVWYAPGKASNMGGVAVSGLEMAQNSARVSWTRETVDAELKKIMTTCFDDCVTTAKEYSNESNVEALPSLVKGANLTGFIRVADAMLHQGDVF

SEQ ID NO: 27486 - protein, 536 aa, Aspergillus nidulans FGSC A4
MAALRRLHATAQQFAPSTTSAASTATEYPTTHEAIANPIDTTNFLNNEFVPSKASTWIDLYDPATNNLVTRVPQSTDEELRAAVEAAQKAFPAWRATSIMARQQIMFKFVNLIRANWDRLAASITLEQGKTFADAKGDVLRGLQVAETACGITTQITGEVLEVAKDMETRSYREPLGVVAAICPFNFPAMIPLWCIPIATITGNTMVMKPSERDPGAAMILAELAREAGFPPGVINIIHGSAKTVDFILDAPEIKAISFVGGNRAGEYIYTRGSANGKRVQANLGAKNHAAVLPDANKNQTINAIVGAAFGAAGQRCMALSTLVTVGETKEWLPEMAERAKALNVNGGFEEGADLGPVISPESKKRIEDLIASAEEEGATILLDGRGYKPEKYPNGNFIGPTIITGVTPGMKCYKQEIFGPVLVCLEVETLDDAIELINKNEYGNGAAIFTRSGPTASRFQKDIEAGQVGINVPIPVPLPMFSFTGNKKSIAGGGANTFYGKPGLQFYTQQKTVTSLWRAEDAVSTKAHVVMPTHS

SEQ ID NO: 27487 - protein, 120 aa, Alteromonadales bacterium TW-7
MSVSKDQILDAIAEMSVMDVVALVEAMEEKFGVTAAAAMVAGPAAEAAEEKTEFDVILTGAGANKVAAIKAVRSATGLGLKEAKALVEAAPTPVKEGVSKEEAEALAKDLTEAGAEVEVK

SEQ ID NO: 27488 - protein, 203 aa, Oryza sativa
  misc_feature (119)..(119): Xaa can be any naturally occurring amino acid
MAAEAAAALEGSEPVDLAKHPSGIIPTLQNIVSTVNLDCKLDLKAIALQARNAEYNPKRFAAVIMRIREPKTTALIFASGKMVCTGAKSEQQSKLAARKYARIIQKLGFPAKFKDFKIXNIVGSCDVKFPIRLEGLAYSHGAFSSYEPELFPGLIYRMKQPKIVLLIFVSGKIVLTGAKVRDETYTAFENIYPVLTEFRKVQQ

SEQ ID NO: 27489 - protein, 427 aa, Marinococcus halophilus
MMQNDLSVFNEYESEVRSYVRGFPTVFHQAKGYKLWDLDGKEYVDFFSGAGALNYGHNDENMKQKLLTYIQEDGVTHSLDMATKAKGEFIDAFQNIILKPRNMDYKIMFPGPTGANSVESALKLARKVTGRTNVVSFTNGFHGMTIGALSVTGNKFKRNGAGMPLSNTSTLPYDQFLKESNNSIEYIENFLDNGGSGLDKPAAFIVETVQGEGGLNAASSEWLRSIEKICRERDIKLILDDVQAGVGRTGTFFSFEPAGIKPDFVCLSKSIGGNGSPLAITLVAPEYDKFAPGEHNGTFRGNNFAFVTGTEALNYWKDDRLEKNVQEKSERITSFLDDMIKKHPEMKGVRKGRGFMQGIMSPIEDLADNIAGRCFEHGLIMETAGAEDEVFKLFPPITIDDEGLERGLSILQQAIEEVTAESNLVAK

SEQ ID NO: 27490 - protein, 308 aa, Burkholderia xenovorans LB400
MPNVPAHNWGLEQIVADLRASREQLHRTRHPLGIRELPSREAVVNIVAGLRAALFPTHYGAPDLTDETVDYYVGHTLESTLRLLAEQIRRALRFLPEFGETPDADLQARAFEVAREFGTQLPGIRALLVSDIQAAFTGDPAAQHITEILLCYPGVWAMTHHRLAHALHRLGVPLLARFINEIAHSATGIDIHPGATIGPSFFIDHGTGVVIGETAIIGEHVRVYQAVTLGAKSFAADLDGALIKGNARHPIVEDDVVIYAGATILGRVTIGRGSVIGGNVWLTHSVPPGSSVSQGKIREGERTDEGRQ

SEQ ID NO: 27491 - protein, 549 aa, Corynebacterium diphtheriae NCTC 13129
MPNVSKPVANGNTVESNNAELAFGGVDFSYSDTHENSCSRTSSKWVNPLRDAEDKRLPRIAGPCGMVIFGVTGDLARKKLLPAIYDLAHRGLLPAGFSLVGYGRRGWSKADFENYVKQAVVAGARTDFRENVWARLAEGMHFVQGNFDDDAAFDSLASLLADLDQTRGTAGNWAFYLSVPPDYFSDVCHQLQRSGMATAEGNSWRRVIVEKPFGHDQESARQLNNLINSVFPEKSVFRIDHYLGKETVQNIMALRFANQLFDPLWNSHYVDHVQITMAEDIGLGGRAGYYDGIGAARDVIQNHLIQLLALVAMEEPVAFTPQELQAEKIKVLRATRPVEPFAKTTARGQYSRGWQGSELVQGLREEDGFDPNSGTETYAACTLEINSRRWAGVPFYLRTGKRLGRRVTEIALVFKDAPHQPFSEGSRHSQGRNVVVIRVQPDEGMLMRFGSKVPGNTMEVRDVNMDFSYSEAFTEESPEAYERLILDALLDEASLFPTNEEVELSWQILDPILNFWSDRGQPEEYPAGTWGPAGADKMLEREGRAWRRP

SEQ ID NO: 27492 - protein, 192 aa, Nicotiana tabacum
SPYDNNGGTCVAVAGADYCVIAADTRMSSGYNILTRDYSKIIKLADKCVLASSGFQADVKALQKVLAARHLIYQHQHNKQMSCPAMGQLLSNTLYYKRFFPYYSFNVLGGLDNEGKGCVFTYDAVGSYGRVGYSSQGSGSTLIMPFLDYQLKSPSPLLLPAKDAVTPLSESEAIDLVKTCFVSATERDIYTG

SEQ ID NO: 27493 - protein, 449 aa, Gluconacetobacter xylinus
MRIAMIGGGYVGLVSGTCFAEFGTDVAIVETNPDRLTALREGRIPIYEPGLDRLVEENVEAGRLTFGDDIAAAVKGADAVFVAVGTPSRRGDGQADTSYVYAAVEQIARVADGYTVIVTKSTVPVGTGREIAQIIRKTRPDLDFDVASNPEFLREGNAIQDFMRPDRVIIGTDQYKPEGTERAQNILRKLYRPLYLLETPIVFTGLETAELIKYSANSFLAMKITFINEISDLCEKVGANVNDVARSIGLDGRIGKKFLHPSPGFGGSCFPKDTRALTAIGRNAGSPVRLIETTVAVNEQRMKDMGERVITFAGGDVSGLTIGVLGLTFKPETDDMREAASIPVLDMLDKGGAKIRAFDPAGMTTARPVLPQSVTYCTDALDAAKGADILVVLTEWNEFRSLAPEKLAAEMKGRKIADLRNIWDPKAIKDAGFEYISLGRPDGVQPHQA

SEQ ID NO: 27494 - protein, 360 aa, Triticum aestivum
MGATNHTLQALLPWLLLFVHQAAAASGGFECTTATDGADKQGATKLKLVAIASILTAGAAGVLVPVLGRSMAALRPDGDIFFAVKAFAAGVILATGMVHILPAAFDGLTSPCIYKGGGDRNGFPFAGLVAMSAAMATMVIDSLAAGYYRRSHFSKARPLDNIDIPGDEEGRADHPHVHAHGHSHGDAIVVSSPEEAAIADTIRHRVVSQVLELGILVHSVIIGVSLGASVRPSTIKPLVGALSFHQFFEGIGLGGCIVQANFKVRATIIMATFFSLTAPVGIVLGIAISSSYNVHSSTAFIIEGVFNSASAGILIYMSLVDLLAKDFNNPKLQTNTKLQLMTYLALFLGAGMMSMLAIWA

SEQ ID NO: 27495 - protein, 260 aa, Corynebacterium diphtheriae NCTC 13129
MARTPLIAGNWKMNLDHLQAVATVQKLAFALPKEYYEKVDVAVTVPFTDLRSVQTLIEGDKLAITYGAQDVSQHEAGAYTGEISAQMLAKLGCTWVVVGHSERREYHGESSELVAVKAKAALNQGISPIVCVGEPLEIREAGTHVEYVVEQTRASLAGLTADDLAKTVIAYEPVWAIGTGKVASAADAQEVCAAIRNLIIELAGKEVAEGLRILYGGSVKAETVAEIVGQPDVDGGLVGGASLDGEAFAKLAANAATVVD

SEQ ID NO: 27496 - protein, 405 aa, Corynebacterium diphtheriae NCTC 13129
MAIKTLKDLLAEGVEGRHVLVRSDFNVPLNDDREITDAGRITASLPTIKALVDNGARVILMAHLGRPKGEVNEKFSLAPVAEALSEALGQYVALAGDVVGEDAHERANGLNDGDVLLLENVRFDPRETSKEEAERGEFADQLVALTAENGAFVSDGFGVVHRAQASVFDVAQRLPHYAGTLVEKELEVLGNKVASAPERPYAVILGGAKVSDKLGVIEALATKADKLIIGGGMCYTFLAAKGINVQKSLLQEEQINKCKELLEAYADKIVLPVDLVAAAEFASDAENKIVAIDEIPEGWMSLDVGPKTVEKFAEVLATSKTVFWNGPMGVFEFENFSAGTRGVAEAIIAATANGAFSVVGGGDSAAAVRLLGLDEDGFSHISTGGGASLELLEGKNLPGVSVLES

SEQ ID NO: 27497 - protein, 422 aa, Acidobacteria bacterium Ellin345
MNVGVYGSGYLGTVVSACLADLGMPVTCYDADTTLVMDSAQGTLRFHEKNLKEIVRRNVRADRLMYTTELESVARRAGAIFIAEDTPDEIEHIVPELAAVAQPHAVFVIVTPTPVGTTRRIETELRMRSYKQHVVVQPMFLTDGCAVEDFNWPDRLVLGTTSHDAVDVMKQIYRPIVMRGVPLIVTSYETAELVREASTAFVATKLSFINELASLCDHVKADATDLALAMGLDKKIGPRCLQPGARIGGAFVENEMNALASLAEEFGVSLKVLTAAREVNHDFSDQVMEKLTSLMPSVVGREVGILGLAFKPNTNCVAGSVSLSLARGLISRGARVRAYDPVAIPEAQRELNDVVHFCQTAYEAAEGSDALVVGTGWPEFRALDWQRVKKLLKTPVVFDTKNMLDAGRLRNMGFRYLGIGRS

SEQ ID NO: 27498 - protein, 334 aa, Corynebacterium diphtheriae NCTC 13129
MTIRVGINGFGRIGRNFYRAITERGADIEVVAINDLTDNHTLSHLLKYDSILGRLGKEVSYDDESITVDGHRMVVTAERDPKNLKWGELNVDIVVESTGFFTDANAAKAHIEAGAKKVIISAPAKNEDATFVVGVNHTDYDPAKHNIISNASCTTNCLAPMAKVLDEKFGIVKGLMTTIHAYTGDQRLHDAPHRDLRRARAAAQNIVPTSTGAAKAVALVLPELKGKLDGFAMRVPVITGSATDLTFETTKEVSAEEINAAMKEAAEGELKGVLAYTEDPIVSTDIVTDAHASIFDAGLTKVIGNQVKVVSWYDNEWGYSNQLVSLTEYVGERL

SEQ ID NO: 27499 - protein, 455 aa, Kluyveromyces lactis NRRL Y-1140
MMMKWTHHRPNTGVSMSQPKIFRKKRQESRYHGGSQSRYQPNRPNNHHNTAGNVNVNRSLGKRNPRGKFNRPSNGPETSGSRFEGHGSIPRGPRAMGSSAESAGDSHSRNIFGKKPLALISFQDVKSSFQPLAQVGEGTYGKVYKAENVHTGKLIALKRLRLEQERDGFPITSIREIKLLQQLNHPNISLIHEIIVSDKNTISMGFQYMENDLSGMLMDKSIQFSDSNIKHLMKQLFVGLQYLHQQQIVHRDIKGSNLLIDNRGNLKITDFGLAKKLTDVSSPASNTNRVITLWYRPPELLLGATDYKYEVDCWGCGCLLVELFAGAAIFPGSNEVDQFQRILSIMGSPTLEQWPKMLDMPWWFMLVPQISKTYKNVFFDEFSKVPQDALDLASKLLRYDQDTRFTTTEALQHHYFTNEPKPQPLLLGPEFKGSHEYEVKKIRRKERERQKETTV

SEQ ID NO: 27500 - protein, 561 aa, Botryotinia fuckeliana
MKNSFFSSLAKFASLSLAFALPTAEVIPSALEERQSCANTATTRSCWGQYSASTNSYTTVPKTGYWLVVQNTTLSADGVSRPTLNFNGTIPGPQITADWGDDVIVHVTNKLTSNGTSIHWHGIRQLNNAQYDGVPGITQCPIAPGGTLTYKFHADNYGSSWYHSHFILQYGDGLFGPLVINGPATANYDVDLGMLFLNDWNHVPVQSLWDKAKTGAPPTLLTGLMNGTNTYNGAGKKFQTTFTPGLKYRIRVVNTAVDGHFQFSIDGHSFQVIAMDFVPIVPYNATSILVSIAQRYDIIVTANAAVGNYWIRAGWQTACSGNTNAANITGILRYTGSSSTADPTTTSTVTASTSCLDEPLASLVPFVPINPVASSIMKTTLTTGGGQWLFNGSSLLLNWTDPTLLTVLNSGNIWPTEYNVIPIESTTANKGWAVLAISGPNGPNHPIHLHGHDFWTLSQGTGAYTATTALNLVNPPRRDVMTLPTGGHLVIAFQIDNPGSWLMHCHIAWHASEGLALQFVESESSILPTIGTADVSTFQNTCAAWKAWTPTEPFPQDDSGI

SEQ ID NO: 27501 - protein, 328 aa, Bradyrhizobium sp. BTAi1
MIMSLHPDIAALLDMIQLGTESGARIPFPQLTPAQARADFDASSPLLDVDPPPLVHERQLMLPARDGTAIAARLYADRTPDCAEPLPVLLYMHGGGFVVGSLDSHQPLCRGLAIDSGVAVLSIDYRLAPEHRFPTAFEDCVDALAWLGREGPAAGLDPRRVAVGGDSAGGTLAAALAIAARDDRALPQPLFQVLAYPGLSPQQSSESYAAFGSGFLLERETVDWFFNHYLRQEADRHDWRFAPLAAPDLAGVAPAMLLLPEFDPLIAEGRDYAARLRAAGVAVDLKIYPGMIHEFLRMGNVVPDALQARAEIGARLAEVFARQTGVGR

SEQ ID NO: 27502 - protein, 187 aa, Rhodospirillum rubrum ATCC 11170
MSLIGSEVKPFKADAFKAGKFVTVTDDTLKGKWSVVFFYPADFTFVCPTELEDLAENYAEFQRLGVEIFSVSTDTHFAHKAWHDTSEAIKKIEYTMVGDPTGTISRNFDVLIEDAGLADRGTFVIDPEGRIQIVEITAGGIGRDALELLRKVKAAQYVASHPGEVCPAKWKEGEKTLAPSLDLVGRI

SEQ ID NO: 27503 - protein, 108 aa, Zea mays
  misc_feature (55)..(55): Xaa can be any naturally occurring amino acid
  misc_feature (67)..(67): Xaa can be any naturally occurring amino acid
  misc_feature (81)..(81): Xaa can be any naturally occurring amino acid
MALTSCLKTGVVPMSPTTGLYLSGSLLKSDSAFPGAGRLQSVQKSDKKRLRIQAXFTFPPAFLTRNXGRSKKQKQLKQDLXLKAIDPLQRGGPRLALMTNLRIDQVGA

SEQ ID NO: 27504 - protein, 337 aa, Oryza sativa Japonica Group
QGFTHFLYNSPASLSATAGVVFMCLVWIMHRRKQTLGFIIHHKYTGNESNTEEELKRYQSLSPKRYRYSDLKKITKCFKEKLGEGGFGTAFKGNLKDGRMVAVKLLKGAKGNGEEFLNEVTSIGRTSHVNIVNLLGFCLERSKRALVYEYMANGSLGKYIYSESLRLAIGLESLQKIAIGVARGLEYLHQGCSTRIIHFDIKPHNVLLDEDLCPKIADFGLAKLCHLKDSAISMAEARGTIGFIAPEVFSRGFGVVSTKSDVYSYGMMLLEMVEGRKNVKTNTDNSSAYFPNWIYDHLAKDLQSHEVTCENEEIARKITLVGLWCIQTAPRKSSFNE

SEQ ID NO: 27505 - protein, 156 aa, Arabidopsis thaliana
MHSSLKTMAPAKLERLCVLSFFLFCATESLESLPEDKLILRGLKFYGFHGVLPEERELGGLFIVDINLWLSLKKAIESDNLADTVSFADTFRLVKKIVEGPPRNLYETVADDIASEMLETFPKINVIRVKFGKPNPSLVNSTVDFLGAELFRKRNH

SEQ ID NO: 27506 - protein, 335 aa, Glycine max
EYYDLMHEFMTAVKQNYGEKVLVQFEDFANHNAFELLAKYGTTHLVFNDDIQGTASVVLAGVVAALKLIGGTLPEHTFLFLGAGEAGTGIAELIALEMSKQTKAPIEESRKKIWLVDSKGLIVSSRKNSLQHFKKPWAHEHEPVNSLLEAVKVIKPTVLIGSSGVGRTFTKEVVEAMTSNNDKPLILALSNPTSQSECTAEEAYQWSEGRAIFASGSPFDPVEYKGKVYASGQANNAYIFPGFGLGLVISGAIRVHDDMLLAASESLAKQVSEENYKNGLIYPPFSNIRRISANIAANVAAKAYELGLATRLPRPQNLVKCAESCMYTPVYRNYR

SEQ ID NO: 27507 - protein, 325 aa, Gibberella zeae PH-1
MENYQKLEKIGEGTYGVVYKARDLANGGRIVALKKIRLEAEDEGVPSTAIREISLLKEMRDPNIVRLFNIVHSDGHKLYLVFEFLDLDLKKYMESLPISDGGRGKALPEGSSPHLQHLGLGDTVVRKFMYQLCDGVKYCHSHRVLHRDLKPQNLLIDKDGNLKLADFGLARAFGVPLRTYTHEVVTLWYRAPEILLGGRQYSTGVDMWSVGCIFAEMCTRKPLFPGDSEIDEIFKIFRTLGTPSEDNWPGVTSYPDFKASFPKWQRDYSKSLCSTLDDHGLELLEMMLVYDPAGRISAKGAFNHPYFEPHLAQKQASAQTNGYYH

SEQ ID NO: 27508 - protein, 656 aa, Herminiimonas arsenicoxydans
MRGIKPLLDKVDVTLNPGDKIGLIGANGAGKSSLFGLLRGELHADLGTIDFPSKWRVAYVAQETPPLERSAIDYAIDGDVTLRRLEEELAFLESEPDTADNGTLIGDLYSALADADAYTVRSRGEQLLLGLGFTMAQMEQPVASFSGGWRMRLNLAQALMCPSDLLLLDEPTNHLDLDAIIWLEDWLKRYPGTLLVISHDRDFLDGVVNVIVHIDERKLKRYSGNYSGFERQRAAQMILAQSALEKQTRQRAHLESFINRFKAQASKARQAQSRMKALSKMEELAPLRAAAEFSFEFREPANAPNPLLVMENVDAGYRIENEDYSITEKKIVSGINFSLQIGQRIGLLGVNGAGKSTLIKTIAAELQPLSGVSEFGKGLAIGYFAQHQVEMLRHEESPLWHLAHIAPNVREQELRNFLGSFNFNGAMVTSKIAPFSGGEKARLALALIVWQRPNLLLLDEPTNHLDLETREALTMALAQFEGTLVVVSHDRHLLRATTDEFIIVADGKLQPFDGDLDDYKDWLFKTKLATKNAAAGNAALPAVKEKSASVVAPAAPAAASIDKREQKKQEAEDRQKLAARKKPIELKIKKLEEQIAKRNAQKAVVETALADPLIYDAAKKKELKQLLADQTFYTKEVAQLEAEWLEQQEALEQVNN

SEQ ID NO: 27509 - protein, 380 aa, Clostridium perfringens SM101
MNCNKTIYTPGPTNLRDNVRRARALKTTNPDVDVDFVEFYKETCDRFGEIINTKNDCYILSGEGILGLEAACASLTEKGDKVLVIDNGLYGRWFDGFVTMYGGEVTYFSGDYTKEIDVEALSKFLEKNNDFKYATVVHCDTPTGVLNPVDKICPLLKSYGILTVVDSVSAMVGEEFKVDKWQIDIALGGSQKAFSAEPGLTMVSISEDARKAMENREIPIVGFYCNLNIWKNYYKDKWFPYTMPTSDIISLRVAIDNILEEGKEKVIERHRKIGEATRKAVKEYGLELFLKNGYSNTVTAVEIPEEIGALNLRNHLNKKYNVLMSTSLDRYENKLLRIGHMGENANIEDITYVLNAIDKALKDLGFSSEKHLDKLFIENI

SEQ ID NO: 27510 - protein, 360 aa, Oryza sativa Japonica Group
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGEPEIRRYIEPAWGRSSMEVGQSATRFVGGCLRAGIRRIGGKEFGVTDFVNPSQLGDKSVSEVINAMTDGGADYSFECIGISSVMTEAGRGKTIILGVEKDSQPLCLPSFEFLFGKCVMGSLFGGAKPKTDIPILAEKCMNKELELEKLVTHEVGLTEINTAFDLLLQGKSLRCIIWMDK

SEQ ID NO: 27511 - protein, 482 aa, Tetracoccus dioicus
EKKNRGRIVQIIGPVLDVVFPRGKMPNIYNALVVKGRDTTGQQINVTCEVQQLLGNNRVRTVAMSATDGLMRGMEVIDTGAPLSVPVGGATLGRIFNVLGEPVDELGPVDTRTTSPIHRSAPAFIELDTKLEIFETGIKVVDLLAPYRRGGKIGLFGGAGVGKTVLIMELINNIAKNHGGVSVFGGVGERTREGNDLYKEMKESGVINEENIAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRKLAAKGIYPAVDPLDSTSTMLQPNIVGSDHYETARKVKQTLQRYKELQDIIAILGLDELSEEDRLTVARARKIERFLSQPFFVAEVFTSSPGKYVGLAETIRGFKLILSGELDSLPEQAFYLVGNIDEATAKATNLEMENDLK

SEQ ID NO: 27512 - protein, 238 aa, Zea mays
  misc_feature (205)..(205): Xaa can be any naturally occurring amino acid
  misc_feature (208)..(208): Xaa can be any naturally occurring amino acid
GRGNITSYLHLPPPLLSQVPTTPNPVSPLRRRLRFGSARLEQKKMQRAVQAVRSHGNVLKYAVLQHISAPKPAMLPAAFSRFMSVSSARLEDRGFETATVADVLKSKGKSADGSWLWCTTEDSVYDAVKSMTQHNVGALVVVKPGQNKSIAGIVTERDYLRKIIVQGRSSKSTKVGDIMTEEVLQAMQLMTENRVRHIPVIDGTXMLXMVSIGDVLRAVVAEHREELNRLHDYIQGSY

SEQ ID NO: 27513 - protein, 153 aa, Zea mays
MAMNYNAKDEVDGGPPCPPGGTAKTRRPDNTAFKQQRLPAWQPILTAGTVLPTFFIIGLIFIPIGIGIFVTSNNIREIEGNVFMYYGLSNFYQNHRRYVKSRDDGQLNGDPSALLNPSKECEPYRRNEDKPIAPCGAIANSMFNDTLELFQVG

SEQ ID NO: 27514 - protein, 458 aa, Pseudomonas putida KT2440
MSSGRIVQIIGAVIDVEFPRDVVPSVYNALKVQGAETTLEVQQQLGDGVVRTIAMGSTEGLKRGLDVVDTGAAISVPVGKATLGRIMDVLGNPIDEAGPIGEEERRGIHQPAPSFADQAGGNDLLETGIKVIDLVCPFAKGGKVGLFGGAGVGKTVNMMELIRNIAMEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGVLQERITSTKEGSITSVQAVYVPADDLTDPSPATTFAHLDATVVLSRDIASLGIYPAVDPLDSTSRQLDPNVIGNEHYETARGVQYVLQRYKELKDIIAILGMDELSEADKQLVARARKIQRFLSQPFFVAEVFTGSPGKYVSLKDTIAGFSGILKGDYDHLPEQAFYMVGSIDEAIEKAKKL

SEQ ID NO: 27515 - protein, 359 aa, Mesembryanthemum crystallinum
MGAEAEIVCPKSVPNLDTVLSCSQLDIMTPDAVSDNSLASTMLQFVPNIRSGSFADIGPRKYMEDEHIRIDDLSVQLGSLFRCPKPSAFYGVFDGHGGSEAAAYVRENVMRFFFEDVSFPEASELDEIFLEGVENCLRRAFFLADLALADDCSISTSSGTTALTALVLGRLLLVANAGDCRAVLCRKGEAIDMSQDHRPTYPSEKRRVEELGGYVDDGYLNGVLSVSRALGDWDMKLPKGSASPLISEPELRQIILTEDDEFLIIGCDGIWDVISSQQAVSIVRWGLKRHDDPEQSAKDLVNEALRRHTIDNLTVIIVCFSSIDHQREQTGPRPRRFRCSLSAEALSSLRSLLEGNESH

SEQ ID NO: 27516 - protein, 612 aa, Candida albicans SC5314
  misc_feature (604)..(604): Xaa can be any naturally occurring amino acid
MRFIVSSFIFFISFLSSLITAETHTWYFKTSWVDANPDGVFPRKMIGFNDSWPLPTLRAKKGDRIQLYLINGFEDLNTTLHFHGLFQHGTNQMDGPEMVTQCPIPPGETYLYNFTIDDQVGTYWYHSHTSGQYGDGMRGVFIIEDDDFPYDYDEEVVLTLSEHYHDYSKDLMPGFLSRFNPTGAEPIPSNILFNETRNNTWKVEPGKTYFVRIINIGRFVTQYLWMEDHEFTVVEVDGVYVEKNTTDMLYITIAQRYGVLITTKNSTDKNYAFMNRVDDTMLDTIPKDLQLNGTNYIVYNESAPLPDAYDVDSIDDYLDDFYLKPLNKEKLLDDADYTITVDVQMDNLGNGVNYAFFNNITYMTPKVPTLLSVLSAGDASTNELVYGSNTNSFVLQGGDVVDIVLNNLDTGRHPFHLHGHVFQLIERHKEIPDTEDPVSYNVSDHAEWPEYPMSRDTVYVKPQSYIVMRFKADNPGVWFFHCHIEWHLDQGLAIVLIEDPEAIQKNSSQHLTDNHKQICEKVGVSWEGNAAANSNNYLDLKGENIQVKRLPTGFTARGIVALVFSCIAEFLGIAAIAYYGMNDIEDLEEKSGKRFGCGIWMKKXRRKKKQKL

SEQ ID NO: 27517 - protein, 141 aa, Ehrlichia canis str. Jake
MLERTLSILKPDVVKRNITGQVNSYIENSGLKIVTQKMCLLTRFQAEEFYAIHKSQHFFIPLVDFMVSGPIIVQVLEGENAISLYRELMGATDPKKANPGTIRGDFAENIDANCVHGSDSLDNAVREIRFFFSDYELLSLK

SEQ ID NO: 27518 - protein, 624 aa, Candida albicans SC5314
MRTFLSSFIILTTFLASLIAAETHTWYFKTGWVDANPDGVYPRKMIGFNDSWPLPTLRVKKGDRVQLYLINGFDNLNTTLHFHGLFVRGANQMDGPEMVTQCPIPPGETYLYNFTVTDQVGTYWYHSHTGGQYGDGMRGVFIIEDDDFPYHYDEEVVLTLSDHYHKYSGDIMPAFLTRFNPTGAEPIPQNFLFNETRNATWKVEPGKTYFVRILNIGGFVSQYLWMEDHEFTIVEIDGVYVEKNTTDLIYITVAQRYGVLITTKNSTDKNYAFMNGVDTTMLDSVPADLQVNGTNYIVYNESSALPDAYDIDSYDDALDDFYLKPLSKQKLMDDADYTITVDVQMNVLNDGINYAFFNNISYKAPKVPTLLTVLSAGEAATNELIYGTNTNSFVLQGGDIVDIVLNNFDTGKHPFHLHGHVFQLIERHEAIGSKESAVTFNVSDHAEWPEYPMIRDTVYVKPHSYMVLRFKADNPGVWFFHCHVDWHLEQGLAIVLIEDPQAIQKNEKITENHKRICEKVGVPWEGNAAANSNDYLDLKGENVQVKRLPTGFTTKGIVALVFSCVAAFLGLFTISFYGMNDIAHVEDKVARDLDIDLEAENEDEEEAVVLNQNSSSSDSNSKPH

SEQ ID NO: 27519 - protein, 149 aa, Methanosarcina acetivorans
MEQTYVMVKPDGVQRGLVGEVISRIEKRGLKILALRMNVIAEATAKEHYGEHAARPFFPSLIEFITSGPSVSMVVAGKDAIKVMRAINGATNPVDAAPGTIRGDFALDVGRNVVHASDSPEAAAREIAIHFKDSEIGKYSRVDEVCLYE

SEQ ID NO: 27520 - protein, 133 aa, Methanococcus maripaludis
MERTFVALKPDTVERKLVGRVIQRFEDRGFEIVEMRMLTLTMEMAEEYYGEHKGKEFYERLIKFMTSGRIVAMVIKGERAISTVRKMLGNTCPCDAEPGTIRGDFGLYTPANIIHASDSLESAEREIDLFFGR

SEQ ID NO: 27521 - protein, 339 aa, Campylobacter jejuni subsp. jejuni NCTC 11168
MKFVSVEQAIKDLQAGKMLVMVDAEDRENEGDLIFPAQFSTQEKVNFMIKEARGVVCVALDETLAKKFELPLMVPKNTSNHETAFTITVDAKDATTGVSAYERNMTIQIFADDNAKASDFVRPGHINPLIAKKGGVLERTGHTEGTVDLCKLAGLKGACVICEIVKDNGDMARREDLEIFCQKHDLNMIAVSDLIEYRLKHESLIKLEEKSQSVLAGFKAEKFIFSDHNQTQHIAFCFKDIKKCENVKFHISGSDFELLTSDKFSKLLEQIKFLSENGGVIVFMQGEKSSTTQYKNYGIGAQILRYFGIEEIKLLSQSCDKDYIGLEGFGLNLKACNFN

SEQ ID NO: 27522 - protein, 150 aa, Methanothermobacter thermautotrophicus str. Delta H
MEKSFVMLKPDAVKRRLAGRIIARFEDRGLKIVAFKMLQIPEDLAMEHYQEHREKPFFRDLVDYITSAPVIAMVIEGKDCISLIRKMVGATNPAEADLGTIRGDFALETGRNIIHASDSPESAEREIKLFFDESEICSYEMPDREMIYEE

SEQ ID NO: 27523 - protein, 138 aa, Picrophilus torridus
MERCLILVKPDGVERNLIGEVISRFERKGLAIKALKMMRVTREQAEDHYSVHRLKPFFDDLVSYLTSGPIVAMIVEGNNAIASSRMLAGATDGSKAAPGTIRGDFSLDIERNIVHASDSLESYEHEYKIFFNENEIMD

SEQ ID NO: 27524 - protein, 137 aa, Streptococcus thermophilus CNRZ1066
MQKTFFIIKPDAVKRHLIGQVLDRIERRGFVIERMEMLMLDEERLKEHYAQLADKPFFPSISEFMMSGPAVIGIMSGPGVIKSWRDMMGATNPGDAAPGTIRGDFATAPDGDMIPNIVHGSDSEESAAREIKIWFGE

SEQ ID NO: 27525 - protein, 154 aa, Campylobacter jejuni subsp. jejuni NCTC 11168
MRRVLSVIVLNEHGVLSRIVGLFSGRGYNIDSLTVAPLENKEFSRINIVTSGNERTFEQIVKQLHKLIPTYKVIESEEFIDKEMALVKIPLNENLGGLDAVLKAYNGTIANSNENFLFLMVADDANRIDNFLKTIKKYNPSDIVRSGSVLMEIK

SEQ ID NO: 27526 - protein, 489 aa, Desulfitobacterium hafniense DCB-2
MNTIHTPKTKRVLTYNREYFYVTSVTLIGTEDGKLKQRRLGGKLNMTYVQEVLEQAVKRNPGEAEFHQALREVLESLEPVLEKRPDLKEAGILERIVEPERQILFRVPWVDDQGKVQVNRGFRVEYNSAIGPYKGGLRFHPSVYLGIIKFLGFEQIFKNSLTGLPIGGGKGGSDFDPKGKSEGEIMRFCQSFITELYRYLGADTDVPAGDIGVGGREVGYMFGQYKRITNRYEGVLTGKGLTFGGSLGRTEATGYGLVYFMEEALKAVGKSFSGATVVVSGSGNVAIYATQKATQLGGTVVAMSDSNGYIYDKDGINLDTVRQLKEVERKRLKDYVSIHPTAEYYEGCAGIWTIPCAIALPCATQNELDGEAAEVLVKNGCYAVGEGANMPSTPEAVDVFLQHKIIYGPGKAANAGGVAVSALEMSQNSMRYSWTFEEVDAKLKNIMVNIYHNASKAAQEFGFEGNLVAGANIAGFLKVAEAMKAQGTV

SEQ ID NO: 27527 - protein, 537 aa, Glycine max
MAALNLCRMALRSSKLLSRPYHRLSVQLQMQMQPSSPPLTRKMSMDAQSVASQLNSSGLLRTQGLIGGKWSDAYDGKTIKVYNPATGESIVDVACMGGRETNDAISAAYDAYGSWSKTTAAERSKLLRKWYDLLMVHKEELAQLITLEQGKPLKESVGEIVYGAGFIEFAAEEAKRIYGDIVPAPFSDRRLFVLKQPVGVVGAITPWNFPLAMITRKVGPALACGCTVVIKPSELTPLTALAAVELSIQAGIPPGVVNVVMGNAPDIGDALLASPQVRKITFTGSTAVGKKLMAGSAETVKKVSLELGGNAPCIVFDDADLDVAVKGTLAAKFRNSGQTCVCANRIIVQEGIYEKFANALRDAVQNMKVGDGFSEGVSQGPLINEAAVKKVESLIHDATSKGAKVILGGKRHSLGLTFYEPTVISDVNSDMHISREEAFGPVAPLLRFKTEEEAIRIANDTNAGLGSYVFTNSIQRSWRVAEALEYGLVGVNEGVISTEVAPFGGFKQSGLGREGSKYGMDEYLEIKYVCFGNMNKE

SEQ ID NO: 27528 - protein, 305 aa, Kluyveromyces lactis NRRL Y-1140
MSTDKKQSNFAIDFLMGGVSAAVSKTAAAPIERVKLLIQNQDEMIKQGSLDRRYTGIVECFKRTAADEGVASFWRGNTANVIRYFPTQALNFAFKDKIKAMFGFKKEEGYAKWFAGNLASGGLAGGLSLLFVYSLDYARTRLAADSKSAKKGGERQFNGLVDVYKKTLASDGVAGLYRGFLPSVVGIVVYRGLYFGLYDSLKPLLLTGSLENSFLASFLLGWAVTTGASTASYPLDTVRRRMMMTSGQAVKYDGAFDAFRKIVAAEGIKSLFKGCGANILRGVAGAGVISMYDQLQVILFGKTFK

SEQ ID NO: 27529 - protein, 291 aa, Herminiimonas arsenicoxydans
MNKIRKAVFPVAGLGSRFLPATKAQPKEMLPIVDKPLIQYAVEEAVAAGITEMIFITGRNKRAIEDHFDTAYELERELEAAGKTALLEFVQNVIPKHVNCIYIRQSAPLGLGHAVLCARPVVGNEPFAVLLADDFMDTPAGTAPVLAQMVEIFEREGSSILAVQDVPRAETRQYGIVSATPYQDRLEQVDAIVEKPQPEDAPSTLAVVGRYILSGRIFDYLENVSQGAGGEIQLTDGIAALMRDQKVLAYRYEGQRYDCGSKLGYLKAMVDMGRKHPETGAAFTEYLKTLK

SEQ ID NO: 27530 - protein, 172 aa, Zea luxurians
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEVAFKDRSNGRAFFSGGDAAPGLLDLALGCFLPALRACERLHGLSLIDASATPPLDGWSQRFAAHPAAKRVLPD

SEQ ID NO: 27531 - protein, 360 aa, Hypocrea virens
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVAARWYRAPEIMLTFKEYTKAIDVWSVGCILAEMLSGKPLFPGKDLTFPDHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 27532 - protein, 233 aa, Arabidopsis thaliana
MTLESYAGDVHTVPQSENSMEERGGGELFVPPLNFAMVDNGIFRSGFPEPVSFSFLQSLRLKSIIYLCPEAYPEVNREFAKSNGIQVFQFGIERCKVRLVEPFVNIPDEVIREALQHRTGCLVGCVRKIQRWCLSSIFDEYQRFAAAKARISDQRFMELFDISNLKHTPLSFSCSKRGVNNDSVCCVCMGRKKGAAFIPCGHTFCRVCSREVWLNRGSCPLCNRPIIEILDIY

SEQ ID NO: 27533 - protein, 277 aa, Herminiimonas arsenicoxydans
MSNISIKTAEDIEGMRIAGRLGSEVLDYITPFVKAGVTTGELDRLCHEYMINVQGTIPAPLNYCPPGYTPYPKAICTSVNDVICHGIPGDKVLKNGDSVNLDITVIKNGYHGDTSRMFLIGEPSILAKRLSEITYECMWLGISKIKPGAHLGDIGHIIQQHAENAGYSVVREFCGHGIGKVFHEEPQVLHYGRPGTLEKLAAGMIFTVEPMINAGRREVREMNDGWTIKTKDRSLSAQWEHTVLVTETGYEILTQSAGTPPPPAFIVPQTAVQAANA

SEQ ID NO: 27534 - protein, 181 aa, Oryza sativa Indica Group
HINPAVTFGLFLARKVSLVRAILYIVAQCLGAICGVGLVKAFQSAYFNRYGGGANTLAAGYSKGTGLAAEIIGTFVLVYTVFSATDPKRNARDSHVPVLAPLPIGFAWFMVQLATIPITGTGINPARTTGPAVIFNNEKAWHNQWIFWVGPFVGAAIAAFYHQYILRAGPIKALGSFRSNA

SEQ ID NO: 27535 - protein, 368 aa, Spinacia oleracea
MATVSSCLLRRSRTASRIFKTSLRCFSTTSSSAQTVSGSSPFPFTGTNIKTNVSQLIGRTPLVYLSKISEGSGAYIAVKQEMMQPTASVKDRPALAMIEDAEKKGLISPGKTVLIEPTSGNMGISMAFMAAMKGYKMVLTMPSYTSMERRVVMRAFGADLILTDPDKGMGGTVKKANQLLDSTPDGFMLQQFNNPANTQVHFETTGPEIWEDTQGKVDIFVMGIGSGGTVSGVGRYLKSQNPNVKIYGVEPAESNILNGGKPGPHLITGNGVGFKPEILDMDVMDAVLEVKSDDAVKMARQLALQEGLLVGISSGANTIAALDLAKRPENKGKLIVTIHPSFGERYLSSALFKELREEAENMQPVPVE

SEQ ID NO: 27536 - protein, 147 aa, Sulfolobus tokodaii
MSIQRTFVMIKPDGVRRNLIGEIISRFEKRGLKIIGLKMVKIDRPTAERLYEEHKGKSFFEELISYITSGPVVCMVIEGDEAVSVVRKMIGNTDPKEAPPGTIRGDYALSKAENVIHASDSEEKAKREMSIFFKEEELVTPLAQVHM

SEQ ID NO: 27537 - protein, 80 aa, Zea mays
MATAPRRLLPALLKALAPAGARGLSTEKAVGAAAVAVVGSHTAKWMQDTSKKSPMELINEVPPIKVDGRIAVCEGGRHQS

SEQ ID NO: 27538 - protein, 149 aa, Synechococcus elongatus PCC 6301
MERTFIAIKPDGVQRGLVGTIIGRFEQKGFKLVGLKQLKPSRELAEQHYAVHRERPFFNGLVEFITSGPIVAIVLEGEGVVAAARKLIGATNPLTAEPGTIRGDFGVNIGRNIIHGSDAIETAQQEIALWFSPAELSDWTPTIQPWLYE

SEQ ID NO: 27539 - protein, 265 aa, Burkholderia xenovorans LB400
MNRRADLNGIQTHYRLTGKAGAPTVILSHGLAADLSMWAPQLDMLSRSFSVLCYDIRGHGGTSATPGDYSLALLADDVIALMDSLGIASAHYVGLSLGGMIGQQLGAWHGERLASLTLCATTSNAPKASWDARVHEARARGIAPLVEATVDRWVTPAFKREQPELMEQMRRMVLGTSLDGYAGSAAAIRDMELAPVLGRIGVPTLVIAGEADTSTPLPILEHIADSIPAATLLTVPEAAHMPTMERPELCNPALERFLLAHSSDQ

SEQ ID NO: 27540 - protein, 167 aa, Neisseria meningitidis
MFEPLWNNKYIESVQLTIAEQLGVEERGEFYDITGALRDMVQNHLMQMLCMTAMEAPASLDADAVRDEKVKVIKSLKPLTVESVNENVVRGQYTAAKGMNGYLEEINVPQDSFTETYVAIKAEIENERWKGVPFYLRTGKRMAGKVAEIVLNFKDLNSHIFEGSRTA

SEQ ID NO: 27541 - protein, 400 aa, Campylobacter jejuni subsp. jejuni NCTC 11168
MLIVQKYGGTSVGTLERIEAVANRVIQSAQQGNQLVVVVSAMSGVTNTLIEQAEYFSKTPNGKDMDMLLSSGERVTSALLSIALNEKGCPAISFSGRKAGIITDSVFTKARIHHIDTKAIKSELQNGKIVVIAGFQGVDEEGNVTTLGRGGSDLSAVAVAGALNADLCEIYTDVDGVYTTDPRIEPKAKKLDKISYEEMLELASLGAKVLQNRSVELAKKLNVNLVTRSSFNNNEGTMITKEDGMEQALVSGIALDKNQARVTLRNIEDKPGIAAEIFSVLANENINVDMIIQNVGVDGATNLGFTVPQNELELAKNAMQKILSSKTTIESDSAVLKVSIVGVGMKSHSGVASKAFKALADEGINIGMISTSEIKISMIVHEKYGELAVRALHECYGLDK

SEQ ID NO: 27542 - protein, 167 aa, Neisseria meningitidis
MFEPLWNNKYIESVQLTIAEQLGVEERGEFYDITGALRDMVQNHLMQMLCMTAMEASASLDADAVRDEKVKVIKSLKPLTVESVNENVVRGQYTAAKGMNGYLEEINVPQDSFTETYVAIKAEIENERWKGVPFYLRTGKRMAGKVAEIVLNFKDLNSHIFEGSRTA

SEQ ID NO: 27543 - protein, 172 aa, Zea luxurians
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEVAFKDRSNGRAFFSGGDAAPGLLDLALGCFLPALRACERLHGLSLIDASATPLLDGWSQRFAAHPAAKRVLPD

SEQ ID NO: 27544 - protein, 167 aa, Neisseria meningitidis
MFEPLWNNKYIESVQLTIAEQLGVEERGEFYDITGALRDMVQNHLMQMLCMTAMEAPASLDADAVRDEKVKVIKSLKPLTVESVNENVVRGQYTAARGMNGYLEEINVPQDSFTETYVAIKAEIENERWKGVPFYLRTGKRMAGKVAEIVLNFKDLNSHIFEGSRTA

SEQ ID NO: 27545 - protein, 167 aa, Neisseria meningitidis
MFEPLWNNKYIESVQLTIAEQLGVEERGEFYDITGALRDMVQNHLMQMLCMTAMEAPASLDADAVRDEKVKVIKSLKPLTVESVNENVVRGQYTAAKGMNGYLEEINVLQDSFTETYVAIKAEIENERWKGVPFYLRTGKRMAGKVAEIVLNFKDLNSHIFEGSRTA

SEQ ID NO: 27546 - protein, 172 aa, Zea luxurians
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEEAFKDRSNGKAFFSGGDAAPGLLDLALGCFLPALRACERLHGLSLIDASATPLLDEWSQRFAAHPAAKRVLPD

SEQ ID NO: 27547 - protein, 112 aa, Zea mays
  misc_feature (78)..(78): Xaa can be any naturally occurring amino acid
ARRDSLETVPPLQKLRSYSDRIRASELEKCLQKIGDDVFPQKMRRALEEVSPGLVNKVLPGPLQHLRWDGSNNRPPDXTLENKHAFNRMFSLDPEKAVLEQKIKAKVEKTQK

SEQ ID NO: 27548 - protein, 172 aa, Zea luxurians
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEEAFKDRSNGRAFFSGGDAAPGLLDLALGCFLPALRACERLHGLSLIDASATPLLDGWSQRFAAHPAAKRVLPD

SEQ ID NO: 27549 - protein, 482 aa, Citrobacter freundii
MSDAPLIPVIMAGGTGSRLWPLSRELYPKQFLHLTEDNSLLQTTLLRLSSLSCKTPLVISNEQHRFIVAEQLRQINQLHDNIILEPCGRNTAPAIALAAFSALKRNEKKEPLLLVLAADHVINESSAFCEAVKNSIPLAEDGHVVTFGIIPEYAETGYGYIERGLPLEKNKSSGDSLFYHVNKFVEKPNRRLAEEYVSSGNHFWNSGMFLFKASTYLCELKKYRPDIYDACESAMSTSYHDLDFIRLSEESFKGCPAESIDFAVMEKTECCVVYPLNIGRSDVGSWQSLWNISEKTETGDVCKGDVLTYNTKNNYIYSDSTLVAAIGIEDVVVIQTKDAILVSKKSEVQNVKKIVDMLKHQNRTEHVTHREVFRPWGKFDAIDQGDRYKVKKIIVKPGEGLSLRMHHHRSEHWIVLSGTAKVTLNNEIKLITANESIYIPLGAVYSLENPGVIPLNLIEVSSGDYLGEDDMVRQKERYRNED

SEQ ID NO: 27550 - protein, 593 aa, Zea mays
MDEINLLRQAQRQHQHHLMVRGIGEEIDLEIGPVDDPSFSGASLVAVTSTHDTVVHADDHKSLLIPCSQPGAADGLAPQQHLSQGEEHDGMLRSPSGHTKKKKKVVKKWREEWADTYKWAYVAVHDTTTRIFCSVCKEYGRKHRRNPYGNEGSRNMQMSALEEHNNSLLHKEALRLQMASKEKLQPPEIEGPVYVKALSKTAASILECVLRRDPHEAEYIQSIQETLKNALSLYKLGGAAGGSDFDPKGKSDNEIMRFCQSFMDELYRYLGPDQDFSAEDIGVGPREMGYLFGQYRRLSGHFQGNFTGPKIFWSGSSFRTEATGYGLVFFARLLLAEMNKELKGLRCVISGSGKIAMHVLEKLLPCGAIPITVSDSKGYLLDEDGFDYMKYSLLRDIKAQQKSLKEYLKSYPHAKYIDDAKPWSQRCDVAFPCASHNEIDQGEAVAISNSGCRVLVECSNMSCTVQAVDILRKAKVIVAPAKATAAGGVALGEIELNPEFNLMQLSVEDFENRIQVNSAAPDHLAVIFRFCFPIVIPCEFSLFSVGFKQDAIKQTYESREADPSVSPCRFLVHGANICAFLNIAQAMTDQGCV

SEQ ID NO: 27551 - protein, 395 aa, Opitutaceae bacterium TAV2
MSSTDPKRWVAGHVASLPKSGIRDFFELVAKMKGQDVISLGVGEPDFVTPWHVREAAIYALERGKTYYTSNLGMIELRRAISTYVTEHFGIDYRPDDQVLVTVGVSEALDLAFRAFCNPGDKVMYHQPCYVSYHPSIALVHGQAIGVPTYAKDNFALTAEALRAAWQPGAKILMLNLPCNPTGGTCDRAQLEAIAAFAREKDLLVLSDEIYSELTFDGIHTSIASLPGMADRTIFLHGFSKAFAMTGWRIGYACGPAPLIDAMMKVHQYAMMCASIIAQEGALEALQRGWDNVCRMRDQYHRRRDLVVRRFNEIGLTCHSPRGSFYAFPHVSGTGLTEKEFAVGLLEKERVAVIPGTAFGQNGTGHVRACFATSYEQLIDACDRIERYVNGIKKT

SEQ ID NO: 27552 - protein, 207 aa, Arabidopsis thaliana
PRVREDVTSRDSPLSSRFFFFPLILSPSAFHFFANGHTSFIWPIFQNRCVYMIANLFHAPVGQDEAVIGCGIVASSESAGLAFKMKWQHRRKAQGLPIDKPNIVTGVNVQVCWEKFARYFEVELKEVKLSEDYYVMDPAKAVEMVDENSICVAAILGSTFTGEFEYVKLLNDLLAEKNAKTAWETPIHVDAASGGFIASMGEEYQCQ

SEQ ID NO: 27553 - protein, 368 aa, Citrobacter freundii
MSKQQIGVVGMAVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELATTFTEWNEGELSSYLIDITKDIFSKKDEEGKYLVDVILDEAANKGTGKWTSQSSLDLGEPLSLITESVFARYISSLKDQRVAASKVLSGPQAKRAGDKAEFVEKVRRALYLGKIVSYAQGFSQLRAASDEYNWDLNYGEIAKIFRAGCIIRA

SEQ ID NO: 27554 - protein, 458 aa, Oryza sativa Japonica Group
MASRDLAESLLPVGGGAATATATATAHDEYDERAYDSDDKVSIAVSDSDSEDGGGGGGDAMRPAFSWRKLWRFTGPGFLMCIAFLDPGNLEGDLQAGAAAGYQLLWLLLWATVMGALVQLLSARLGVATGKHLAELCREEYPPWATRALWAMTELALVGADIQEVIGSAIAIKILSAGTVPLWGGVVITAFDCFIFLFLENYGVRKLEAFFGVLIAVMAVSFAIMFGETKPSGKELLIGLVVPKLSSRTIKQAVGIVGCIIMPHNVFLHSALVQSRKIDTNKKSRVQEAVFYYNIESILALIVSFFINICVTTVFAKGFYGSEQADGIGLENAGQYLQQKYGTAFFPILYIWAIGLLASGQSSTITGTYAGQFVMGGFLNLRLKKWLRAMITRSFAIIPTMIVALFFDTEDPTMDILNEALNVLQSIQIPFALIPLITLVSKEQVMGSFVVGPITKVM

SEQ ID NO: 27555 - protein, 404 aa, Staphylococcus aureus
  misc_feature (1)..(1): Xaa can be any naturally occurring amino acid
  misc_feature (21)..(21): Xaa can be any naturally occurring amino acid
  misc_feature (38)..(38): Xaa can be any naturally occurring amino acid
  misc_feature (52)..(52): Xaa can be any naturally occurring amino acid
  misc_feature (257)..(257): Xaa can be any naturally occurring amino acid
  misc_feature (271)..(271): Xaa can be any naturally occurring amino acid
  misc_feature (286)..(286): Xaa can be any naturally occurring amino acid
  misc_feature (322)..(322): Xaa can be any naturally occurring amino acid
XGSSHHHHHHSSGLVPRGSHXISNKLANIPDSYFGKTXGRKIEHGPLPLINXAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSKVDSQIIDKTKLIYLTYPNNPTGSTATKEVFDEAIAKFKGTDTKIVHDFAYGAFGFDAKNPSILASENGKDVAIEIYSLSKGYNXSGFRVGFAVGNKDXIQALKKYQTHTNAGXFGALQDAAIYALNHYDDFLEEQSNVFKTRRDRFEAXLAKADLPFVHAKGGIYVWLETPPGYDSEQFEQFLVQEKSILVAPGKPFGENGNRYVRISLALDDQKLDEAAIRLTELAYLYE

SEQ ID NO: 27556 - protein, 428 aa, Oryza sativa Japonica Group
MAGDHSSPFPPPSSTRRRRPQERDEERGEGERGSRRGGGRHLHGYTTTPTEEEQEREKSPMAHARSTGSLPVANVQALAETCNDPDQQIPERYIRADANADEVISGDDCTAAIPTVDLSKLLDPLSSDEETEKLGSACQQWGFFQLINHGVSEDVIRDARKDIAEFFRLPMETKKAYSQLPSGIEGYGQAFVVSHEQKLDWADMFYLVLRPGESRNMALWPAHPPSFRNSIDRYSSETARVARCLLEFMAKDMGVRPGSLLERFQDQPQGIRMNDYPPCREAGKVVGLSPHTDAACLTLLLQVNDVPGLQIRSPGGRWLAVGAPPDDGAFIVNVGDILEIMSNGKYRSVEHRAVVRPDRERVSAAVFHQPCQDAVVGPLPELVGEGGGDNARYTSMGYLDFMKRYYSAKLDGRNHLDGLRIKLSSSKG

SEQ ID NO: 27557 - protein, 128 aa, Brassica napus
GDLFLVRGGMRSVEFKVIETDPAEYCVVAPDTEIFCEGEPIKREDEERLDEVGYDDVGGVRKQMAQIRELVELPLRHPQLFKSIGVKPPKGILLYGPPGSGKTLIARAVANETGAFFFCINGPEIMSK

SEQ ID NO: 27558 - protein, 281 aa, Zea mays
MAAAERDRERWILPGATALVTGGSKGIGHAIVEELAALGARVHTCSRNAAELEECRRRWAEKGGGRLLQQVTVSVCDVAVRADREALMATVRDVFGVKLDILVNNAAQVVFKPAVECTGEEYARIMATNLESCFHLSQLAHPLLRNASLAGGGSVVHISSTAGLLGFPGAVLYSTAKGFICTHFFVPLLAGGVNQLTRSLAAEWACDKIRVNSVAPGIVMTDMVKNAASSEAVEQETSRIPLRRAGEPAEVASVVSFLCMPAAAYVTGQVIYVDGGRTIRA

SEQ ID NO: 27559 - protein, 424 aa, Thermus thermophilus
MKSEPLSYLGKDGGPWEIFTEQVDRVVPYLGRLAPLAESLKRPKRVLIVDVPVRLDDGSVAYFEGYRVHHNTARGPAKGGVRYHPEVTLSEVMALAGWMTIKNAAVGLPYGGGKGGIRVDPRKLSPGELERLTRRYTSEIGILLGPDRDIPAPDVNTGEREMAWMMDTYSMNVGRTVPGVVTGKPIALGGSLGRRDATGRGVFITAAAAAEKIGLQVEGARVAIQGFGNVGNAAARAFHDHGARVVAVQDHTGTVYNEAGIDPYDLLRHVQEFGGVRGYPKAEPLPAADFWGLPVEFLVPAALEKQITEQNAWRIRARIVAEGANGPTTPAADDILLEKGVLVVPDVIANAGGVTVSYFEWVQDFNSYFWTEEEINARLERVVRNAFEAVWQVAQEKKIPLRTAAYVVAATRVLEARAPPGLYP

SEQ ID NO: 27560 - protein, 127 aa, Brassica napus
MEDEEGIGLILARATELRLKITDCIESSSTAVSDDGHGGGGNELSFPGEGKKDETIANQDKDFDSISSGDVEEEEEEADEQLLRIRDALESLESQLASLQNLRQRQQYEKQVALSEIDYSRKVLLEK

SEQ ID NO: 27561 - protein, 285 aa, Acidobacteria bacterium Ellin345
MFAKDLLQGKRALITGGGTGLGKAMARRFLELGATVYICGRREEVLRGTCEELTSATGGEIHGIPCDVRDLAAVDTMITQIWNDGPLDILVNNAAGNFLAKTEELSPRAWEAVIGIVLNGTINLTMACGRRWLAEKKPANVLSIVATYASTGSGSGYVVPSAVAKAGVLALMRSLAVEWGPRGIRLNAIAPGPVPTEGAFSRLIPSDQLEEIAKQRVPMRRFGRPEEIADLAAFLVSDGAGYINGEVVTIDGGEWLQGAGEFNYVGQMMTDEMWAMFKPGKKRRE

SEQ ID NO: 27562 - protein, 477 aa, Oceanicola granulosus HTCC2516
MAEQKMLKFVTVQRDMPDKRPPDLRRADFNEIYADFAREKAAEQSGRCSQCGVPYCQSHCPLHNNIPDWLRLTAEGRLREAYEISQSTNTFPEICGRICPQDRLCEGNCVIEQSGHGTVTIGAVEKYINDTAWEEGWIAPIRPAQERSESVGIIGAGPGGLAAADALRRAGLQVTVYDRYDRGGGLMTYGIPGFKLEKEVVMRRMAQLEDGGVEFVMNCNVGEDISFDAIRGKHDAVLIATGVYKSRDLQGPGSGAAGIVRAIDYLTASNRVGFGDEVPEYASGELNAEGKKVVVIGGGDTAMDCVRTAIRQGAESVKCLYRRDRANMPGSQRETANAEEEGVEFVWLSAPKGFTGDAVEGVMVQKMRLGAPDVSGRQMPELIEGSDYVEDADLVIKALGFEPEDLPRLWGVEGLEVTRWGTVKAEYGTGQTSLPGVYAAGDIVRGASLVVWAIRDGREAAEAILDYVSGSASVAAE

SEQ ID NO: 27563 - protein, 262 aa, Aeropyrum pernix K1
MIGYIIVTGTAGAGKSSLVGALADRITSLGANVATLNLDPAAEKLPYDPSVDARDYVSVAELMDKGLGPNGALVAAVDSLINHVLDIREEIDYYSPDYVVVDTPGQLELFAYRVGGPLVLRGIMGDYNGVNIFLIDSIFIDNAISLVSALLLASSVAVRLGLPQVNAVSKADMLLPEVREEVIPRLGEPGFLEFLLEKDKTYEGAGKALAEELARAIETTGFIGEVLQASVLEPETVTLLAAKAQQILAGGDDYKIYDITGQ

SEQ ID NO: 27564 - protein, 386 aa, Bordetella bronchiseptica
MSVAVLAFGLNHTSAPVSVRERVSMPVDLVKPALEGLRATFGGAVREAAILSTCNRTELYCAAEGQVAEHLPAWLAEHNRLEAAALRPHLYRHQHDDAVRHAFRVASGLDSMVLGEPQILGQMKDAVRAANEAGALGTLLHQLFQRTFSVAKEVRSQTAIGAHSVSMAAAAVRLAERVFGQLEDARTLFIGAGEMIELCATHFAAQRPRSMVVANRTIERAETLAGRFSAQTMKLADLTERLAEFDVIVSCTASSLPILGLGMVERATRQRRHRPMVMIDLAVPRDIEPEVGRLDDVYLYSVDDLGRLVQSGTDARRAAVVQAEAIIETRVQGFMHWMQSREVVPVIRDLHQAADERCGPPSSSARAACWRAASRPRPCWNSWRTG

SEQ ID NO: 27565 - protein, 283 aa, Salmonella enterica subsp. enterica serovar Urbana
MHMLPATKAIPKEMLPIVDKPMIQYIVDEIVAAGIKEIVLVTHASKNAVENHFDTSYELESLLEQRVKRQLLAEVQSICPPGVTIMNVRQAQPLGLGHSILCARPVVGDNPFIVVLPDIIIDDATADPLRYNLAAMVARFNETGRSQVLAKRMKGDLSEYSVIQTKEPLDNEGKVSRIVEFIEKPDQPQTLDSDLMAVGRYVLSADIWAELERTEPGAWGRIQLTDAIAELAKKQSVDAMLMTGDSYDCGKKMGYMQAFVKYGLRNLKEGAKFRKSIEQLLHE

SEQ ID NO: 27566 - protein, 468 aa, Oryza sativa
  misc_feature (183)..(183): Xaa can be any naturally occurring amino acid
MSHVRSAPAGKSGGGGGSTPAKRGRPFGSTTGSGAAAAAAAAAIGDAAAPAALVGPSLQVLTALSDQNNKRIVLALQSGLKSEILWALNALTVLSFKEKDDLRRDTTPLAKVPGLLDALLQVIDDWRDIAMPKDHTKPPRVRTLGVNTTLSGFGHENVEKVYSDTTTPSAVFVWSSEGVVVSXVDSTVTKKRSAGFLFDEEGLFNVDDEGRTEKQQCAVAASNIIRNFSFMPENETVMVQHRHCLETVFQCLEDQNTEDDELITNMLETLVNLAPVLDLRIFSSSKPSFIKITEKRAVQAIMGMLASSIRVWHCAAAELIGRLIINPDNEPFLLPAIPQIYKRLVDLLSVPAVDAQAAAISALYNVAEVNMDFRLKLASERWAVDRLLKVVKTPHPVPEVCRKASMIVESLVSEPQNRMHLLVHENTFAEILTSEGKYSDTFARILYELTARPSNKVTAGQAIWGNIN

SEQ ID NO: 27567 - protein, 418 aa, Artemisia annua
MSSLKAVLKHPDDFYPLLKLKMAAKKAEKQIPSQPHWAFSYSMLHKVSRSFALVIQQLNPQLRDAVCIFYLVLRALDTVEDDTSIAADIKVPILIAFHKHIYNRDWHFACGTKEYKVLMDQFHHVSTAFLELKRGYQEAIGDITMRMSAGMAKFICKEVETVDDYDEFCHYVAGLVGIGLSKLFHSSGTEILFSDSISNSMGLFLQKTNIIRDYLEDINEIPKSRMFWPREIRSKYVNKLEDLKYEEDSEKAVQCLNDMVTNALIHIEDCLKYMSQLKDPAIFRFCAIPQIMAIGTLALCYNNIEVFRGVVKLRRGLTAKVIDRTKTMADVYQAFSDFSDMLKSKVDMHDPNAQTTITRLEAAQKICKDSGTLSNRKSYIVKRESSYSAALLALLFTILAILYAYLSANRPNKIKFTL

SEQ ID NO: 27568 - protein, 172 aa, Zea mays subsp. mexicana
AANPVYGKIPVLLLPDGRAICESAVIIQYIEDVARGSGGAEASSLLLPDDPYERAMHRFWTAFIDDKFWPALDAVSLAPTPGARAQAVEDTRAALSLLEVAFKDRSNGRAFFSGGDAAPGLLDLALGCFLPALRACERLHGLSLIDASATPLLDGWSQRFAAHPAAKRVLPD

SEQ ID NO: 27569 - protein, 347 aa, Zea mays
  misc_feature (294)..(294): Xaa can be any naturally occurring amino acid
  misc_feature (299)..(299): Xaa can be any naturally occurring amino acid
  misc_feature (304)..(304): Xaa can be any naturally occurring amino acid
  misc_feature (309)..(311): Xaa can be any naturally occurring amino acid
  misc_feature (313)..(313): Xaa can be any naturally occurring amino acid
  misc_feature (316)..(317): Xaa can be any naturally occurring amino acid
MLSRLAAARRQLLLSPAVAYRSSSAAATASAVHERAAPASASVLPDTLERGSDAYQRNTAAVGGLLSDLRARVSQVLRGGGAEAVRRNAARGKLLPRDRIDRLLDPGASFLELSQLAGSDVYDEALPSAGIITGIGPVHGRLCMFVANDPTTKGGTYYPLTVKKHLRAQEIASECKLPCIYLVDSGGANLPRQADVFPDRDNFGRIFYNQAKMSSDGIPQIAVVLGSCTAGGAYIPAMADESVIVKGNGTIFLAGPPLVKAATGEEISAEDLGGASVHCKVSGVSDHFAQDEIXGLELXRNIVXNLHLXXXGXNIXXFFRPHVHMHAPPLPISPLSTPLFYPSPHFL

SEQ ID NO: 27570 - protein, 250 aa, Physcomitrella patens subsp. patens
MKIAFGEADEASSPDAIKGAVAEFISLFLFVFIGVGSVMAYEKIHVGDLDAAGLLMIAIAHGLAIAVLVAATANISGGHVNPAVSLGLALAGKITIIRLVLYWVAQLLGAVAGAWVLKAVTTGEDVARHAIGANMTGFSAMLMEIVLTFTLMFVVFATAVDPNKGTVGVIAPLAIGFTVLAQIFVGAPFSGASMNPGRSFGPAVVAWDFKNHWVYWVGPLVGAALAALIYDGVFISPAPPAGHQPVPTEF

SEQ ID NO: 27571 - protein, 377 aa, Ralstonia eutropha JMP134
MSTPASRSAPPRRAHMESITYANLRTSLVANPCTWLVTGVAGFIGSNLLEALLRLNQRVVGLDNFLTGHRRNLHEVQALVSPAQWENFQFIEGDIRDLEQCRSAMRFCSGEREGTHGASSHPVDFVLHQAALGSVPRSLEDPIATHSVNISGFLNMLVAARDAEVRAFVYAASSSTYGDHPGLPKTEDRIGKPLSPYAVTKYANELYADVFRRCYSLRAIGLRYFNVFGPRQDPNGAYAAVIPRWISALLRRETVYINGDGETSRDFCYVANAVQANLLAALSCSGDAESQIYNVAVGDRTTLSTLFQLLRDGLRPYGIPADTQPTYRAFRAGDVRHSQADIGKAQRLLGYQPTHRIGDGLAEAMHWYVQLHRTQDA

SEQ ID NO: 27572 - protein, 319 aa, Pseudomonas sp.
MPRREMMKCLFVSESCVCHTDLAIKDGVLPFPLPAVLGHEGSGIVEAVGPGVKHLKPGDAVVMTFASCGHCASCEHERPSYCLDFGAQNYSAQRADGPVLLSQGDEVISGFFFGQSSFSSMAMAREHNLVKIDALVDDAPIELLGPLGCGVQTGAGAVMISLDVRAGRSFLVLGGGAVGLSAVMAAKLRGCSRIIVSEPSAAKREQALALGATEVIDPLNENLVERVQQITEGQGCDYALECTGLVSVMEQAIDSMAMRGQLAVVGVPPKLDATAAVSPLALIQKGLKLMGVIEGDSCRVYSSTSCTRSSRLGVFRSPR

SEQ ID NO: 27573 - protein, 425 aa, Ralstonia eutropha JMP134
MDLSNAKIAIIGLGYVGLPLAVEFGKQRQVVGFDINAVRIDELRSGQDSTLEVSHDDLRGARSLKFSCDPADLKDCQVFIVTVPTPVDRAKRPDLTPLIRASETVGRVMGQDAVVIYESTVYPGATEEVCVPLLEQHSGLKFNVDFYCGYSPERINPGDKEHRLPDIRKVTSGSTPEVSVAIDELYRRIIVAGTHRASSIRVAEAAKVIENTQRDVNIALMNELSLLFHRLGIDTLEVLKAAGTKWNFLPFRPGLVGGHCIGVDPYYLTHKAQEVGYHPQVILAGRRINDRMAIHVADELVKLMLRRGISVLGSRILMLGLTFKENCPDVRNTKAVDIVTTLRGYNASIDVYDPWIDVEEAEAEYGLACLRELPRHDQYDAIVLAVPHHQFVTMGVRAIRAFGKSHAVLFDVKGILPRSDVDARL

SEQ ID NO: 27574 - protein, 350 aa, Zea mays
MVAVADAGSPARLNPLPNTDAEEEEVLTITPTKCSTIYLNRGIYSVRNPILHRQHLLRDCDGNHVDILPTSEFDEGPIFDEEPCFHRNLLDSDPDSPYDWVVPVIAVHSSGYTEMSHSEADKVPATAALPNLREKICCRFVDRTKLSRHVRLIHFSLPSPDQALGIPTGTHVFDCTSVDGKPCMRSYTPTSKEDEVLAPTPIRCLTNCFILTQSCFSPPVSCSWDAVMQRQPWPPPMQSNRVVSIPARPPEEASPVRKLVAEIIGVLGSKHMRTVTPLPDPGQWLLLSLIEKLPQSGVDLLRAHVINLHHFLMLFSLLGFSVLFDCIKAPDSNAICRGITQDMTYAAVQA

SEQ ID NO: 27575 - protein, 243 aa, Synechococcus sp. RS9917
MRKPVIAGNWKMHMTCAQARDWMTVFLPLIANTPEDRHLVVAPPFTAISTLAAMGQGSRLELSSQNVHWEGEGAFTGEISPTMLLEHGVRYAIVGHSEPRKYFSESDEQINHRGRSAQSHGLIPIVCVGESDEQRSRGEAERVIRRQVEQGLEGLDPAKLVVAYEPIWAIGTGKTCEASEANRICGLIRSWVGSPDLIIQYGGSVKPGNIDQLMAMSDIDGVLVGGASLDPESFGRIANYQKS

SEQ ID NO: 27576 - protein, 812 aa, Herminiimonas arsenicoxydans
MSNVVNTGIKHDQVVEGNYVISFEHLRMSDVDSVGGKNSSLGEMISQLAEAGVRVPGGFATTAQAFRDFLEHSEGGGLSLAQRIADRLADLDIDDVRALAQAGAEIRQWIVETPFPPRLLNEITQYYHNLSSDSSKEMSFAVRSSATAEDLPDASFAGQQETFLNVVGIDNVLEAIKHVFASLYNDRAISYRVHKGFTHAEVALSAGVQRMVRSDLGSAGVMFTMDTESGFTDVVFITSSYGLGETVVQGAVNPDEFYVHKPMLEQGRLPIIRRNIGSKLIKMEFTAEAKAGHSVQTVDVPIGMRNRYSLTDEEIVQLAKYAVIIEKHYGRPMDIEWGKDGLDGQLYILQARPETVKSQQKATDVQQRFKMKGSGTVLTVGRAIGQKIGAGPVRVILDAADMERVQPGDVLVADMTDPNWEPVMKRASAIITNRGGRTCHAAIIARELGVPAVVGCGDATELLKDGALVTVSCAEGDEGKVYDGLLESEVTEIARGDLPELPLKITLNVGNPQLAFDFQSIPNAGVGLARLEFIINNNIGVHPKAILEYPNIDPDLKKAVESVARGHASPKAFYIDKLAEGIATIGAAFWPKPVIVRLSDFKSNEYKKLIGGSRYEPDEENPMLGFRGVARYLAPDFAEAFEMECKAMKRVRDDMGLTNVEIMVPFVRTLGQAEKVIDLLAKNGLKRGENGLRIIMMCEVPSNAILAEEFLNYFDGFSIGSNDLTQLTLGLDRDSGMEILAADFDERDPAVLALFSRAIAACRKQGKYVGICGQGPSDHPDFAEWLMKEGITSLSLNPDSVIETWQSLAKRL

SEQ ID NO: 27577 - protein, 731 aa, Oryza sativa
  misc_feature (34)..(34): Xaa can be any naturally occurring amino acid
  misc_feature (686)..(686): Xaa can be any naturally occurring amino acid
MGVHAEGHHQAEEHPRGQARATVQLRGLHDALHXIYNMCTQKPPHDYSQQLYDKYRESFEEYITSMVLPSLRDKHDEFMLRELVKRWSNHKIMVRWLSRFFFYLDRYFISRRSLIPLEQVGLTCFRDLIYQEIKGQVKGAVIALIDKEREGEQIDRALLKNVLGIFVEIGLGSMECYENDFEDFLLKDTTDYYSLKAQSWILEDSCPDYMIKAEECLKKEKERVGHYLHISSEQKLLEKVQNELLAQYATPLLEKEHSGCFALLRDDKEEDLSRMYRLFSKINRGLEPIANMFKTHVTNEGTALVKQAEDSASNKKPEKKDMVGMQEQVFVWKIIELHDKYVAYVTECFQGHTLFHKALKEAFEVFCNKGVSGSSSAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAAHQELNPGIDLAVTVLTTGFWPSYKTFDINLPAEMVKCVEVFKEFYQTRTKHRKLTWIYSLGTCNINAKFEAKTIELIVTTYQAALLLLFNGSDRLTYSEIVTQLNLSDDDVVRLLHSLSCAKYKILNKEPANRSISPNDVFEFNSKFTDRMRRIKIPLPPVDEKKKVVEDVDKDRRYAIDASNVRMMKSREVMGHQQLVXRECVEQLSRMFKPDFKAIKKRIEDLITRDYLEREKDNANVYRYLA

SEQ ID NO: 27578 - protein, 472 aa, Coprinopsis cinerea okayama7#130
MPPIYDKPTTDRYDYVVIGGGSGGSGTSRRAASYGKKVAVVEATPYLGGTCVNVGCVPKKLMWNAADLQDRFRHHAPGYKFENIGEPTFNWGEFKTQRDAYIRRLNGIYANNFHKEGVEFHQGFGRLTSPNSVEVTRPDGTKYTLQADHITIAVGGSPTIPSDDVIPGASLGIDSDGFFALESQPKRVAVIGAGYIAVELAGIFNALGSETHLVIRGQTVLRTFDPTIQETLTPWMEHTGVHIHKGSNVTRIDGAKGQTLTVTTDQGEKIEVDTVLWAIGRHPCTKGLGLEEVGVKTDEKGDIIVDEYQNTNVKGVYSIGDVSGKWLLTPVAIAAGRRLSNRLFGPEKFKNDKLEYDNIPTVVFSHPPIGTVGLTEPQARKKYGDDAIKIYKTSFKSLYFSQVDQDLKEPTVYKLIVAGPEEKVVGVHIIGQGSDEAMQGFGVAVKMGATKADLDNTVAIHPTSAEELVTLR

SEQ ID NO: 27579 - protein, 151 aa, Coprinopsis cinerea okayama7#130
MSNTERTYIMIKPDGVQRALVGKIIQRFEERGFKLIALKLTQPTEAHLEKHYADLAGKPFFPGLIKYMASGPVVAMVWQGLDAVKTGRAMLGATNPLASPIGSIRGDYALAVGRNIIHGSDSVENAEKEIALWFPEGVVQYTSVAEPWIYE

SEQ ID NO: 27580 - protein, 341 aa, Silicibacter pomeroyi DSS-3
MTLKVAINGFGRIGRGVLRALVESGADDIEVVAINDLASPETLAHLLKYDSVHGRLQAPVLVEGDRMIVGRSSIRLSAIRNPEDLPWADVDIAYECTGLFTEREQAARHLKNGSKRVLISAPGKGADRTVVFGVNDGALTADDVIVSNASCTTNCLAPVAMVLDHAFGIKTGYMTTIHAYTGDQPTHDTAHRDLYRARAASVSMIPTSTGAARAISEVLPHLKGRLEGSAIRVPTPNVSLVDLSFVPERPATREAVNAAIRTAAQGPLAGILAYEEDPLVSIDFNHDSHSSCFAAAQTSVTADGLVRVVSWYDNEWGFSNRMLDTGRRIGALLITPQRLAG

SEQ ID NO: 27581 - protein, 373 aa, Zea mays
  misc_feature (141)..(141): Xaa can be any naturally occurring amino acid
MVKVIQGRPAEMGFRMPAEWEPHEQCWMGWPERPDNWRENAGPAQEVFARTAIAISKFEPVTLCASAKQYPKVHELMEHQTNIRVVEMSMNDSWFRDMGPTFVTCKGDSGIAEQTIAGIDWQFNAWGGIYDDWSLDSDVAXKKIVEIERIPRFPQKIILEGGSIHVDGEGTCITTEECLLNPNRNPNMTKLEIENELKDFLGVSKVIWIPRGLYGDEDTNGHVDNLCCFIKPGVILLSWTDDEKDHQYERSVEALSVLSQSVDAKGRQLQVVKIHVPGPLYMTEEEAQGVVSSGHSVPRPAGTRLAASYVNFYIANGGIIAPSFGDRWDEEAYAVLQKAFPDHEVVMVEGGREIALGGGNIHCITQQQPVRPS

SEQ ID NO: 27582 - protein, 235 aa, Triticum aestivum
  misc_feature (204)..(204): Xaa can be any naturally occurring amino acid
  misc_feature (223)..(223): Xaa can be any naturally occurring amino acid
VSDIPLSLPCLGKKKKKKRGLPINFAGLAKAVKPGATIFVGQYLFTGSETTSVWLEVSEVQGDDVVCVIKNSATLAGSLFTLHCSQIHIDMPTLSDEDKDVMKKWGAPNKIDFLSLSYTRHAEDVRQAREFLSKLGDLSQTLIFAKIENVEGLNHFDEILEEADGIILSRGNLGIDLPPEKVFLFQKSALHKCNMAGKPAVVTXRVVDSMTDNLRPTRAEATXDVANAVLDGSDA

SEQ ID NO: 27583 - protein, 167 aa, Neisseria meningitidis
MFEPLWNNKYIESVQLTIAEQLGVEERGEFYDITGALRDMVQNHLMQMLCMTAMEAPASLDADAVRDEKVKVIKSLKPLTVESVNENVVRGQYTAAKGMNGYLEEINVPQDSFTETYVAIKAEIENERWKGVPFYLRTGKRMTGKVAEIVLNFKDLNSHIFEGSRTA

SEQ ID NO: 27584 - protein, 367 aa, Salmonella enterica subsp. enterica serovar Urbana
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIR

SEQ ID NO: 27585 - protein, 172 aa, Zea mays subsp. mexicana
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEEAFKDRSNGRAFFSGGDAAPGLLDLALGCFLPALRACERLHSLSLIDASATPLLDGWSQRFAAHPAAKRVLPD

SEQ ID NO: 27586 - protein, 591 aa, Chlamydomonas eugametos
MAAKFVEGTLDVTLKSASDLREDMSVKLDAYCVVSCASTAHRSNTVTDAGKTMNWEQTFHFDKVASTSVLKLESSMRRTPSDRSSCACKIPLTRACTSGSDEVCVPVLDKKGKPIGETHVSMTFKATSMADGPTKGNWILPTYANKDCWKDYEQGKVVGKGSFGTTYLVTKKDTQEQYAVKVISKRKLTTMEEVEDIQREVRIMHHLAGHPNVVQLKNVYEDKSYVYLVMDACMGGELFDAIVERGTYSEKDARALMRTIVSVVAHCHDMGVIHRDLKPENFLLLDKSANPVLKSIDFGLSSFYQEGQVFHDIVGSPFYVAPEVVRRSYGKEADIWSCGVILYILLCGYPPFHGDNETKIFEAIMNKSLDFQSDPWPKVSEPAKECIRRMLDRNPKTRASAQQTLEHEWMRENGVATEKRLEMEVLTSMKKFSAGNRLKKEAAKIIAANLPTDEICGLREMFIAIDVDHSGSITAEEFANALRMKGNSLPEDEVQRLVSNADVDGDGTCDYEEFLAATINQSKLEREDRLKIAFEHFDLDHDGSITHDELMQSLANLGINDAGIKEIIADVDRDGNGQIDYNEFCLMMRNL

SEQ ID NO: 27587 - protein, 297 aa, Salmonella enterica subsp. salamae serovar Greenside
MTNLKAVIPVAGLGMHMLPATKAIPKEMLPIVDKPMIQYIVDEIVAAGIKEIVLVTHASKNAVENHFDTSYELESLLEQRVKRQLLAEVQSICPPGVTIMNVRQAQPLGLGHSILCARPVVGDNPFIVVLPDIIIDDATADPLRYNLAAMVARFNETGRSQVLAKRMKGDLSEYSVIQTKEPLDNEGKVSRIVEFIEKPDQPQTLDSDLMAVGRYVLSADIWAELERTEPGAWGRIQLTDAIAELAKKQSVDAMLMTGDSYDCGKKMGYMQAFVKYGLRNLKEGVKFRKSIEQLLHE

SEQ ID NO: 27588 - protein, 187 aa, Synechococcus sp. RS9917
MAAMMTGLWPLRHLSLDLRQLIRDIPDFPKPGILFRDISPLLRDPAGWSEVMRRLGGVCDQLQPDLIVGIESRGFIVGTALATDRKLGFVPVRKPGKLPGEVIAIDYSLEYGSDRLEMHADALRDGARVLIVDDLLATGGTASATASLVQQAGGQLVGCGFVVELAGLDGRRRLPDQTPVESLIIYS

SEQ ID NO: 27589 - protein, 539 aa, Herminiimonas arsenicoxydans
MHSKILILDFGSQVTQLIARRVRDSGVFSEVYPYDVSDEFVRNYGAAGVILSGGPNSVIEGDESPRVPQAVFELGVPVLGICYGMQAMAEQLGGKVENGTVREFGYAEVRAHGHTALLKDISDFTTPEGHGMLKVWMSHGDKVNEMPPGFKLMASTPNCPIAGMADEARHMYAFQFHPEVTHTLQGKAIIARFVHDICGCKSDWNMPDYIAEAVEKIRQQVGNDEVILGLSGGVDSSVAAALIHRAIGDQLTCVFVDHGLLRLDEGKMVMEMFADHLGVNVIRIDAVDQFMGHLAGVTDPEAKRKIIGREFVEVFQVEAGKRKNAKWLAQGTIYPDVIESAGKGKKGHTIKSHHNVGGLPETLNLQLLEPLRELFKDEVRQLGVALGLPHDMVYRHPFPGPGLGVRILGEVKKDFADLLRRADAIFIEELRNTPYVLAAGASESTDNGIPHRNWYDATSQAFAVFLPVKSVGVMGDGRTYEYVVALRAVQTQDFMTAHWAHLPYELLGKVSNRIINEVRGINRVVYDISGKPPATIEWE

SEQ ID NO: 27590 - protein, 129 aa, Triticum aestivum
MAASAATATATATAAAVGAGEVISVHSLEQWTMQIEEANAAKKLVVIDFTASWCGPCRIMAPIFADLAKKFPAAVFLKVDVDELKPIAEQFSVEAMPTFLFMKEGDVKDRVVGAIKEELTTKVGLHAAQ

SEQ ID NO: 27591 - protein, 249 aa, Mannheimia succiniciproducens MBEL55E
MNNIQGKVVIITGASSGIGEATAYKLAEQGAKIVLAARREAQLKAIADNIKAKGGEAVYRVTDVVKPEDNQALVELAKSAFGKVDAIFLNAGLMPSAPLSALETDNWNRMIDVNIKGVLNGIAAVLPTFEAQKSGHVLATSSVAGLKVYPGGTVYCGTKWAVKAIMEGLRMESAQAGTNIRTATIYPAAVQSELVAGITDETTSQGYRQLYDTYEIPAERVANVVAFALSQPDDTNVSEFTIGPTTQPW

SEQ ID NO: 27592 - protein, 318 aa, Triticum aestivum
MAEHLASIFGTEKDRVNCPFYFKIGACRHGDRCSRLHNRPTTSPTIVLANMYQRPDMITPGVDAQGVAIAPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPQHRRDNRDRGGDFRRDGRDEYRGGGGGGGYRGGDGGDGGGYCGGGGGGYRGGDGGGYRGGGGGGYPGGGGRHDRYDDGPRRRYGGSPPRRGRSPPARENSEERRAKIEQWNREREEK

SEQ ID NO: 27593 - protein, 734 aa, Coprinopsis cinerea okayama7#130
MASAFKRWSKRVVKHPEETVPIISSTAWAQGLFDHPTNKFGAYVLSLFPIVQWLPRYNFGWLSGDLIAGITVGMVVIPQGMSYAQFFATSKDVSIGPVAVMSILVSQIINHVESQHPGVWTGPDIAAVLAVITGFITLGMGLLRIGWLVEFIPAPAVSGFMTGSAFTIATTQIPGLMGITGFSIGRGLTDATSTRDPAYQVIINTLKNLGGTKLDAAWGITGLVSLYAIRYFCIWGTKRYPARARWFFFMSVMRNAFVIIVLTLASFLYNRKRLDPETGKYPIRILLTVPSGFKHVRPPPISTSLLSALGPKIPVATIILLLEHIAIAKSFGRLNGYKINPAQELIAIGVTNTVGSVFGAYPATGSFSRSALKSKCGVRTPAAGVVTAVVVIVALYGLTDAFFWIPMAGLSAVIIHAVADLMASPDQVYSYWRISPLEFLIWAAAVLITVFSSIENGIYTSVVASLVLLLVRLAHPRDSFLGKVTIHQGENGKGESRDVYLPLTKNGITNPHVKVTPPAEGVIIYRFEESYLYPNSSIPNSALVDEVKTKYRRGQDMTNVKPSDRPWNDYGKRRSGAEDQALNLQKPVLHAIVLDFSSVSHIDTTSVQALIDARREIEKWADHPVEFHFAPILSPWIHRALVAGGFGIGNSHSSIPFDLAAVVPYRDGTSFDEVTKGPPSDIESGGDTKEPASPKESESVLEPVVPTNTPFFHIDLASAVKAAESGVERVHDKN

SEQ ID NO: 27594 - protein, 457 aa, Roseovarius nubinhibens ISM
MLKNDQLDQWDRDNFFHPSTHLAQHARGEAANRVIKTASGVFIEDRDGTKLLDAFAGLYCVNVGYGRQEIAEAIADQARELAYYHAYVGHGTEASITLSKMILDRAPKGMSKVYFGLGGSDANETNVKLIWYYNNILGRPEKKKIISRWRGYHGSGLVTGSLTGLELFHKKFDLPVEQVIHTEAPYYYRRKDLGQSEAEFVAHCVAELEALIAREGADTIAAFIGEPVLGTGGIVPPPSGYWEAIQAVLEKHDILLVADEVVTGFGRLGTMFGSDHYGMRPDLITIAKGLTSAYAPLSGSIVGDKMWKVLEQGTDENGPIGHGWTYSAHPIGAAAGVANLKLIDDLGLVQNAGAVGTYLRDQMQAALGDHAHVGEVRGEGMMCAVEFVRDRDDRVFFDAAEKIGPQVSAKLLEQDKVIARAMPQGDILGFAPPFCLSREEADQVVAATMRAVKTVLG

SEQ ID NO: 27595 - protein, 621 aa, Escherichia coli
  misc_feature (1)..(1): Xaa can be any naturally occurring amino acid
  misc_feature (159)..(159): Xaa can be any naturally occurring amino acid
  misc_feature (164)..(164): Xaa can be any naturally occurring amino acid
  misc_feature (174)..(174): Xaa can be any naturally occurring amino acid
  misc_feature (183)..(183): Xaa can be any naturally occurring amino acid
  misc_feature (236)..(236): Xaa can be any naturally occurring amino acid
  misc_feature (269)..(269): Xaa can be any naturally occurring amino acid
  misc_feature (281)..(281): Xaa can be any naturally occurring amino acid
  misc_feature (340)..(340): Xaa can be any naturally occurring amino acid
  misc_feature (346)..(346): Xaa can be any naturally occurring amino acid
  misc_feature (352)..(352): Xaa can be any naturally occurring amino acid
  misc_feature (446)..(446): Xaa can be any naturally occurring amino acid
  misc_feature (449)..(449): Xaa can be any naturally occurring amino acid
  misc_feature (460)..(460): Xaa can be any naturally occurring amino acid
  misc_feature (515)..(515): Xaa can be any naturally occurring amino acid
  misc_feature (532)..(532): Xaa can be any naturally occurring amino acid
  misc_feature (546)..(546): Xaa can be any naturally occurring amino acid
  misc_feature (562)..(562): Xaa can be any naturally occurring amino acid
  misc_feature (574)..(574): Xaa can be any naturally occurring amino acid
  misc_feature (600)..(600): Xaa can be any naturally occurring amino acid
  misc_feature (611)..(611): Xaa can be any naturally occurring amino acid
XSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGXAFEAXNHAGDIRPDXLVILNDNEXSISENVGALNNHLAQLLSGKLYSSLREGGKKVFSGVPPIKELLKRTEEHIKGXVVPGTLFEELGFNYIGPVDGHDVLGLITTLKNXRDLKGPQFLHIXTKKGRGYEPAEKDPITFHAVPKFDPSSGCLPKSSGGLPSYSKIFGDWLCETAAKDNKLXAITPAXREGSGXVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEXVIXTPSDENECRQXLYTGYHYNDGPSAVRYPRGNAVGVELTPLEKLPIGKGIVKRRGEKLAILNFGTLXPEAAKVAESLNATLVDXRFVKPLDEALILEXAASHEALVTVEENAIXGGAGSGVNEVLXAHRKPVPVLNIGLPDFFIPQGTQEEXRAELGLDAAGXEAKIKAWLAL

SEQ ID NO: 27596 - protein, 784 aa, Bacillus anthracis str. Ames
MKGVILAGGKGRRLRPLTCNTPKPMLPLLEKPVLEYNIELLRQHGIREIAITVQYMSTAIKQYFGDGSKWGVNLYYFEDSPPLGTAGSIKQAEKFLDETFVVISGDALTDFQLSKGITFHEQQKRMVTMFVKEVENPLSFGLVVMNKEQEVTRYIEKPSWNEVVSNIVNTGIYIMEPEIFSYIPPREFFDFSQDVFPLLANKNALFAYLSEGYWLDIGTFDQYRQAQFDLLTKKLQVPIPYTEVLPMVWMGEGVTIGKGTKIHGPSFIGEGAKIGAGAVIEPYSIIGKNSIVSSYSHLQKSIVFANAHIGQYCELLETTIGEHTMVEDDVTLFQKSIVADHCHIGKSTVIKQKGKLWPYKAIDSYSVVGSAGVQESEKSAGWLQKSRIVGRGNVEITPQFIVKVAMAYGSLFTKGESILIGSQEHIETTSYKNLFLHAIHGIGIHTMECKEMNESLFQYSIQDLQCAGGVFIQVENEKEVIIKLYAQDGAQLTYKQQKAIEQVYMSESFYYVCEKEMGRNKLVHVSLHDYIEAVLERIDIEKIQKQKFHLLINKRNDMLQHLLMLFLQRLGCTVTWIYAGEQKDHVKALMKSSKANMALMFSEQGNYFELYDNHSNIYQGTDFEEVDIPDLLLESTGNIYLMSLKLGECYLLFYTQDEKKSFQARWKRDILYRIGKLFELIALQGKTFLSIVEQSPPLYLLCDEVVCSWNEKGKVMRKLLADMERKEEGIFEGVQFKYTEKEWSYIVSDTKQPKFLVYSHARNPVIARENMKNLIEKIRQYQKV

SEQ ID NO: 27597 - protein, 255 aa, Brassica napus
  misc_feature (172)..(172): Xaa can be any naturally occurring amino acid
MARKFFVGGNWKCNGTAEEVKKIVNTLNEAQVPSQDVVEVVVSPPYVFLPLVKSTLRSDFHVAAQNCWVKKGGAFTGEVSAEMLVNLDIPWVILGHSERRALLNETNEFVGDKVAYALAQGLSVIACVGETLEQREAGSTMDVVAAQTKAIADRVSNWSKVVIAYEPVWAIXGTGKVASPAQAQEVHDELRKWLAKNVSADVGATTRIIYGGSDDGGNCKELGGQADVDGFLVGGASLKPEFIDIIKAAEVKKSA

SEQ ID NO: 27598 - protein, 366 aa, Vitis vinifera
MPYRQQRIETMEVDFESQPTDHHSHPLQLSNHHPQQTLTLASCSGCKLKASGLIYDCKRCNYFLHISCSQMPQQITHSFHKAHALSLLPNPAYPEGLFNCDACGKQGNGFSYHCGVCNIDLHILCASKPLFLNHQSHHHRLALSFSPPYHNKSFSCDICRQIGTSHWLYRCDECEFDAHLSCATATPAAPIQAPLQQNFMQQFQTASRATPHGHFPRNQSAIGQNYMQQLQTTQPTLHCQFPTGQNYMQQFQTTPRAILPGQFPGTQVGTGQNYPPMNQVNNLNPGVVYRPVRPAATSGQGNSLLSQAIDGLVNGAAQQVGMNMVQGLLGGGGGGGSTALDAGGGGTWDGGSSSVSYDCYSGTDGG

SEQ ID NO: 27599 - protein, 100 aa, Oryza sativa
LLWFLQDDLDDYVDVTNSRLQVYFWYFFIQSSGKFHCYIVISSLCELNFDINLSLIQRVQKRLAILNKRVKGGCSCMALLISVVAIVFLAVIAWLLIKHL

SEQ ID NO: 27600 - protein, 771 aa, Oryza sativa Japonica Group
MAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 27601 - protein, 377 aa, Bacillus cereus ATCC 14579
MKAVTYQGPNQVQVKQVDDAKLEKKDDIIVKITSTAICGSDLHLYQGNMPLPQGYIIGHEPMGIVEEVGPDVTKVKKGDRVVIPFNVSCGHCFYCQHEMESQCDNSNPHYDSGGYFGYTEKFGNHPGGQAEYLKVPFGNFTPFVIPESCELEDESLLFLSDVLPTAYWSVINAGVRPGDTVIVLGCGPVGLMTQKFAWMQGAKRVIAVDYLDYRMNYAKKINNVEVFEFTKFPDMGEHLKEITHGGADVVIDCVGMDGKKSPLEFLEQKLKLQGGTLGPIQIATKAVRKYGTVQMTGVYGGNYNAFPLGAFWVRNINLKMGQAPVIHFMPELFEKITNKEFDPKEIITHKIPLEEASYGYQIFNNREDDCIKVILKP

SEQ ID NO: 27602 - protein, 172 aa, Zea mays subsp. mexicana
AANPVYGKIPVLLLPDGRAICESAVIIQCIEDVARGSGGAEASSLLLPDDPYERAMHRFWTAFIDDKFWPALDAVSLAPTPGARAQAVEDTRAALSLLEVAFKDRSNGRAFFSGGDAAPGLLDLALGCFLPALRACERLHGLSLIDASATPLLDGWSQRFAAHPAAKRVLPD

SEQ ID NO: 27603 - protein, 323 aa, Saccharomyces cerevisiae
MSGSFWTSTQRHHWQYTKASLAKERQKLWLLECQLFPQGLNIVMDSKQNGIEQSITKNIPITHRDLHYDKDYNLRIYCYFLIMKLGRRLNIRQYALATAHIYLSRFLIKASVREINLYMLVTTCVYLACKVEECPQYIRTLVSEARTLWPEFIPPDPTKVTEFEFYLLEELESYLIVHHPYQSLKQIVQVLKQPPFQITLSSDDLQNCWSLINDSYINDVHLLYPPHIIAVACLFITISIHGKPTKGSSLASAASEAIRDPKNSSSPVQIAFNRFMAESLVDLEEVMDTIQEQITLYDHWDKYHEQWIKFLLHTLYLRPASAI

SEQ ID NO: 27604 - protein, 172 aa, Zea mays subsp. parviglumis
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEEAFKDRSNGRAFFSGGDAAPGLLDLALGCFLPALRACERLHGLSLIDASATPLLDGWSQHFAAHPAAKRVLPD

SEQ ID NO: 27605 - protein, 626 aa, Candida albicans SC5314
MRFIVSSFIFFISFLSSLITAETHTWYFKTSWVDANPDGVFPRKMIGFNDSWPLPTLRAKKGDRIQLYLINGFEDLNTTLHFHGLFQHGTNQMDGPEMVTQCPIPPGETYLYNFTIDDQVGTYWYHSHTSGQYGDGMRGVFIIEDDDFPYDYDEEIVLTLSEHYHDYSKDLMPGFLSRFNPTGAEPIPSNILFNETRNNTWKVEPGKTYLLRIANTGRFVTQYLWMEDHEFTVVEVDGVYVEKNTTDMLYITIAQRYGVLITTKNSTDKNYAFMNRVDDTMLDTIPKDLQLNGTNYIVYNESAPLPDAYDVDSIDDYLDDFYLKPLNKEKLLDDADYTITVDVQMDNLGNGVNYAFFNNITYMTPKVPTLLNVLSAGDASTNELVYGSNTNSFVLQGGDVVDIVLNNLDTGRHPFHLHGHVFQLIERHEEIPDTEDPVSYNVSDHAEWPEYPMSRDTVYVKPQSYIVMRFKADNPGVWFFHCHIEWHLDQGLAIVLIEDPEAIQKNSSQHLTDNHKQICEKVGVSWEGNAAANSNNYLDLKGENIQVKRLPTGFTARGIVALVFSCIAAFLGIAAIAYYGMNDIEDVEERVARDLDVDLDEENEDEEEAEIVNEGSSSSGSNSKQH

SEQ ID NO: 27606 - protein, 201 aa, Triticum aestivum
MAEAAALEGSEPVDLTKHPSGIIPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVASCDVKFPIRLEGLAYSHGAFSSYEPELFPGLIYRMRQPKIVLLIFVSGKIVLTGAKVREETYSAFENIYPVLTEFRKVQQ

SEQ ID NO: 27607 - protein, 172 aa, Zea mays subsp. parviglumis
AANPVYGKIPVLLLPDGRAICESAVIVQYIEDVTRESGGAEAGSLLLPDDPYERAMHRFWTAFIDDKFWPALDAVSLAPTPGARAQAAEDTRAALSLLEVAFKDRSNGRAFFSGGDAAPGLLDLALGCFLPALRACGRLHGLSLIDASATPLLDGWSQRFAAHPAAKRVLPD

SEQ ID NO: 27608 - protein, 468 aa, Salmonella enterica subsp. salamae serovar Greenside
MSKQQIGVVGMAVMGRNLALNIENRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 27609 - protein, 111 aa, Arabidopsis thaliana
GTFVLVYTVFSATDPKRSARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 27610 - protein, 388 aa, Salmonella enterica subsp. salamae serovar Greenside
MKITISGTGYVGLSNGLLIAQHHDVVALDIVPSRVELLNDRISPIVDKEIQQFLKEDNIRFRATLDKFDAYQNADYVIIATPTDYDPKTNYFNTSSVESVIQDVTSINPAAVMIIKSTVPVGFTAAMRQKFATENIIFSPEFLREGKALYDNLYPSRIVIGEQSERAREFAALLQEGAIKQDIPTLFTDSTEAEAIKLFANTYLAMRVAYFNELDSYAETLGLNTRQIIEGVCLDPRIGNHYNNPSFGYGGYCLPKDTKQLLANYQSVPNNIISAIVEANRTRKDFIADAILARKPKVVGIYRLIMKSGSDNFRASSIQGIMKRIKAKGVEVIIYEPVMQEDAFFNSRLERDLRCFKQQADVIISNRMAAELLDVAEKVYTRDLFGSD

SEQ ID NO: 27611 - protein, 503 aa, Glycine max
MSIPIPHRQLFIDGDWKVPVLKNRIPIINPSTQHIIGDIPAATKEDVDLAVAAAKAALSRNKGADWASASGSVRARYLRAIAAKITEKKPELAKLEAIDCGKPLDEAAWDIDDVAGCFEFYADLAEKLDAQQKAHVSLPMDTFKSYVLKEPIGVVALITPWNYPLLMATWKVAPALAAGCAAILKPSELASVTCLELAEICKEVGLPPGVLNILTGLGPEAGAPLAAHPDVDKIAFTGSSATGSKIMTAAAQLIKPVSLELGGKSPIIVFEDVDLDKAAEWTIFGCFWTNGQICSATSRLIVHESIATEFLNRIVKWVKNIKISDPLEEGCRLGPIVSEGQYEKILKFISNAKSEGATILTGGSRPEHLKKGFFVEPTVITDVTTSMQIWREEVFGPVLCVKTFSTEEEAIDLANDTVYGLGSAVISNDLERCERITKAFKAGIVWINCSQPCFTQAPWGGIKRSGFGRELGEWGLDNYLSVKQVTQYISDEPWGWYQSPSRL

SEQ ID NO: 27612 - protein, 273 aa, Physcomitrella patens subsp. patens
MGETEAGFAKLQGEDFEYYMQTYSIVLGRNSKKSAVDVDLVGLGGGMNISRQHARIFYDFERQRFVLEVLGKNGCYVEGVLHHPGNVPVKLDSQDLLQIGEKRFYFLLPAKKIVRGRNKNGPVGGGTWGQQQTGMVPKEVVPPPLVGTGTKGREGNRYDEDEPDVVHEQFEGTEVVKIILEKLQSQYHPGEWMAVSKLHADILDHFQRRQLSPQFMQIMGLDGDGQDRDGKGNTKAWSGLVSLLKQYPRYFVINTKLKGGIRVEYVSLYIEEQ

SEQ ID NO: 27613 - protein, 480 aa, Pseudomonas fluorescens PfO-1
MLIPVILSGGAGTRLWPVSREGHPKPFMTLPDGQSLLGKTYRRAAALLDGWGDIVTVTNREYYFQSKDHYQAAHLSRHRGHFLLEPTGRNTAPAIAAAALSLQALHGDAAIMVVMPADHLIVNEEALKSAVEHAVNLAKDGYLVTFGVVPTAPETGFGYIETGAPLNDRGAAKVQRFVEKPDLQTATHYLESGNFLWNSGMFCFSTATVIAELALHAPELLEQTRACMAASEPVETAGCLQQELSTQLFAEITDISIDYALMERSEKVVVVPAGFDWSDIGSWSAVAALVPADTDNNRASGEAIFIDSRNNFVQSEGRLVAAVGVEDLIVIDTADAVLVAHADRAQDVRRVAKQLKDKSHEAYRLHRTVSRPWGTYTVLEEGPRFKIKRIVVKPGGKLSLQMHHHRNEHWVVVEGMAKVTNNGSGTTLVAKNESTFIAAGHKHRLENPGVIDLVIIEVQSGEYLGEDDIVRFEDQYGRTV

SEQ ID NO: 27614 - protein, 189 aa, Opitutaceae bacterium TAV2
MSKDATTASPATTVQDRLANHLGRTPETSGALWIATNATVTGNVKLGADTSVFYGAVLRGDINSIEIGDGSNIQDNCIVHLSDDADVKVGRYCTVGHAAILHGCTIEDEVLVGMGSIILDKAVIGARSLVGAGSLVTQGFTCPPGSLVLGRPAKVIRQLSPEEQLSGRKLAEKYTAVAKSHAAKQNAPA

SEQ ID NO: 27615 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGFCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 27616 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGWCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 27617 - protein, 196 aa, Arabidopsis thaliana
MTDQGLEGSNPVDLSKHPSGIVPTLQNIVSTVNLDCKLDLKAIALQARNAEYNPKRFAAVIMRIREPKTTALIFASGKMVCTGAKSEDFSKMAARKYARIVQKLGFPAKFKDFKIQNIVGSCDVKFPIRLEGLAYSHAAFSSYEPELFPGLIYRMKVPKIVLLIFVSGKIVITGAKVISHFSLGFVIILVMSLSSL

SEQ ID NO: 27618 - protein, 483 aa, Roseovarius nubinhibens ISM
MTFRDKAFINGQFVAAQSGETFDSINPATGEVLAQVASCDAADVDRAVAAARTAFDAGHWSRSDPGHRKSVLLKLADLIRDNLAEFALLDSLDMGKLVQDAVTVDAPGSAHFFQWYAEAIDKIYDEVAPTGPGDLALVRRVPLGVVGAVTPWNFPLDMATWKAAAALAAGNSVVLKPAEQSPLSALRLAELAMEAGLPEGVFNVVPGMGATAGRALGLHNDVDCLAFTGSTAVGKMFMQYSGQSNLKPVWPETGGKSPNLIFADCADLDRAADMAAFGIFFNQGQVCSANSRLYVERAIHAEFVERMIARAEATPPGDPLDPASKLGAIVDEKQTRSIEAAIAAGRNSANLVAGGNRVTLNGKGCFIEPTIFDDVRHDDALARDEIFGPVLSIIPFDTEAEAVAMANDSIYGLAASVWTDNLSRAHRVSEAIHAGTVSVNTVDALSAQTPFGGMKQSGFGRDLSLHSFDKYTALKTTWIKYQA

SEQ ID NO: 27619 - protein, 349 aa, Zea mays
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKDHLLTMSSVINQVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASEGPLKGIMGYAEEDLVSTDFLGDSRSSIFDAKAGIALNDHFVKLVSWYDNEWGYSNRVVDLIRHMFKTQ

SEQ ID NO: 27620 - protein, 507 aa, Robiginitalea biformata HTCC2501
MKKKRLSFWEIWNMSFGFLGIQFGFALQNANTSRIFETLGAEIDQIPILWIAAPVTGLVVQPIIGYFSDRTWTRLGRRRPYFLAGAILASIALCIMPNSPALWVAAGMLWIMDASINVAMEPFRAFVGDNLPGDQRTLGFAMQSFFIGLGAVVGSVMPYVFTNWLGISNTAPEGVIPDSVKWSFYVGGVVFLTAVLWTVWRSREYSPEELEQFEENRDFPAPDLSPEENERRIARLRQYGIMFLAAGLLATAIPYYYNLQKELYVLTVGFALVGILFLAASAIRRRKGRNGFVTIMSDLLNMPDTMKQLAWVQFFSWFALFSMWIYTTQAVTGHVYGTRDTTSELYNDGADWVTVLFGVYNGVAAVVAFLLPVLARKTSRKITHLIALTLGGLGLMSVYFITDPDWLLLSMVGVGIAWASILSVPYAMLAGALPPKKMGYYMGVFNFFIVIPQMVAATILGFLVSGLFGGEPVYALVVGGLAMILSGLLTLRVRDRRAIDLAGMTKS

SEQ ID NO: 27621 - protein, 624 aa, Candida albicans SC5314
MRTFLSSFIILTTFLASLIAAETHTWYFKTGWVDANPDGVYPRKMIGFNDSWPLPTLRVKKGDRVQLYLINGFDNLNTTLHFHGLFVRGANQMDGPEMVTQCPIPPGETYLYNFTVTDQVGTYWYHSHTGGQYGDGMRGVFIIEDDDFPYDYDEEVVLTLSDHYHKYSGDIRPAFLTRFNPTGAEPIPQNFLFNETRNATWKVEPGKTYFVRILNVGGFVSQYLWMEDHEFTIVEIDGVYVEKNTTDLIYITVAQRYGVLITTKNSTDKNYVFMNGVDTTMLDSVPADLQVNGTNYIVYNESSALPDAYDIDSYDDALDDFYLKPLSKQKLMDDADYTITVDVQMNVLNDGINYAFFNNISYKAPKVPTLLTVLSAGEAATNELIYGTNTNSFVLQGGDIVDIVLNNFDTGKHPFHLHGHVFQLIERHEAIGSKESAVTFNVSDHAEWPEYPMIRDTVYVKPHSYMVLRFKADNPGVWFFHCHVDWHLEQGLAIVLIEDPQAIQKNEKITENHKRICEKVGVPWEGNAAANSNDYLDLKGENVQVKRLPTGFTTKGIVALVFSCVAAFLGLFTISFYGMNDIAHVEDKVARDLDIDLEAENEDEEEAVVLNQNSSSSDSNSKPH

SEQ ID NO: 27622 - protein, 453 aa, Saccharomyces cerevisiae
MSENNEEQHQQQQQQQPVAVETPSAVEAPASADPSSEQSVAVEGNSEQAEDNQGENDPSVVPANAITGGRETSDRVLYVGNLDKAITEDILKQYFQVGGPIANIKIMIDKNNKNVNYAFVEYHQSHDANIALQTLNGKQIENNIVKINWAFQSQQSSSDDTFNLFVGDLNVNVDDETLRNAFKDFPSYLSGHVMWDMQTGSSRGYGFVSFTSQDDAQNAMDSMQGQDLNGRPLRINWAAKRDNNNNNNYQQRRNYGNNNRGGFRQYNSNNNNNMNMGMNMNMNMNMNNSRGMPPSSMGMPIGAMPLPSQGQPQQSQTIGLPPQVNPQAVDHIIRSAPPRVTTAYIGNIPHFATEADLIPLFQNFGFILDFKHYPEKGCCFIKYDTHEQAAVCIVALANFPFQGRNLRTGWGKERSNFMPQQQQQGGQPLIMNDQQQPVMSEQQQQQQQQQQQQ

SEQ ID NO: 27623 - protein, 181 aa, Physcomitrella patens subsp. patens
MGLTFTKLFSKLFSKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPDAMNAAEITDKLGLHSLRQRHWYIQSTCATSGEGLYEGLDWLSSNITNKS

SEQ ID NO: 27624 - protein, 83 aa, Triticum aestivum
  misc_feature (38)..(38): Xaa can be any naturally occurring amino acid
  misc_feature (50)..(50): Xaa can be any naturally occurring amino acid
  misc_feature (72)..(72): Xaa can be any naturally occurring amino acid
LRYTNTVWKTGIKVDSTKEMLGTFSPQPEPYAYVTPEXETTPSGMFARGXSYSAKTKFLDDDRKCYLQIKLXTSDIRREWRSS

SEQ ID NO: 27625 - protein, 451 aa, Candida albicans SC5314
MISNGKDTSLKQVEAEVSTKSTSITPTKNELSNSTSKPTPSNDKSTEQTKEQLVVNEKEKKKQAFVTRTIWTFVMIGGFFAILASGHLALIIMVSVFQMLTFKEVIALTSEPARDKKIPWNRSLNWYFLGTTWYYLDFPALFDFFQESVYSSKFLTLLVKNHKFISYSLYIAGFVFFVWTLKKGYYRFQFAQLCVTHMTLLLVVFQAHLIIDNILQGIIWFFLPATLVIVNDIFAYLCGITFGRTQLIEISPKKTVEGFVGAWICTGIAGVIASHILSKSDYMICPAENLSTHLYNFPHCDLNPIYIPQVYQLPANIVELTGHELITFKPFYFHAAILATFASLIAPFGGFFASGLKRAFGIKDFGDTIPGHGGITDRFDCQFLMGSFTYLYYHTFVSNQNVNLGHVLQLAIMNLSVPQLLQLIKSLLKYLNREEVLTSEQLSRIFDILEN

SEQ ID NO: 27626 - protein, 171 aa, Bacillus halodurans C-125
MDFKQHITIVENFPKEGIRFKDITTLMQNGEVYKRAIDEMARFAKEKEVDLVVGPEARGFVVGCPIAYAIGKGFVPVRKAGKLPREVISVDYGLEYGKDRLTIHRDAIQKGQRVLIADDLLATGGTIEATVQMVEQLGGEVVGIAFMIELGYLNGRDKLVTYDVFSLTTYE

SEQ ID NO: 27627 - protein, 336 aa, Synechococcus sp. WH 5701
MTSSFPPSADPSGAAPSDRLWLRSELMGTQVITRDTGRRLGVVGEVVVDIDRREVVALGLRDNPLTRFLPGLPRWMPLDRIRQVGDVVLVDSADSLAEGFNPERYSKVINCQVISESGEQLGRVLGFSFDIETGELTTLVLGALGVPLLGEGVLSTWELSVEEIVSSGPDRIIVYEGAEEKLKQLGSGLLEKLGIGGPSWEQEERDRFRQTMVPVENQLASGQPSVQEQRRIQPASSRAVQVEDQEELEYVELERRRQEPLRQRRYLDEDEFDDEPRRRSPLPQQPRQAPLRSSGDQRQPLDVEPEPYRVRQEPEPEVLEPPARPRTNEERFSDPW

SEQ ID NO: 27628 - protein, 251 aa, Cryptococcus neoformans var. neoformans JEC21
MARKFFVGGNFKMNGSLESVEKIVRSINDANLDGTNEVVIAPPALYLLKVQSELNAPTQVSAQNAFTESSGAFTGEIAPQQLKDANVHWVILGHSERRSLFGDTDKLVADKTKAAINAGLSVIACIGESLEERESDKTMTVVERQLEAIAAAIDVDAWKRIVIAYEPVWAIGTGKVATVSQAQEVHAAIRSWLSRRASPEIADSTRIIYGGSVNGKNCGKLSAAKDIDGFLVGGASLKPEFIDICKSGKKA

SEQ ID NO: 27629 - protein, 364 aa, Picea abies
MGSASENSEMNTKIVNEDEWLLGMELGNFSCLPMGMKAAIELDVLQIIANAGNGVQLSPRQIVAHIPTTNPDAAITLDRILRVLASHSVLSCSVTTDENGKAERLYGLTPLCKYLVKNQDGVSLAPLVLMNQDKVLMDSWYYLKDAVLEGSQPFTKAHGMNAFEYPAKDQRFNRVFNRGMSEHSTMLMNKILDTYQGFKEVQELVDVGGGVGSTLNLIVSRYPHISGINFDMPHVVTDAPHYPAVKHVGGDMFDSVPTGQAIFMKWILHDWSDDHCRKLLKNCHKALPEKGKVIVVDTILPVAAETSPYARQGFHIDLLMLAYNPGGKERTEQEFQDLAKEAGFAGGVKPVCCANGMWVMEFHK

SEQ ID NO: 27630 - protein, 110 aa, Glycine max
MTENNPKTHYPSSGGIPSPSDDGPKKLPGKQKMHFNPPEKEIPDAATLRDQWRYAIRQYSKWYSHAWGTAILAGTAFFALGWFIKGENPIPSFNSNKDKDKDKDNHNSHP

SEQ ID NO: 27631 - protein, 332 aa, Streptococcus agalactiae A909
MKNLRNRSFLTLLDFSTAEVEFLLKLSEDLKRAKYAGIEQQKLVGKNIALIFEKDSTRTRCAFEVAAHDQGAHVTYLGPTGSQMGKKETSKDTARVLGGMYDGIEYRGFSQETVETLAEFSGVPVWNGLTDADHPTQVLADFLTAKECLHKPYKDIRFTYVGDGRNNVANALMIGASIVGMTYHLVCPKELEPDPELLSKCQEIAKTTGASIEITDDIAEGVRDSDVLYTDVWVSMGEPDEVWKERIALLEPYRITQEMLNMTENPNVIFEHCLPSFHNIDTKVGYDIYEKYGLKEMEVSDEVFEGPHSVVFQEAENRMHTIKAVMVATLGD

SEQ ID NO: 27632 - protein, 162 aa, Triticum aestivum
  misc_feature (19)..(19): Xaa can be any naturally occurring amino acid
RGRRGQTPKKRGDERGGGXTLGSTAWEAFRRHFSRKRAVDIRRINPKVPKEEAVAISGRLLQILADHGPLTVGSTWNHAKDAAIDGLNSKTHMKILLKWMWGRRIIKLSCTQAGNTKKFLYSPFTAEDTEAAEEPAEEQPKRKGWKGKHPKYQTKKQPATAA

SEQ ID NO: 27633 - protein, 265 aa, Escherichia coli
MAISIKTPEDIEKMRVAGRLAAEVLEMIEPYVKPGVSTGELDRICNDYIVNEQHAVSACLGYHGYPKSVCISINEVVCHGIPDDAKLLKDGDIVNIDVTVIKDGFHGDTSKMFIVGKPTIMGERLCRITQESLYLALRMVKPGINLREIGAAIQKFVEAEGFSVVREYCGHGIGQGFHEEPQVLHYDSRETNVVLKPGMTFTIEPMVNAGKKEIRTMKDGWTVKTKDRSLSAQYEHTIVVTDNGCEILTLRKDDTIPAIISHDEL

SEQ ID NO: 27634 - protein, 845 aa, Zea mays
  misc_feature (279)..(279): Xaa can be any naturally occurring amino acid
  misc_feature (423)..(423): Xaa can be any naturally occurring amino acid
  misc_feature (653)..(653): Xaa can be any naturally occurring amino acid
MIVVPQTTVNMALAFLVLLLLFAPVAVSQQGFLSIDCGLDADSSGYTDKVTGIVYVSDGSYVDAGENHRIAPDLEGTFEGSSQTLRSFPSGQRNCYALPTVAGTRYLARATFAYGNYDGKNSSALEFDLHLGANYWQTVYPNARSSNAHEAVFVAWAGWTPWCLVNTGRGTPFVSVLELRPLGAALYPLVTPGLVVSTFTRINMGGSVSTTRYPDDPYDRFWWAMDEASPRWVNLSTGRPIQPDTSSYAVPSRILQTAVAAASNNGTAAALTAVTWQYXTKYSFMIFLHFTDFQDTQLRQFDILINENESGPKLTAYNDTWYLTPTHVHTKSYRADDGKYNVTLAATKASVLPPMINALEIYIRVPYESPTTLPQDFDAIVAIKTEYGLSRNWMGDPCFPIKYAWDGVKCSNASEVLAACPSXDLSYNKLSGSIPDSLPTLPSLRVLNVSGNQLSDESLCKNYTGPLIFRLVVPVLVLIVLLLTYFIWWQKRKPIVQPVPTHGPTRDPEPDNASGSQKSYGYNLNITENRQFTYKELEKFTNNFKKFIGQGGFGPVYYGRLEDDTEVAVKMRSESSSHGLDEFLAEVQSLTKVHHRNLVSLIGYCWEEDHLALVYEYMPQGSLFDHLRRLKMVALGSWFGNVQVVLEAAQGLXYLHKGCSLPIVHRDVKTNNILLGQNLQAKIADFGLSKTYLSDTQTHISVTPAGTAGYMDPEYYQTGRLSESSDVFSFGVVLLEVATGESPTVPGQGHIIQRVKQKIATGNVGSIADSRLGSAYDISSMWKVIDTAVMCTADSTAQRPTMATVVIQLKESLALEETREKGSSNRVSRGSDVEAMASTLGPFAR

SEQ ID NO: 27635 - protein, 272 aa, Bacillus cereus ATCC 14579
MNKQIGFIGCGNMGIAMIGGMIKKNIVSPDQIICSDLNVINLKNASNEYGITITTNNNEVANSADILILSIKPDLYSSVINQIKDQIKNDVIVVTIAAGKSIKSTENEFGRKLKVVRVMPNTPALVGEGMSALCFNEMVTEKDIKEVLNIFNIFGQTEVINEKLMDVVTSISGSSPAYVYMFIEAMADAAVLGGMPRKQAYKFAAQAVLGSAKMVLETGIHPGELKDMVCSPSGTTIEAVVTLEEKGLRTAIISAMKRCTQKSMEMSSLTSK

SEQ ID NO: 27636 - protein, 137 aa, Zea mays
MATVSAAVVTTIVARAAIARPNALGLPALRARSERVRCSYAKDAAPVSTKGAGASLLAAAGAVTASAGPALALVDERMSTEGTGLSLGLSNNLLGWILLGVFGLIWSLYTIYTSDLDEDEESGGPLALDPPPLLLMI

SEQ ID NO: 27637 - protein, 125 aa, Zea mays
GLVDEQFQQLQMLQEDGGTPGFVAEVVTLFCDDADRIISELAALLDQPIVDFDKVDAYVHQLKGSSASVGAQKVKFTCMQFRQLCQDKNRDGCIMALAVVRNEFYDLRNKFQTMLQLEQQIQAQQ

SEQ ID NO: 27638 - protein, 523 aa, Silicibacter pomeroyi DSS-3
MTETDTRVYDLFVIGGGINGCGIARDAAGRGLSVALAEMKDLAWATSSASTKLFHGGLRYLEYFEFRLVREALIEREMLLRAMPHISWPMRFVLPYHPDMRFENDTPTSRLLSTVMPWMKGRRPAWLIRLGLFMYDHLGGRKILPGTRTLDLSSDPAGAPLQERFRKAYEYSDCWVEDARLVVLNARDAAARGARIMTRTKVVSATRGADHWTVTLEDTVTGDTRTLCARVLVNAGGPWVGELIHGALRLNSSEQVRLVRGSHIVTRRLFDHDRCYFFQGTDGRIIFAIPYEGEFTLIGTTDQEHHDPDAHPTCTEGERDYLLRFASEYFKRQLTPEDVVWTYSGVRPLYDDGASSATAATRDYVLKVDRNGGAPVLNVFGGKITTYRRLAESALDKIAPFFPGLAGKWTAGVALPGGDFPVDGVAALTEGLMRQYPFLTQAWAARLVRAYGTEAAAMLGEAGNAEALGEDFGATITAHELDWAMSREWVRSAEDFLWRRTKLGLRLTPDQVARIEAYISARG

SEQ ID NO: 27639 - protein, 215 aa, Physcomitrella patens subsp. patens
MDDDWDAEDFTPLPPVLAKEATQVKSQWDDEDAEEEPVEEKPKVVAVPKPKAEKKKEKPKKATSDEGVLSDPLAEKLRQQRLVEEADYQNTSELFGGKTRGGRSLEDFIPKSEDDFLEYAELLAQKIRPFEKSFHYMTLLRAIMRHSVANMKASDAKEIASSMTVIANEKLKAERDATAGKKKTGAKKKQLIVDKPDDDGMGGVSYDAVDDYDFM

SEQ ID NO: 27640 - protein, 326 aa, Bacillus cereus ATCC 14579
MIKDSSVQVEGQEKVCLDQWVAHYRAYAAKGRSASYIPALGEINVSQLGICIVKPDGTMIKSGDWEIPFTLQSISKVIGFIAACLSRGISYVLERVDVEPTGDAFNSIIRLEIHKPGKPFNPMINAGAITIASLLPGTSVQEKLESLYVLIEKMIEKRPAINEIVFQSEWETAHRNRALAYYLKENGFLESDVEETLEVYLKQCSIEINTEDIALIGLILAHDGYHPIRKEQVLPKEVARLTKALMLTCGMYNASGKFAAFIGLPAKSGVSGGIMTLVPSKSRKDLSFQDGCGIGIYGPAIDEYGNSLPGIMLLEHIAKEWDLSIF

SEQ ID NO: 27641 - protein, 275 aa, Mycobacterium avium subsp. paratuberculosis K-10
MKSMQELFEIAWQATQIGATTLKKTQPSSVQHKGDRDLVSDVDLTIQRDIANYLSQTTPDVALLAEESDHQPDIETAEWLWVLDPVDGTSNFVHGLPLCAVSLALLHAGRTVVAVTHAPLLGKTYHAIESKGAFVNGERITASATDSLSGAIVSLGDYAVGHDAGRLNAHRLALTAELVPRAERIRMIGAATLDLAFVAEGALDACVMMSNKPWDTAAGTLIAREAGARLTDAQGNPHTHKSASTVVAAPGIAEQLATVIRNTEVPSDRYAAAVG

SEQ ID NO: 27642 - protein, 286 aa, Mycobacterium avium subsp. paratuberculosis K-10
MTVIDEIYSSSSAIPTVALNDEAKKPVLGLGVAKLSDEETESSVLAALEAGCRLIDTAASYGNEAAVGRAIAASGIPREELFVTTKLGTSRQGFHSAQESCKESLDRLGLDYLDLYLIHWPAPTLGKYVESFEGMIEARERGHVRSIGVSNFTEDLLATVIEETNEVPAVNQVELHPRLNQAELRQVHAQHDVTTQSYSPLGVGRLIEEPTVTTIAAEYGRTPAQVLVRWNLQLDNVVVSRSSKPERVAENLDVFDFTLEPEHMEAIEGLHDGTRVLHDPMTFMGT

SEQ ID NO: 27643 - protein, 333 aa, Ostreococcus tauri
MHARGTPSSQRNDGLEKENAQASSRGMKSATPPSGKTPGRSGLQSRTENASESGRGDEREATKEWTLDDFDIGKPLGKGKFGSVYLAREKRSKYIVALKVLHKSQLCASHVEHQLRREIEIQSHLRHPNILRLYGYFYDNTRVFLILEYAALGELYKELQRAKRFSERKSATYIASLARALIYCHKKHVIHRDIKPENLLVGIKGELKIADFGWSVHAPNSRRQTLCGTLDYLPPEMVEGRDHDYAVDVWSLGVLAYEFLVGTPPFEAEGHSETYKRILRVDLQFPSYVSENAKDLIRSLLVKEPAQRLPLSRLLDHPWIKENASPNGIPLPE

SEQ ID NO: 27644 - protein, 162 aa, Zea mays
MDPAAEPAAWPPWTSLLLRALSRRRTWVALFLAVYAGLLSSSWSLLASVRAWYYSASSASAAPAWPAALYASVMYGAVFGLLSMAAALAVAAPAMLVTWTTVLVLLAFAGRPRRSLVAEGRRATRDIAGLALRVLLREGNAVAALCAAASFAALLLGHRDHQ

SEQ ID NO: 27645 - protein, 172 aa, Campylobacter jejuni subsp. jejuni NCTC 11168
MNLSKIKIGDIPNKINAVIEIPYGSNIKYEIDKDSGAIMVDRVMASAIFYPANYGFIANTLADDGDPVDILVLNEYPIQAGAVIPCRLIGVLIMEDESGMDEKLLAVPNSKIDARYDNIKTYTDLPQATLNKIKNFFETYKILEPNKWVKVQDFKDEKAAIEILEKAIKNYK

SEQ ID NO: 27646 - protein, 579 aa, Schizosaccharomyces pombe 972h-
MSAKDYDFDIESVLPEEKAPQVSEAKKDYISQESTVLSGQVDFVEPEHKGFFQNLIDGFKPAREADGNGGPALKRGLSTRHMQLMSIGGAIGSGLYVGSGSALADGGPASVIINYILIGIMMFFVIYALGEMAVAYPVAGSFNTYATRFIDPAWGFAVSWNYFFNYFVTFPFELTTCAITFTFWTDVNCAVWISIFLVVVIGINLFGVRVFGEVEFVLALIKVVATVGFIILAIIINCGGVPTDHRGYIGGSIIKQKPFRHGFKGFCSVYTTAAFSFSGTEIVGLAAAEVGDPRKTLPGAVKQVFWRVAIFYIVSLILIGLLISPDDPKLMGNGSASVSPFVLAIQEANIKGLPSVFNAVIIISVISVTNSSTYTAGRTLHGMANLKQAPAFFKYTDRLGRPLIAMIVVLSFGFFAYINEANNNGNDISDTVFDWLLAISGLSNFFTWGSICLSHIMFRLAFKKQGHSLKELGFVSPMGIWGSVIGLGFNILCLMAEFYVSLFPIGGSPNANDFFQGYLAACITLVFFIGYKIYDRSHIPSLDKLDITTGLKTYEYEETKDSSDTGRFRFFKKIINTVC

SEQ ID NO: 27647 - protein, 937 aa, Ostreococcus tauri
MRRDHADDEALTAVKRGASLIKYCTNAKPHVVYATCTERGLTWVGKRRKEKTIAASAIARVIAGRHTEKFRRRRDGDADADADARSFSVVYEDGSGKASKTWDGVCESECQRDLWVRALERVMAEAREDAARRTSDDGGRREFEDARDGGISIGTAVRVSSAIGKFKVKSPSLREREIQREMEETRMRATARVCNVPNETVAWGWRADVTPESAVESVSGGGFAAKSERWTRVDAPSAIEGMETLDVVEISIGARHTLARTRTGAVYSWGEGKGGKLGIPSGQDFDRPTRVDLDGRAVALSCGSAHSVAVVEGEVFAWGDPNAAPGLLGLSDVRSVMWFPGKILFPSATGTLSAHRGARSLGGGGVKVVQVSCGPCHTACVTETGACYTWGEGSFFALGHGDRESSREPRKLETFTRERRVVLRVSCGVWHTAAIVAASGSSVVRVPVPTNEESEFDSVDGELFTWGDGETGQLGIRDSTEAPVPTKTSNRLGEPGSEVCSVSCGQHHTVALTSQGDLWLAGCVGKVDNSLRTTTFTRLTDFETGSVRTVASGENHVVASTRDARVFSWGVGKNGRLGLGRNDRDQPVPQEIVNMRGREVLHIACGPTSSACVLRGVQMTIKEKASMARLSTFSIRQSSMLRVSASIKPPERKNSSSNMETASTSTPNTAKDKNAQSGSAQSGSVRSGTTGTVGSGGRAKGSQQGLKSEKAVHRLLSVLSPTYENVAKTSNRTYLKESLVHNESLDNDLARSLPSPLIEPLAPRAATPELVEPTKLECREPSPAAAPPSPRPSPPPFTVVEAPQEALTEETFIQSARRVADEAEASLTHLAEERAVLERATQAAIAARGAERHTKPPSLRHKVPNPSRRSNVPIDEPKVFTEEVEEGVFMTLEVHGDKTILKRVRFSKRIFSNELARQWWEENRDRLTSDLDLTIPT

SEQ ID NO: 27648 - protein, 154 aa, Zea luxurians
AANPVYGKIPVLLLPDGRAICESAVIVQYIEDVARESGGAEAGSLLLPDDPYERAMHRFWTAFIDDKFWPALDAVSLAPTPGARAQAAEDTRAALSLLEVAFKDRSNGRAFFSGGDVAPGLLDLALGCFLPALRACERLHGLSLIDASATPLLD

SEQ ID NO: 27649 - protein, 259 aa, Bacillus halodurans C-125
MEGEEGMLHQFSRNELAIGHDGLERLKQSKVAVLGVGGVGSFSVEALARSGVGRIVIVDKDDVDITNVNRQIHALLSTVGRPKVDLMKERISDINPECEVIALKMFYTEETYEQFFSYEPDYVIDASDTITYKIHLMKECLKRNIPIISSMGVANKMDPTRLRIADISKTSYDPIAKVIRTRLRKEGIHKGIEVVYSDEQPIRIREDIRKEIVPEAAESGKIRKAKMPPSSNAFVPSVSGLFMAGHVISKLLDGIEIQR

SEQ ID NO: 27650 - protein, 812 aa, Zea mays
MGGGRAQVNKAHKSRFASKASRHTHKIDKVRSGKSETSHRADVKGARAARIQQSKAIRDKKRAALLKEKRSSTGPSSAPRVIVSILSFCFWILPDYSLFVVIIQLVLVGLSSSANVGSLAKDLLAFAEGDDRKLKLSTIASPTYKLRTTVLQAPYGDLTTCMELAKVADLLAFVLPANSFYSGDLNSPIDEFGSQCLSVFRAMGLPSTAVFIRLHNQDLPADNKSRQELKKAATSFLSAELPEDCKFYLADTKDDLHKFMWLFKEQHLSSPHWRNQRSYVMSEQVCINPDENTGLCTLLVSGYLRAHNLSVNQLVHVSGAGDFQLGQIDVLKDPCPLSERKSSDVMETEDNGIQIVNTFVPDPSSQEPLLVENVPDPLAGEQTWPTEEDMEEVDINNKQRKLEKRKLPQGTSEYQAAWIVEDTDDEDNDSDDDNQTESGMVIDEQGHSDQGSDGSDIDAVSHFTEKFDGETIGDTEMADEENLTKDQIEAEIKKIKEANADDEEFPDEVETPLDVPAKKRFAKYRGLKSFRTSSWDPKESLPLDYARIFAFDNFTRTQKHVFAKIAELDGGMKNCAQVGSYVRLYVKNVPTDIASKLCHPSRRIPVVVSGLLQHESKMSVLHFSIKKHDSYEAPIKSKEPLIFNVGFRQFTARPLFSSDNINCNKHKMERFLHHGRFSVASVYAPISFPPLPLIVLKNRDGEQPAIAAVGSLKSVDPDRIILKKIVLTGYPQRVSKLKSIVRYMFHNPDDVKWFKPVELWTKHGRRGRIKETVGTHGAMKCLFNSSIQQHDTVCMSLYKRAYPKWPEQLYHV

SEQ ID NO: 27651 - protein, 278 aa, Escherichia coli
MAISIKTPEDIEKMRVAGRLAAEVLEMIEPYVKPGVSTGELDRICNDYIVNEQHAVSACLGYHGYPKSVCISINEVVCHGIPDDAKLLKDGDIVNIDVTVIKDGFHGDTSKMFIVGKPTIMGERLCRITQESLYLALRMVKPGINLREIGAAIQKFVEAEGFSVVREYCGHGIGQGFHEEPQVLHYDSRETNVVLKPGMTFTIEPMVNAGKKEIRTMKDGWTVKTKDRSLSAQYEHTIVVTDNGCEILTLRKDDTIPAIISHDELVPRGSLEHHHHHH

SEQ ID NO: 27652 - protein, 351 aa, Streptococcus agalactiae A909
MRAATYLSANELSLTDKAKPQVIKPTDAVVRLVKTTICGTDLHILGGDVPACKPGTTLGHEGIGIVEEVGSAVNHFKVGDKVIISCVTACNTCYYCKHQLPSHCEDGGWILGHLIEGTQAEYVHIPHADGSLYHAPEGVCDDALVMLSDILPTSYEIGVLPSHIKPGDTVCIVGAGPIGLSALLTAQFYCPAKIIMVDLSQKRLEASKKFGATHTILSTSTQEVKEEIDKITKGRGVDVVLECVGYPATFDICQNVVSIGGHIANVGVHGKPVEFNLQDLWIKNITLNTGLVNANTTEMLLEVLETGKIDATQLVTHHFKLSEIEEAYKVFKAAEENNTLKVIIENDITPA

SEQ ID NO: 27653 - protein, 132 aa, Lactobacillus reuteri
IRQTVRFTTWDSNIQLSLAFIVNSLLLIMGVAVFKTGAVQDSSFFGLYDALNNTSMLSNPVLIAVAKSGVLSTLFAVALLASGQNSTITGTLTGQVIMEGFIHMRMPLWARRLVTRIISVIPVIACVAMTSG

SEQ ID NO: 27654 - protein, 471 aa, Arabidopsis thaliana
MESVKPLDVVSSGKGKLRRTFAKVINMKKLTGVVPEGNNKVERVKKSQEKVKLDKDLAKNAANLSESFDKLEEEYEKRLAMEALLAKLFATISSIKSGYAQLQYAQSPYDPNGIQKADNLVVAELKTLSELKQSFLKKQLDPNPDRTLVLAEIQELRSVLKTYEIMGKKLECQLKLKDSEIIFLKEKFQESMTQNKLMEKRLNQSGQLCNPLDHNLHLSAVSSTHFVTYLHHTVKSIRGFVKLMVEQMKLAAWDIDMAAELIQPDVLYYKQDHKCFALEHYVCKIMLEAFQLPYFSNESSKKTSREDKAMFFERFTELRSMKPREYLASRPKSRLAKFCRTKYLQLIHPKMEQAFFGHLHQRNQVTAGEFPETSLCTAFLEMAKRVWLLHCLAFSFDPEASIFQVSRGCRFSEVYMKSVSEEAFFSPEQEESSSETEPGVAFTVVPGFRIGKTTIQCEVYLSRSCQRRQSR

SEQ ID NO: 27655 - protein, 472 aa, Arabidopsis thaliana
MMESVKPLDVVSSGKGKLRRTFAKVINMKKLTGVVPEGNNKVERVKKSQEKVKLDKDLAKNAANLSESFDKLEEEYEKRLAMEALLAKLFATISSIKSGYAQLQYAQSPYDPNGIQKADNLVVAELKTLSELKQSFLKKQLDPNPDRTLVLAEIQELRSVLKTYEIMGKKLECQLKLKDSEIIFLKEKFQESMTQNKLMEKRLNQSGQLCNPLDHNLHLSAVSSTHFVTYLHHTVKSIRGFVKLMVEQMKLAAWDIDMAAELIQPDVLYYKQDHKCFALEHYVCKIMLEAFQLPYFSNESSKKTSREDKAMFFERFTELRSMKPREYLASRPKSRLAKFCRTKYLQLIHPKMEQAFFGHLHQRNQVTAGEFPETSLCTAFLEMAKRVWLLHCLAFSFDPEASIFQVSRGCRFSEVYMKSVSEEAFFSPEQEESSSETEPGVAFTVVPGFRIGKTTIQCEVYLSRSCQRRQSR

SEQ ID NO: 27656 - protein, 1023 aa, Neurospora crassa
MTRRDAEVKDRCDTGRESPSTDGTGKSIFHVKPPALAALRFLHLLHLALTCFASAATVTTPSLYRPIRGYRFQHLLSISHVPVQHFPEGIQSRIFVAATSGHTEQTQPGVFGCLQRLDHACLQGHAQPTRPDPTRTHHPDPPPTVHGSVKAPAVCNGIHSRRQNSEKTPLARGKDTDTHSDTLLHHGQAALETAIPRLPKPARQALPVSPWTVLMSGATAPRLQNVLSRPVLSSKRDAGRTSSHHLLKSLLLASRFAASTLVATTSSAGASRSTGTSSPDPGPTINKSQTNRNPSTYTSPPNSLSRTFSASNLLAWYRTLPSPYFNLSGHLDDLSSLIRPFLAFLDPSSLSSPYSMASTSYAFSTSSGSDFSTPRSSSPHSSASVASARSSHSSTFSAGKRLSMSSVRRTSASNPMSSVDLSTIEEALKMANLDTLKGYCQKTYGEVHQETTTEYISQEEARGYQVLNQPHWNKVADFRISPKGTSFTPEERVAKNLTGLIPHVMEDSEKQVERALKMIRTRQTDIDRYLYLSTIKSQNVDLFYRLLMDHAKEMMPLVYTPTIGDVCLQYSTLYTRPEALYISIKQRKSIRTILRNWPYPQPEICVVTDGSRILGLGDLGVNGVGIPIGKLALYTAAAGIHPDKTLPIVLDCGTANETNLKDPLYLGLRQKRIPVAEQQEFMDEFMEAAAEVFPDMVVQFEDFESEKAFNYLDRYRDQYKCFNDDIQGTGAVVLAGYIGAVNLSNVPIEEQRLVFMGAGSAGVGVAKQLVEYYTKRGLSEQQAKDKFWLVDTKGLVTKDRGDKLAEHKKYFARTDNNGHQFRTLEEVIEYVKPSALVGLTATHGVFTESVVRALKASVDAGGLGRRPILFPLSNPLTKAECTFKEAIDWTDGTVLFASGSPFSSYTTNGVTYHPNQGNNVYVFPGIGLGAILAKATRVTDDMIYTSAAALANSLNADEVKQGLIYPRIDRVREASVIVAREVMKSARREGVSTLPEEQWLEWEEWGDVDLERYIKQHIYDPKF

SEQ ID NO: 27657 - protein, 523 aa, Arabidopsis thaliana
MAAMNIVDFQNCFFFVLLSLFSLLCYSLFFRKPKEPRLHYDLPPSPPTLPIIGHLHLLLSVLVHRSLQTLSTKYGSILYLRVFSFPVALVSSASIAYEIFREHDVNISSRGFPPTDDSLFAGSFSFTSAPYGDYWKFMKKLLVTNLLGPQALERSRGFRADELDLFYENLLDKAMKKESVDICVEALKLSNNSICKMIMGRSCSEENGEAERVRALATQLDGLTKKILLANMLRAGFKKLVVSLFRKEMMDVSSRFDELLERILVEHEDKLDMHHQGTDLVDALLAACRDKNAEYKISRNHIKSFFADLLFASTDTFVQTTQWTVAEIINNPNVLERLRGEIDSVVGKARLIQETDLPNLPYLQAVVKEGLRLHPPGPLFARFSQEGCRIGGFYVPEKTTLMINAYAVMRDSDSWEDPDEFKPERFLASSRSEQEKERREQAIKYIAFGSGRRSCPGENLAYIFLGTAIGVMVQGFEWRIKEEKVNMEEANVGLSLTMAYPLKVTPVPRTLVPLTQNPLNRSS

SEQ ID NO: 27658 - protein, 673 aa, Cryptococcus neoformans var. neoformans JEC21
MAQSADSACGPSNMVGSVHLADVQGVSREINPYDRNGMFVGAHTICRMFPSSLVPSFTHPAIVFQRPTPPPLAVPSSVQHASSATNSLSASQASQATSVLTDDEEDLEDYRPGGYHPVNIGDEFNNGRYRIVRKLGWGHFSTVWLARDNVANRHVALKVVKSDGHYTETALDEIQLLQRVVSSAPGHAGRHHVLDLLDSFRHTGPNGSHVCMVFEVLGENLLGLIKRYQHRGVPQHIVKQIAKQVLLGLDYLHRECRIIHTDLKPENVLICIDDVESVVQAELASCPAAVPTKLVGVPPSQGRLGNQTPRKDGIFIVGSQPLPSPSSSYSSSPMLDKYGFGMSKISGASAAKAGNQPSGVGGPSYPPTQPKKSATTEAIGTDLENVKLGEGSSLKWEKTATPAPAPPKGPSLLSQQLHHPPASPPLNPSVPSGSASVSTNHTINTATDETEVSTPATTPDHVTRLSDERAPEAGDPTTLPPPFPYDPVSLERITVKIADLGNACWVDHHFTNDIQTRQYRCPEIILGTRWDESVDMWSAACLFFELLTGDYLFDPQPGVKYDKDDDHIAQIMELLGEMPRSLALSGKYSHEIFNRRGELRHINRLRFWPLTSVLKEKYLMEHEDAELLSSFLMPMLAYLPGQRAKASDLLNHPWLEGVVVQGELEMAQSLHKS

SEQ ID NO: 27659 - protein, 225 aa, Shewanella sp. MR-4
MRPFLIAPSILSADFARLGDDVKAVLDAGADVVHFDVMDNHYVPNLTIGPMVCKALRDYGITADIDVHLMVKPVDRIVPDFAKAGASIITFHPEASEHIDRTLQLIKESGCKAGLVFNPATPLHYLDHVMDKLDVILLMSVNPGFGGQSFIPSTLDKLRQVRERIDASGFDIRLEVDGGVKVDNIAEIAAAGADMFVAGSAIFGKRDYKAVVDEMRAELAKVEVK

SEQ ID NO: 27660 - protein, 681 aa, Silicibacter pomeroyi DSS-3
MGENQVVTVRRDGDIAWVEIDSPPVNATSTPVRAGLARAVAEVQGARVAILTCAGRTFVAGGDMTEFDRPAEEPHLPDVVQMIEDSETPFVAAMHGTVLGGGFEIALACAWRIAAPGTKFGLPEVNVGLIPGAGGTQRAPRLIGMMAAIDMACSGKMLDAAQMLALGGLDQVAEGDLRAAAQGFAKGLPPRPEKTRLRQVQALNSEALAEAKRALSKAAKGRAAPLHNLDALQWAALPFDQGQPRERALHLGLRQSDESRALRYAFFAERLVARPDAIAGVTPRELTRVAIVGGGLMGAGVAMACLGGGLSVTVIERDAAAAQAAQERVAGLVAAGVKRGKISPDAQADMLARLATTDTYADASDADLAIEAVFEDLDVKRIVFADLAAVMRPDAILATNTSYLDPQLVFAGIANPARCLGLHFFSPAHVMKLLEIVKTPDTAPEVLATGFALGKRLRKISVLSGICDGFIGNRMLAAYRREAEYLLADGALPHEVDAAMRAQGLPMGPFELQDLTGLQIAWANRKRQAATRDPAERYERIADMLCEMDRLGQRSGKGWYRYAEGSRSPERDPEVETLIVDYSAKRGITRRPFSAEEIAQRLLAVLANEGARIVSEGIAERAEDVDMVQLHGYGFPRHRGGPMHLAQSQGWEKSMEIMELVASESPDSWVLAPRGDPSAEI

SEQ ID NO: 27661 - protein, 157 aa, Robiginitalea biformata HTCC2501
MKLILLAVGKTDAGPLEALIADFERRLNHYIPFEIGIVPDIRTKGKVKPEQLKEKEAEAILRALHPQDALWLLDEKGREYSSRGFAGQLQKCMNAGPKRLVLVIGGAYGFSEGLRTRADRTVSLSKMTFNHQVVRLLAVEQLYRAFSILRGDPYHND

SEQ ID NO: 27662 - protein, 412 aa, Oryza sativa Japonica Group
MAGLPFLLALHIALLLLLPCSCQVGDSCSSARDCGAGLYCGNCAATGKTRPSCIRDLAIQPTSIVKGLPFNRYSWLVTHNSFSIIGEPSHTGVERVTFYNQEDTVTNQLRNGVRGLMLDMYDFNDDIWLCHSLQGQCYNFTAFQPAIDTLKEVEAFLSENPTEIITIFIEDYVHSTMGLSKLFTAADLTKYWYPISEMPTNGKDWPSVTDMVAKNHRLLVFTSDSSKEASEGIAYQWSYLLENESGDPGITGSCPNRKESQPLNSRSASLFMQNYFPTIPVENEACKENSVGLPQMVQTCYTAAGNRIPNFIAVNYYMRSDGGGVFDVQDRINGVTLCGCNTIAACQAGAPAGACKDTGAPNRTSSSVNGNVYSGTIEFKSPASAASISNANIPSKFVGLLLLGLVLIIKPF

SEQ ID NO: 27663 - protein, 282 aa, Oceanicola granulosus HTCC2516
MTGTLLSLGHGYSAAALARLLMPRGWRVIGTTRSPEKAERLAADGVEPVLFPGTDLAPHLAAATHLLASAAPGDDGDPFLAALDLADQTFDWVGYLSTTGVYGDRAGGWVDETSELAPSTRRGRQRVAAEQAWRETGLPLHVFRLAGIYGPGRGPFAKVRGGTARRIVKPGQVFSRIHVDDIAQVLAASIARPNPGAVYNVCDDDPAPPQDVIAEAARLLGLPLPPEEDFETAEMTPMARSFYAESKKVRNDRIRDELGVALHYPDYRSGLRALLAAEDQPK

SEQ ID NO: 27664 - protein, 254 aa, Robiginitalea biformata HTCC2501
MKQPKDLFSEQAADYRRFRPSYPANLLEDIIALVPDRQRALDCATGNGQVARALSPYFQQVNAIDISEEQLRQAPSAPNITYSRQRAEATGFANGTFDLICVAQAIHWFDIPAFHNEARRLLKPGGVLAVWGYGLLKTDPETDAWLDRYYRQVVGPYWEPERRYVEAAYANLPFPWEEIEMPGPYSIRREVALEDIAGYLYSWSATRHLLHTERDPVPEWMDQLAARWIPGSTREARHEIFLRAGRADVPDGDG

SEQ ID NO: 27665 - protein, 352 aa, Triticum aestivum
  misc_feature (178)..(178): Xaa can be any naturally occurring amino acid
  misc_feature (200)..(200): Xaa can be any naturally occurring amino acid
  misc_feature (226)..(226): Xaa can be any naturally occurring amino acid
  misc_feature (264)..(264): Xaa can be any naturally occurring amino acid
  misc_feature (289)..(289): Xaa can be any naturally occurring amino acid
  misc_feature (298)..(298): Xaa can be any naturally occurring amino acid
  misc_feature (308)..(308): Xaa can be any naturally occurring amino acid
MASRILLPALLLLLLCAHCGGAAGRRARGGGEASSQVKFDFSPFLIEYKSGVVKRLMGTDRVSAAADPLTGVTSRDVTIDPAAGVDARIYLPSLRATTKVPVLVYFHGGAFVVESAFNPIYHAYLNTLAAKAGVVAGSVNYRLAPEHPLPAGYEDWGPGLKGVVRQAGPGAQQGLAPXGNLSRLFLGGERGGGKIGHNLXIFPAGKEGLDGGARLKGVALLDPYFXGRSAVGAYSADPSFLQSAARTWSFICAGKYPIDHPYAXNPLMLPTASMAATSAPPRVLVTVSXRDRVSPWQXRAYYSTLRSXSGWPGQAELYEPPGEGPVYFLTKMSTPQAQAEMATLVAFINRAD

SEQ ID NO: 27666 - protein, 310 aa, Schizosaccharomyces pombe 972h-
MKIIIDTDPGQDDAITALLAIASPEIELLGVTTVAGNVPVSMTTRNALQMLDLAGRPDIPVYAGSNKPLLRAPITATHVHGASGFEGAVLPPPSRKENEGHAVDFIIDTLRNNEPGTITICTIGPLTNIALALNKAPEVIQRAKQIVMMAGAFSEVGNITPAAEFNIYVDPHAAQMVLSSGIPIVMMPLDITHQLHTSAKRIARMEALPNRVGPVVAAWLRMEKAYEAKKYGTDGGPLHDPNTVMWLLRPDIYSGRKVNVQIETQSELTMGMSVVDWWQVGLLPANVTFLRTVDDDEFYEVLIERLGRLP

SEQ ID NO: 27667 - protein, 157 aa, Musa acuminata AAA Group
VSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 27668 - protein, 704 aa, Oryza sativa Japonica Group
MRGGGFVNEMRHTGKRPQQHRDHDREERRDQKRRPVPRAQENSGNDELVVYRILCPDRVIGNVIGKNGKVINSIRQQTSAKVKVVDPHPGADKRVILVYCFVKHRNLDVNDDDDREPVCTAQDALLKVHDAIVDALSITRDSDDEEANILVPASQSASVIGKSGAVIKRLRSTSKAFIKVSPKDPNEVTHSCAMSFDNFVQITGDARAVRKALFAVSTIIYKCPSKETIPLETSVSDLPPSIIVPSELPVYPSSNFYSPSDAAISSGHPSLSILGSTPHVPELTVSADAHSRLPIYQSVLPVIPAYNTPKCSGELVLRVLCPAGKIGLVIGKGGVTIKSIRKESGARIDVDDSKNDREESIITITSNEATDDAKSAAVEAVLLLQSKINDDNEGKVIGCLIGKGGSIVNDMRSKTKAAIYISKGEKPRKASSSDELVEVFGEVENLRDALVQIVLRLRDDVLRDSVDRQNSEKDGKLTVATTDPLYASSYPLPALLPYRQQITPLGYDHRGDIERGLEVYPHSSLYGYSSLQAIDDGYSAVSSYASKGYGGRPPHMEMTIPASGLSKVMGKHGTNLDNIIKMSGIRMFCILEDKFQRFSSEMQNMWSCWLLLILFWALAGIGGGMSVDIDASGRKSTGKGVYQFVDKYGANVDGYSPIYSPEEWSPTGDTYVGGTTGLLIWAVTLAGLLGGGALLVYNTSALAG

SEQ ID NO: 27669 - protein, 520 aa, Lilium longiflorum
MSRHESRKLSDDYEVVDVLGKGGFSVVRRGISKSRGKNNDVAIKTLRRYGYTLPGAQRSQPGQRGLSPLGMPTLKQVSVSDALLTNEILVMRRIVEDVSPHPNVIHLHDVYEDANGVHLVLELCSGGELFDRIVAQDRYSESEAAEVVQQIASGLAALHKSTIIHRDLKPENCLFLNQEKRSTLKIMDFGLSSVEDFTDPIVALFGSIDYVSPEALSQRQVSSASDMWSLGVILYILLSGCPPFHAPSNREKQQRILAGDFSFEEHTWKTITSSAKDLISSLLSVDPYKRPTANDLLKHPWVIGDSAKQELIEPEVVSRLRSFNARRKLRAAAIASVLSSKVLLRTKKLKNLLGSHDMKSEELENLRAHFKRICANGDNATLPEFEEVLKAMKMNSLIPLAPRVFDLFDNNRDGTIDMREILCGLSNLRNSQGDDALQLCFQMYDADRSGCISKEELASMLRALPEDCVPADITEPGKLDEIFDQMDANSDGVVTFDEFKAAMQRDSSLQDVVLSSLRTI

SEQ ID NO: 27670 - protein, 756 aa, Haemophilus influenzae R2846
MSEQLRQAALDFHEFPIPGKIEVTPTKSLATQRDLALAYSPGVAEPCLEIEKDPAASYKYTARGNLVAVISNGTAVLGLGNIGALAGKPVMEGKGVLFKKFAGINVFDIEVNEHDPDKLVDIIASLEPTFGGVNLEDIKAPECFYIEQKLRERMNIPVFHDDQHGTAIISAAAIINSLRIVGKKIEDVRLVASGAGAASIACLNLLLSLGMKRENITVCDSKGVVYKGRDDKMDQTKKDYAIEDNGWRKLGDAIPNADIFLGCSAAGALTQDMVKSMAAHPIILALANPNPEITPPEAKAVRPDAIVCTGRSDYPNQVNNVLCFPFIFRGALDVGATTINEEMKRAAVYAIADLALEEQNEVVTSAYGGEGATFGGDYVIPRPFDPRLIVRIAPAVAKAAMESGVATRPIQNWDAYVEKLTQFVYKTSLFMRPIFSQAKSAKQRIILAEGEENKALHATQEVISMGLANPILIGRRSVIEEKIKKLGLRLTAGVDFEIVDNEDNPRYEECWKHYYELTKRKGITPAIAKRVVRSNTTVLASTLLSLGYADALVCGLFGSYGKHLASIRDIIGLKDGVKTAAALNSLVLPTGNVFLTDTHVNSNPTAEELAEITLMAAEEIHRFGIEPAVALLSHSNFGSSDSLGAPKMREVLQIVKEHNPHLMIDGEMRGDLAMNEAHRKELMPDSPLKGSANLLVFPDLSASRISYSLLRGTTTAITVGPILMGMNKSAHILNPGASVRRIINMIAYAAVKAQQE

SEQ ID NO: 27671 - protein, 161 aa, Musa acuminata AAA Group
SSMMVSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDK

SEQ ID NO: 27672 - protein, 527 aa, Pisum sativum
MEYGTRKLSDVYEVSEILGRGGFSVVRKGTRKSNNDDEKSQSQSKSQSQSQVAIKTLRRLGTSNNLPRKKDGGENSTETMMKFPTMRQVSVSDALLTNEILVMRRIVENVSPHPNVIDLYDVYEDTNGVHLVLELCSGGELFDRIVAQDKYSETEASTVVHQIVAGLEAIHRANIIHRDLKPENCLFLDVGKDSSLKIMDFGLSSVEEFTDPVVGLFGSIDYVSPEALSQGKITTKSDMWSLGVILYILLSGYPPFIAQNNRQKQQMILNGNFSFYEKTWKGISQSAKNLISSLLTVDPAKRPSAQELLSDPWVKGEKAKDDQMDPEIVSRLQRFNARRKLRAAAIASVWSSTIFLRTKKLKSLVGSYDLKEDEIENLRMHFKKICADRDNATLCEFEEVLKAMKMPSLIPFAARIFDLFDNNRDGTVDMREILCGFSSLKNSKGEDALRLCFQMYDTDRSGCITKEEVASMLRALPYDCLPTDITEPGKLDEIFDLMDANSDGKVTFDEFKAAMQRDSSLQDVVLS

SEQ ID NO: 27673 - protein, 501 aa, Saccharomyces cerevisiae
MSHRIAPSKERSSSFISILDDETRDTLKANAVMDGEVDVKKTKGKSSRYIPPWTTPYIIGIGGASGSGKTSVAAKIVSSINVPWTVLISLDNFYNPLGPEDRARAFKNEYDFDEPNAINLDLAYKCILNLKEGKRTNIPVYSFVHHNRVPDKNIVIYGASVVVIEGIYALYDRRLLDLMDLKIYVDADLDVCLARRLSRDIVSRGRDLDGCIQQWEKFVKPNAVKFVKPTMKNADAIIPSMSDNATAVNLIINHIKSKLELKSNEHLRELIKLGSSPSQDVLNRNIIHELPPTNQVLSLHTMLLNKNLNCADFVFYFDRLATILLSWALDDIPVAHTNIITPGEHTMENVIACQFDQVTAVNIIRSGDCFMKSLRKTIPNITIGKLLIQSDSQTGEPQLHCEFLPPNIEKFGKVFLMEGQIISGAAMIMAIQVLLDHGIDLEKISVVVYLATEVGIRRILNAFDNKVNIFAGMIISREKLQNHQYKWALTRFFDSKYFGCD

SEQ ID NO: 27674 - protein, 326 aa, Staphylococcus aureus subsp. aureus Mu50
MIEKSQACHDSLLDSVGQTPMVQLHQLFPKHEVFAKLEYMNPGGSMKDRPAKYIIEHGIKHGLITENTHLIESTSGNLGIALAMIAKIKGLKLTCVVDPKISPTNLKIIKSYGANVEMVEEPDAHGGYLMTRIAKVQELLATIDDAYWINQYANELNWQSHYHGAGTEIVETIKQPIDYFVAPVSTTGSIMGMSRKIKEVHPNAQIVAVDAKGSVIFGDKPINRELPGIGASRVPEILNRSEINQVIHVDDYQSALGCRKLIDYEGIFAGGSTGSIIAAIEQLITSIEEGATIVTILPDRGDRYLDLVYSDTWLEKMKSRQGVKSE

SEQ ID NO: 27675 - protein, 205 aa, Triticum aestivum
  misc_feature (28)..(28): Xaa can be any naturally occurring amino acid
  misc_feature (100)..(100): Xaa can be any naturally occurring amino acid
PGIYLHSTPLAPPVMACSATSVGPFQGXLKSTAGLPVTRRSNGASLASVSHGGRIRCMQVWPIEGIKKFETLSYLPPLSTEALLKQIDYLIRSKCVPCLXEFSKVGFIFREHNASPGYYDGRYWTMWKLPMFGCTDATQVINEVEEVKKEYPDAYVRIIGFDNMRQVQCTSFIAFKPPPPEEKAPPSPAHSRQAIYKVPLQFCQL

SEQ ID NO: 27676 - protein, 193 aa, Physcomitrella patens subsp. patens
LEFDYTDGPHGPASWGCLNTSWRTCSDGMVQSPIAIIPQIIVTSKKFKDLEVDYPHHAVPANISNNGHSVALKIPDGSVELSIKGEKYRSTQMHFHCPSEHTFVKYKFALEAHLVLISAAGKIAVVAWLITLGPVSPFFDQFINNLPAYKEEYPLASPIKLLPIHAEHYGRYTGSLTTPPCTENVVWTVLLWN

SEQ ID NO: 27677 - protein, 406 aa, Oryza sativa Japonica Group
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 27678 - protein, 672 aa, Oryza sativa Japonica Group
MASHANASGGGGDEEMVEASTLRHRHGAGKDANGVGTERQLAAAAAEGEEEGPSSVERAFVDRAVPSWREQLTVRAFVVSFFLSIMFSIIVMKLNLTTGIIPSLNVSAGLLGFFFVRLWTAAIERVGLLRQPFTRQENTVIQTCVVAAYGIAFSGGFGTYLFGMSETIAKQATEANNAQNVKNPHIGWMIGFLFLVSFIGLLALVPLRKIMIVDYKLTYPSGTATAYLINGFHTPEGAKLAKFYFDFSPTYVGVGMICPHIVNVSVLLGGILSWGIMWPLIRNKKGSWYAASLSETSLHGLQGYRVFISIALILGDGLYNFVKVLIRTTAGFVVMMKKNSTLPVSNNGSPMVATEAISFDDERRTELFLKDQIPKTVAFGGYVAVAAVSIGTLPQIFPQLKWYYILVAYVFAPVLAFCNAYGAGLTDWSLASTYGKLAIFIFGAWAGASNGGVLVGLAACGVMMSIVSTASDLMQDFKTGYLTLASPRSMFVSQVIGTAMGCVIAPCVFWLFYKAFADIGVSGTEYPAPYAIVYRNMAILGVDGFSSLPKHCLTLCYIFFAAAIAINLARDLAPSKVARFIPLPMAMAIPFYIGSYFAIDMFIGTVILFVWEMVNKAKAEAFAPAVASGLICGDGIWTLPQSILALAKVKPPICMKFLSRSVNAQVDGFLGN

SEQ ID NO: 27679 - protein, 180 aa, Taxus x media
MRYSLLAGGKRVRPALCIAACELVGGSQDLAMPTACAMEMIHTMSLIHDDLPCMDNDDFRRGKPTNHKVFGEDTAVLAGDALLSFAFEHIAVATSKTVPSDRTLRVISELGKTISSQGLVGGQVVDITSEGDANVDLKTLEWIHIHKTAVLLECSVVNGGILGGATEDEIARIRRYAPVC

SEQ ID NO: 27680 - protein, 182 aa, Mycobacterium leprae TN
MAHCDFVTNSLIQNATATLHTNRGDIKVALFGNHVPKTVANFVGLAQGTKEYSTQNASGGPSGPFYDGAVFHRVIQGFMIQGGDPTGTGRGGPGYKFADEFHPELQFDKPYLLAMANAGPGTNGSQFFITVGETPHLNRRHTIFGEVTDPDSQKVVDAISTTATDGNDRPTEPVVIDSITIS

SEQ ID NO: 27681 - protein, 720 aa, Oryza sativa Japonica Group
MNMSPRIPVVDLEDGWRDVLAGVAKLKCILDGSNVVHFVPDEYMHLYTTVYNMCTQKPPNDYSQVLYDRYKQALDDHIESVVLPSLNEKHGVFLLREIVQRWEKHKLMVRWLRRFFDYLDRYYVTRRSLDSLKDLGWSSFRDLVFDKLKSTVATIMIGMIDDEREGNLIDRPLLKNALDIYVEIGDSQLNYYSDDFEQSFLNGTTDYYSKKAQTWILENSCPEYMLKAALFELIDRRAEEILNKENSGCKVLLCDEKTEDLARMFRLFSRITDGLLPVSKIFKEHVIAEGMSLLKHATDAANSRKDEKKGVVVGLPEQDFVRSVIELHDKYMAYVTNCFQSNSVFHKALKEAFEVICNKDVVGCSSAELFAAYCDSILKRGGSEKLSDEAIDESLEKVVKLLTYLSDKDLFVEFHRKKLGRRLLFDKNTNDEHERILLSKLKQFFGGQFTSKMEGMLKDITLAKEHQSSFEEYVSNNPESNPLIDLNVTVLTTGYWPTYKNSDINLPLEMVKCVEVFKEYYRSDKQHRKLTWIFSLGNCVVIGNFDAKPVEFVLNTYQAALLLLFNEADKLSYSDIVSQLKLSDDDAVRLLHSLSCAKYKILNKEPSNRVISPEDEFEFNSKFTDRMRRIKVPLPQIDEKKKVVDDVNKDRRFAIDASLVRIMKSRKVLGHQQLVAECVEQLSRMFKPDIKIIKRRIEDLISREYLERDSENAQTYKYLA

SEQ ID NO: 27682 - protein, 496 aa, Thermotoga maritima MSB8
MKCSLGLEKCPDDTLRCFPKIEQPFGIVIFGASGDLTKRKLIPALNRLFEAGILPERFFVLGAARTKMDDKKFRSRFDANPDFLEHCSYISVDYQDPESFKQLKNTIETLIKRIDSSNLVFYLAVPPDLYIPILENLSKTGLNEKPARVVIEKPFGKDLESARRLEDTLQKYFQEDQIFRIDHYLGKETVQNILVFRFANFIFEEIWNNKFVDHVQITMAEDIGVEHRAGYFENVGLLRDIFQNHMLQILALIAMEPPSSFNGENFRNERVKLLRSIRPFPVEELESWIVRGQYGRGVVNGKEVPAYREEPGVAKDSNVETFVAMKLFIDNWRWSGVPFYLRSGKRLPKKITEVAVVFKKIPHSIFAGVPSDELEPNTIVFTLQPNEGISLEFQVKRPCPGMFPQLLSMDFRYEDYFGVKLPDAYERLLLDVILGDPTLFMRRDDLEVSWELLDPVLKAWENDPVRFSPYVYPAGTWGPREADLLIERDGRKWRKL

SEQ ID NO: 27683 - protein, 246 aa, Pseudomonas putida
MSLQGKVALVTGASRGIGQAIALELGRQGATVIGTATSASGAERIAATLKEHGITGTGMELNVTSAESVEAVLAAIGEQFGAPAILVNNAGITRDNLMLRMKDDEWFDVIDTNLNSLYRLSKGVLRGMTKARWGRIISIGSVVGAMGNAGQANYAAAKAGLEGFSRALAREVGSRGITVNSVTPGFIDTDMTRELPEAQREALQTQIPLGRLGQADEIAKVVSFLASDGAGYVTGATVPVNGGMYM

SEQ ID NO: 27684 - protein, 245 aa, Bacteroides thetaiotaomicron VPI-5482
MDYPQQHIKPYNEDGKKTEQVERMFDNIAHAYDKLNHTLSLGIDRSWRRKAIAWLRPFRPQHIMDVATGTGDFAILACRELNPDELIGTDISEGMMNVGREKVKKEGLSDKISFAREDCTSLSFADNRFDAITVAFGIRNFEDLDKGLSEMCRVLKPGGHLVILELTTPDRFPMKQLFAIYSKVVIPLLGKLLSKDNSAYHYLPDTIKVFPQGEVMKGVISKTGFGEVHFRRLTFGICTLYTATK

SEQ ID NO: 27685 - protein, 224 aa, Arabidopsis thaliana
MAGSLSTGDFHIRKKPRLEKFSSESSYGYTFRELRRYDPYDDEYVRQYILYYQYHKSEGFVIDWDKLDFRFETRPIMDPFRLDVCSTNDEMIHGVALRAITQHNGSRIELVDHVSASYRWCAGILYWVTFLARDLASSDPEPRLYQAKVRLCGPTFCQIYIFRLRPTDEEIAAVQVDPPPPLYDDDPELPTILFTVTGPGSGYMSIPEVFFTRIPAEVEPVSSP

SEQ ID NO: 27686 - protein, 357 aa, Silicibacter pomeroyi DSS-3
MARFHDLEVTDIHKTIRDAVVVTLKPANGAASEFDFTQGQYLTFRRAFEGEELRRSYSICSGKDDGVLQIGIKRVDGGAFSTWANEELKVGDTVQAMPPMGGFHTPLDPGAEKQYLGFAGGSGITPVLSIIKTTLAREPRSQFTLVYANKGVNTIMFREELEDLKNLYMGRFNVLHILETDAQEIELFTGLVTEEKCGQLFEHWIDIQHVDTAFICGPEPMMLGIAAALRAHGLSDAQIKFELFASAQPGRAKRKAVSSEAAKGANQTRAAITLDGATQSFDMPKDLSILDAALQNSLDAPFACKAGVCSTCRCRVLEGEVEMVANHALEDYEVEKGYVLSCQAYPLTDTVVVDYDQ

SEQ ID NO: 27687 - protein, 382 aa, Haemophilus influenzae R2846
MAKKDYYEVLGLQKGASEDDIKRAYKRLASKHHPDKNQGSKEAEEKFKEINEAYEVLGDDQKRAAYDQYGHAAFEQGGGTGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKTCRSCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVTSTRSGYAGDLICRIVVETPVNLTSEQKELLQKLEESLQGKDLSKHAPKSSGFLDGVKKFFDNLGKSDK

SEQ ID NO: 27688 - protein, 448 aa, Arabidopsis thaliana
MGSCLSSSGGGGSRRSLHGSPHVPGPGRRKRPPKRRPGSCSSSFDNTEEPLLHRIPERMFLNGSTDTVSLFSQQGKKGPNQDAMIVWENFGSMEDTVFCGVFDGHGPYGHIVAKRVRDLLPLKLGSHLESYVSPEEVLKEISLNTDDRKISEDLVHISANGESRVYNKDYVKDQDMIQMLIGSIVKAYRFMDKELKMQVDVDCFCSGTTAVTMVKQGQHLVIGNIGDSRAVLGVRNKDNKLVPFQLTEDLKPDVPAEAERIKRCRGRIFALRDEPGVARLWLPNHNSPGLAMARAFGDFCLKDFGLISVPDVSYRRLTEKDEFVVLATDGIWDALTNEEVVKIVAKAPTRSSAGRALVEAAVRNWRWKFPTSKVDDCAVVCLFLDSEPNRLSTASFSKEKHINNGVTEPEPDTASSSTPDSGTGSPELNGVNRIDTLVNLPVYVPTKE

SEQ ID NO: 27689 - protein, 985 aa, Oryza sativa
MTRVIHDSGEGMQKEALAMVSSDVNFPKGHFPDYKIGPNNQIIDPEEIHEAVPLKEIVAKETAQLLEQRRRLSVRDLKEKFEKGLSGASKLSEEAKRREAASLDRQVLLKKLRDVLDTLKGRVAGRNRDDADEAISLVEALAVQLTQREGELIYEKAEVKKLASFLKQATEDARKVAEEERALALAEIEKARTAIAIVEKGLQEHDAASSSREKEEIEGLRKEVREARRIKMLHQPSKVMDMEFELKALRTLIAEKNQLCNQLMKELAMIKRLEEDSSDLYDLEGSDILGSQFCIIPRFDDAPDISSCPTQWYRVISGGNRNLILGATKPTYAPEPFDVGRLLQAEIVLNAEKVTIQTMGPINPAAGLEHYVESLMKRADVEFNVVVTQMNGNDYSSNSVHAFHIGKMRIKLRKGWSTKARESYSTTMKLCGSRGGGNAAATAVFWQARKGLSYTLAFETDRDRNAAIMLARKFASNCNITLTGPGDEVHAELAGAAVAAALDGGEEGSRAARLHSFFASVISGIFGQGEEEEEGEMATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 27690 - protein, 423 aa, Schizosaccharomyces pombe 972h-
MEYLTNLKTNIMDKQLGHREVSEGSTQPKPDPSGATMKACVWDGPLNVKIAEVPKPTITHPKDVIVKTTACTICSGSDSHIFSGEMPGIEKGAILGHESCGIVAEKGDEVNNLEIGDRVVIAFDLACGQCSFCKRHEYAACDTTNDSKLMDVNYGSHHSAIFGYTKLLGDVPGCQAEYIRVPFAEINCCKLPDDIPDSEGLFMSDVLCTSLHACTLGEVKKGDTVAIWGMGPIGLYAGRWAQILGASKVIGIEVVPERIELARQKFGFTVIDRNEVSDVPKKIMELVSNGVDCAIEASGFRFSTSILHKVERAVGLETDSPDMITECLNAVRKYGHVSIIADYVGTSNQFPIGHVVMKHLTIRSGQCPCQNYFGYVIDNIRSGKIDPRWMVTNKIKFDDLPDAYNKLFYKEDGYVKVYCDMTE

SEQ ID NO: 27691 - protein, 413 aa, Synechococcus sp. WH 5701
MTSLLLDIVVIFTMSAVAVVLCHRFSIPSSIGLLLAGVLAGPDLFRLVQNVHEIELLAEIGVVLLLFVIGLEISLADVARLSRHFLIGGSLQFFGTAALVGAICMGLGLSPGQGVYVGFVVALSSTAIVLRMLQERAELETPHGRTTLAILIYQDVGVVPVMLIAPLLAGVGSASGGGTIAALLGRIALVALVAWLAWRWIVPWLLERITRTRSSEAFLLGVFSLCVGIAMMTQSLGLSLALGAFLAGFILSESEYSHQAVAVMLPFRDVLMSLFFVSIGMLLDIQFMLAHPLSLLLLTLGVVLVKPLVAAGSALVVGLPLGGSVLTGLALAQVGEFSLVATKAGVSTGLLGPDIFQTVLDVAVLSMMLTPALVACGPGLAAWVATTPPCGGWSAAAWCRSAPAAPMASAVTS

SEQ ID NO: 27692 - protein, 191 aa, Saccharophagus degradans 2-40
MAKSIGTLLAVSSVVAIAAVFSQVGLVSQTIADEINAEPDMSMTVAQAQQLVARGENLTSIPKHIWRQLLTKHEYNIMWEKGTERAFTGDLLEVQQPGVFVTAGCKLPVFKTEHKFKSGTGWPSFWDVVDKNNIILKDDSSWGMRRIEVLSACGEHLGHVFDDGPEPTGLRYCINSAALDFIAADTAEPEE

SEQ ID NO: 27693 - protein, 232 aa, Saccharomyces cerevisiae
MSLFEWVFGKNVTPQERLKKNQRALERTQRELEREKRKLELQDKKLVSEIKKSAKNGQVAAAKVQAKDLVRTRNYIQKFDNMKAQLQAISLRIQAVRSSDQMTRSMSEATGLLAGMNRTMNLPQLQRISMEFEKQSDLMGQRQEFMDEAIDNVMGDEVDEDEEADEIVNKVLDEIGVDLNSQLQSTPQNLVSNAPIAETAMGIPEPIGAGSEFHGNPDDDLQARLNTLKKQT

SEQ ID NO: 27694 - protein, 480 aa, Bordetella petrii
MSVLRRTKIVATLGPSTSTPAQLEALVRAGVDVARLNFSHGTADDHRERARLVREIAAKQGRFVALMGDLQGPKIRIARFADKQVTLHAGQPFVLSNSHPKDAGDATIVGIDYPELVQDCKPGDELLLDDGRVVLLVDRIAGDAVHTTVTVGGPLSNNKGINRRGGGLSAPSLTDKDRADILVAAELNLDYVAVSFPRYGRDIDEARQLVRAAGSEAWIIAKIERAEAVVDDEALDSLIRASDGVMVARGDLGVEVGDAELVGIQKRIIQHARTLNKVVITATQMMESMISSPLPTRAEVSDVANAVLDYTDAVMLSAESASGQYPAEAVQAMARVCLGAEKHPTTTHSHHRLGETFSRCDETIALAAMYAANHFPGVKAIIALTESGHTPLIMSRIRSGVPIYCYSPHSQTQHRVAMFRGVYTVPFDPSAYDPAELSNAAIDELKKRGRVQPGDWVILTKGDFYRDSGGTNGMKILMVE

SEQ ID NO: 27695 - protein, 892 aa, Aspergillus nidulans FGSC A4
MADNVSASTSSTHAPPQPSTAASNQQYDASQGNGQTNPSHMPPPPRPPVIIPQNTNPIPTAITTPMSGNMVSPTSAGGYVRRAAPEPNKRALYVGGLDPRVTEDILKQIFETTGHVISVKIIPDKNQFNSKGANYGFVEFDDPGAAERAMQTLNGRRIHQSEIRVNWAYQSNTANKEDTSNHFHIFVGDLSNEVNDEVLLQAFSAFGSVSEARVMWDMKTGRSRGYGFVAFRERADAEKALTSMDGEWLGSRAIRCNWANQKGQPSISQQQAMAAMGMTPTTPFGHHHFPTHGIQSYDMVVQQTPAWQTTCYVGNLTPYTTQNDIVPLFQNFGYVIETRMQADRGFAFIKMDTHENAASAICQLNGYNVNGRPLKCSWGKDRPPTGQFDNFPGQQANSPFASSPGPYFPQYGGPGGPMTPQGPAQAGRGWEQPQMAQQGFGQVPGNTGYGRGQATPNSGWNQGNNANFGNGFAGGYQACGWTRRHVIRATWSMEDAIDRKATAPSSDNEGQPSGRTRSGSANSGHKRSSSGSLLSRLSFLRMMQASQNPSGRGHSSLEADDDRDDLGSGLRGGRPISTAPQHRRTRRRRGSLRKTALLGTRFDYRDKKAGRQGVDVRGENADQHQVQSRAQQQQLTPPPIPTHTRMKSFGDPATSSDGFIHSQPSSREGLGGRSTSTSSWTLMDAPQRSRKLSASTPQHIQSIRSKENKLRDDVTTDDEDIVPFPSKNAGTAPSAFHSSSNTSSNSGAAGLHLPTPPSSTDSYYSLQPDQKYRAAHRAKSPLATHAVDITGSQEAMSWDYSETEWWGWIILIVTWLVFVVGMGSCFGVWSWAWDVGETPYAPPELEDDPTLPIVGYYPALIVLTAVMSWVWVIIAWVGMKYFKHANITGDDT

SEQ ID NO: 27696 - protein, 367 aa, Brassica napus
MSRRSLTLLKNLARNSNASCIQTRSVTYMPRPGDGSPRAVTLIPGDGIGPLVTNAVEQVMEAMHAPIYFEKYDVQGEMSRVPAEVMESIRKNKVCLKGGLKTPVGGGVSSLNVQLRKELDLFASLVNCFNLPGLPTRHENVDIVVIRENTEGEYAGLEHEVVPGVVESLKVITKFCSERIAKYAFEYAYLNNRKKVTAVHKANIMKLADGLFLESCREVAKKYPGITYNEIIVDNCCMQLVAKPEQFDVMVTPNLYGNLVANTAAGIAGGTGVMPGGNVGADHAVFEQGASAGNVGKDSIVRENKANPVALLLSSAMMLRHLQFPSFADRLETAVKKVISEGKCRTKDLGGQSTTQEVVDAVIAKLE

SEQ ID NO: 27697 - protein, 89 aa, Physcomitrella patens subsp. patens
MGIREDAAQSRMKKKVEEALRSKMKAQALKECDPLVAKFAECAKGRLFSVVWACRAQSKETNACLHRYTNDEAFEKYKKQYEEQALQKL

SEQ ID NO: 27698 - protein, 161 aa, Musa acuminata AAA Group
SSMMVSSAATVSRASPAQSSMVAPFTGLKSTSAFPVTRKANADLSHLPSNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 27699 - protein, 368 aa, Brassica napus
MSRRQSLSLLKNIGRFTTGSQTQTRSVTYMPRPGDGKPRPVTLIPGDGVGPLVTNAVEQVMEAMHAPVYFEPFDVHGDMKSLPEGLLESIKKNKVCLKGGLKTPVGGGVSSLNVNLRKELDLFASLVNCFNLPGLGSRHENVDIVVIRENTEGEYAGLEHEVVPGVVESLKVITKFCSERIAKYAFEYAYLNNRKKVTAVHKANIMKLADGLFLESCQEVAKKYPSIAYNEIIVDNCCMQLVARPEQFDVMVTPNLYGNLVANTAAGIAGGTGVMPGGNVGAEYAVFEQGASAGNVGKDTTEEQKNANPVALLLSSAMMLRHLQFPSFADRLETAVKRVIAEGKCRTEDLGGKSTTQEVVDAVISNLD

SEQ ID NO: 27700 - protein, 180 aa, Musa acuminata AAA Group
MVSSMMVSSAATFTRASPAQSSMVAPFTGLKSASAFPVTRKPNADLSHLPSNGGRVQCMKVWPIEGVKKFETLSYLPTLKDEALLKQIEYLLRSKWIPCLEFCPKGFVWRENHRSPGYYDGRYWTMWNLPMFGCTDAVQVAKEVEECKKEYPHAFIRIIGFDNNRQVQCVSFIAYKPTGY

SEQ ID NO: 27701 - protein, 477 aa, Oryza sativa Indica Group
MDALARFPGSYWRDLFDSRVGRTTWPFGSGVWSKKEFVLPEIDPDHIVSLFEGNSNLFWAERLGRDHLAGMNDLWVKHCGISHTGSFKDLGMTVLVSQVNRLRRAPLSRPIAGVGCASTGDTSAALSAYCAAAGIPAIVFLPANRISLEQLIQPIANGATVLSLDTDFDGCMRLIREVTAELPIYLANSLNSLRLEGQKTAAIEILQQFDWEVPDWVIVPGGNLGNIYAFYKGFEMCRVLGLVDRVPRLVCAQAANANPLYRYYKSGWTEFTPQVAEPTFASAIQIGDPVSVDRAVVALKATDGIVEEATEEELMNAMSLADRTGMFACPHTGVALAALFKLRDQRIIGPNDRTVVVSTAHGLKFSQSKIDYHDSKIEDMACKYANPPVSVKADFGAVMDVLKKRLKVPCSWHMNTASICSECRPCLSVVLNFLVTFHPYLVKAGKLIIVECKMYGSWLHLHQCPVAKEIADYTISA

SEQ ID NO: 27702 - protein, 337 aa, Zymomonas mobilis
MKAAVITKDHTIEVKDTKLRPLKYGEALLEMEYCGVCHTDLHVKNGDFGDETGRITGHEGIGIVKQVGEGVTSLKAGDRASVAWFFKGCGHCEYCVSGNETLCRNVENAGYTVDGAMAEECIVVADYSVKVPDGLDPAVASSITCAGVTTYKAVKVSQIQPGQWLAIYGLGGLGNLALQYAKNVFNAKVIAIDVNDEQLAFAKELGADMVINPKNEDAAKIIQEKVGGAHATVVTAVAKSAFNSAVEAIRAGGRVVAVGLPPEKMDLSIPRLVLDGIEVLGSLVGTREDLKEAFQFAAEGKVKPKVTKRKVEEINQIFDEMEHGKFTGRMVVDFTHH

SEQ ID NO: 27703 - protein, 211 aa, Bacillus halodurans C-125
MGKRPIIIGVAGGTGSGKTTVAKEIFYQFNEKSIVLIEQDAYYKDQSQLSLEERLQTNYDHPLAFDNDLLIEHLHSLLNGQAIEKPVYDYKLHTRSNEVILVEPKDVIILEGILLLEDERLRELMDIKLFVDTDADIRIIRRMVRDIRERGRTLESVIEQYTKVVRPMHMQFIEPTKRYADVIIPEGGQNRVAIDLMVTKIRAIIEEKAVL

SEQ ID NO: 27704 - protein, 180 aa, Musa acuminata
MASSMMVSSAATVSRASPAQSSMVAPFTGLKSTSAFPVTRKANADLSHLPSNGGRVQCMKVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDNNRQVQCISFIAFKPPGY

SEQ ID NO: 27705 - protein, 626 aa, Oryza sativa Japonica Group
MTMMGCAVLLVVVASMAGEAAGRFVVEKNSLRVTSPAGLRGVYECAIGNFGMPQYGGTMHGVVVYPKANKKACRSFDDFDLSFKPKPGGLPIFLLVDRGDCYFTTKGWNAQTAGAAAVLVADDRLEPLITMDSPESSGTDYIEKITVPSALVTKKFGDDLKKALENGDMVNVLLDWRESLPHPDERVEYEFWTNSNDECGAKCDMQMNFVRNFRGTAQVLEKRGYTQFTPHYITWYCPEAFVLSKQCRSQCINHGRYCAPDPEQDFNIGYDGKDVVLQNLIQICLFKVGNETHKPWVWWDYVHDFSIRCPMKEKKYTRECANGVIKSLGLDLERINKCVGDPEADEENPVLKAEQDAQIGQGSRGDVTILPTLVVNNKQYRGKLEKSAVLKAVCSGFEETTEPDVCLSQEIQTNECLESNGGCWQDKTNNFTACKDTFRGRVCECPIARGVKFVGDGYTHCEASGVGRCQINNGGCWKETKNGKTVSACSNEESKGCKCPPGFKGDGIKSCEDIDECKDKLFCQCKDCSCENTWGSYECSCGGSNMLYMREHDTCISKVASSSVGWGFLWVIFFGLALAGIGAYAVYKYRLRSYMDSEIRAIMAQYMPLENQETPNQHRPVEHADI

SEQ ID NO: 27706 - protein, 265 aa, Mannheimia succiniciproducens MBEL55E
MLREVWNNIRNEAKELVEHEPVLASFFHSTILKHKNLGGALSYILANKLATSTMPAITLREIIEETYQDDPRIIDSAACDIHAVRQRDPAVGLWATPLLYLKGFHAIQSYRITHHLWQQNRKSLAIYLQNQISVAFDVDIHPAARVGCGIMFDHATGIVVGETAVIENDVSILQGVTLGGTGKESGDRHPKIREGVMIGAGAKILGNIEVGKYAKIGANSVVLQPVPEYATAAGVPAKIISKDRSAKPAFDMNQYFIDDAEALNI

SEQ ID NO: 27707 - protein, 335 aa, Mannheimia succiniciproducens MBEL55E
MSIQASPVTILGAGSYGTALAIALSRNGYPTYLWGHNPTACAQMAQERQNARFLPDISFPEALRVESDLKSAVEKSKDLLIVVPSHVFGEVIQQIKPFLHNRHRIIWATKGLERGTGRLLQNLVEQELGSQYPLAVLSGPTFAKELAAGLPTAITLAAENEQFAKEFQARIHCSKHFRVYINNDMVGVQLGGAIKNVIAISAGMSDGMGFGANARTALITRGIAEISRLGVSLGANVNTFMGMSGLGDLVLTCTDNQSRNRRFGMMLGQGVDARTAMDEIGQVVEGYYNTKEAYMLAQKQGIEMPITEQIYQVLFCGKDAKEAATALLGRKSKVE

SEQ ID NO: 27708 - protein, 458 aa, Pseudomonas fluorescens PfO-1
MSSGRIVQIIGAVIDVEFPRDSVPSIYDALKVQGAETTLEVQQQLGDGVVRTIAMGSTEGLKRGLDVNNTGAAISVPVGKATLGRIMDVLGNPIDEAGPIGEEERWGIHRAAPSFAEQAGGNELLETGIKVIDLVCPFAKGGKVGLFGGAGVGKTVNMMELIRNIAIEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGVLQERITSTKQGSITSIQAVYVPADDLTDPSPATTFAHLDATVVLSRDIASLGIYPAVDPLDSTSRQLDPNVIGNDHYETARGVQYVLQRYKELKDIIAILGMDELSEADKQLVNRARKIQRFLSQPFFVAEVFTGASGKYVSLKDTIAGFKGILNGDYDHLPEQAFYMVGGIEEAIEKAKKL

SEQ ID NO: 27709 - protein, 301 aa, Shewanella sp. MR-4
MKHLLSIKELTQQQLLDLITLAKTIKANPAEYRHALDGKSVVMLFEKPSLRTRVSFDIGINKLGGHCLYLDQQNGALGKRESVADFASNLSCWADAIVARTFSHKTIEQLAEFGTVPVINALSDLYHPCQALADFLTLAEHFENISDVKLAYVGDGNNVTNSLMYCAAILGATMTVICPAGHFPDGYVVAEVQELASRYGGKVVLTSDIGAIEGHDAIYTDTWISMGDPTPLAEIKDKFAPYQVNKGLMAKAGAHFFMHCLPAHRGVEVTDEVMDGEGSLILQQAENRMHAQNAVLVTLFS

SEQ ID NO: 27710 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGAHSAFDAIGGAYAENLPVILISGAPNNNDHAAGHVLHHALGKTDYHYQLEMAKNITAAAEAIYTPEEAPAKIDHVIKTALAKKKPVYLEIACNIASMPCAAPGPASALFNDEASDEASLNAAVDETLKFIANRDKVAVLVGSKLRAAGAEEAAVKFTDALGGAVATMAAAKSFFPEENPHYIGTSWGEVSYPGVEKTMKEADAVIALAPVFNDYSTTGWTDIPDPKKLVLAEPRSVVVRRIRFPSVHLKDYLTRLAQKVSKKTGSLDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAAKGLKAKTGGELAEAIKVALANTDGPTLIECFIGREDCTEELVKWGKRVAAANSRKPVNKLL

SEQ ID NO: 27711 - protein, 130 aa, Oryza sativa
  misc_feature (124)..(125): Xaa can be any naturally occurring amino acid
  misc_feature (127)..(128): Xaa can be any naturally occurring amino acid
IDRMFKDAITAGKRVRCETNISAGAVSVSSAAVELALMKLPKSECLSARMLLIGAGKMGKLVVKHLIAKGCTKVVVVNRSVERVDAIREEMKDIEIVYRPLTEMYEAAAEADVVFSSTASESLXXTXXHA

SEQ ID NO: 27712 - protein, 352 aa, Oryza sativa
  misc_feature (261)..(261): Xaa can be any naturally occurring amino acid
  misc_feature (290)..(290): Xaa can be any naturally occurring amino acid
MASAAIYSLFIINKSGGLIYYKDYGSAGRTDTNDSLRLASLWHSMHAISQQLSPTHGCEGIDLLQAHNFDLHCFQSLTGTKFFAVCETGAQNIETLLKVIYELYTDFVLKNPFYEMEMPIRCELFDLNLAQVRLPPPHGLTSQGSPNRFRRGYHHLTRLNGYRKVVAFVSFVNHQAALSAMSALNGTVFDPDTGDRLHIELAKSSSRKRHGDGGVYRVVDKRLKRKERAADHENAGDGGNDDDAWGEDDNGGNDVVVIDDXVLPFVHSSGQPGLKQHRGQSLSDLLLIRXDQPDKLSSDIPPCSTLFVANLGHSCTEEELKEVLSKQPGFHLLKMRRRGGMPVAFADFTLCV

SEQ ID NO: 27713 - protein, 260 aa, Shewanella sp. MR-4
MSTNNSVLVLKVGGALLQCEMGMARLMDTAAAMIADGQQVLMVHGGGCLVDEQLAANGMETVKLEGLRVTPPEQMPIIAGALAGTSNKILQGAATKAGIVSVGMSLADGNTVSAKIKDERLGLVGEVSPKDATYLKFILSQGWMPICSSIAMMDDGQMLNVNADQAATVLAKLVGGKLVLLSDVSGVLDGKGQLIPSLNGKQIAELVKQGVIEKGMKVKVEAALEVAQWMGQAVQVASWRDASQLVALAKGEAVGTQIQP

SEQ ID NO: 27714 - protein, 386 aa, Salmonella enterica subsp. enterica serovar Typhi str. CT18
MTSENPLLALRDKISALDEELLALLAKRRALAIEVGQAKLLSHRPVRDIDRERALLDRLIHLGKAHHLDAHYITRLFQLIIEDSVLTQQALLQQHLNNTHPHSARIAFLGPKGSYSHLAARQYAARHFEQFIESGCAKFTDIFHQVETGQADYAVVPIENTNSGAINDVYDLLQHTSLSIVGEMTVTIDHCVLVSGATDLNTIETVYSHPQPFQQCSKFLSRYPHWKIDYTESTSAAMEKVAQANSPRVAALGSEAGGMLHGLQVLERIAANQTQNITRFLVLARKAINVSDQVPAKTTLLIATGQQAGALVEALLVLRNHNLIMTKLESRPIHGNPWEEMFYLDIQANLESQVMQSALKELGEITRSMKVLGCYPSENVVPVEPA

SEQ ID NO: 27715 - protein, 351 aa, Bordetella pertussis Tohama I
MSQARPATLRVAVLGAGSWGTALAAAASRRHPTVLWARDGAQAQAMAARHENTRYLPGVALPHALQVSADLAQALAHLAHDPAHALIILGVPVAGMTPLCTELAARLPALGLQAVPLVWTCKGFEEQTARLPHETVQAALGAMPGLAAGVLSGPSFAREVAQGLPVALTVASGSSAVRDAVTTALHGAAVRIYASTDVVGVEVGGALKNVIAVACGICDGLALGTNARAALITRGLAEMARFGAALGAQQETFAGLTGLGDLVLTATGELSRNRRVGLEIGAGRKLADILASGMTAEGVRCARAARDRARALNIELPITEAVCAVLFEGLSPMTAVSALLAREARPESPTP

SEQ ID NO: 27716 - protein, 245 aa, Chlamydomonas reinhardtii
MEFVSPEGLRLDGRRPRELRRINCQLDVLSNADGSAIFEMGNTKVLAAVFGPHAVTRRSELREEGALVVCEYSMAAFSTGERRRRGKGDRRSTELSMVIRNTLEQAVITELLPRSQIDVYVQVLQADGGTRCAAINAAVLALAAAGVPLRDLVAGCAAGYLDGTALLDLNYTEDSGGGPDLCVALAPRLDSLYLVQMDNRLPVDTFQAVMELAREGCRTISGVMRAALLEHTQRLAVARGITAAV

SEQ ID NO: 27717 - protein, 163 aa, Zea mays
MAMGLINANPIIHEKKERRARQAPETTDENAAEPIDQLEIFDILLNDFFKYIKDPEHPYSLEQLNVVTEDSIELNDESNYVRVTFTPTVEHCSMATIIGLCIRVKLVRSLPPRYKVDIRVAPGSHATEAAVNKQLNDKERVAAALENPNLLDMVEECLSPTFD

SEQ ID NO: 27718 - protein, 314 aa, Oryza sativa
MGVYLSTPKTEKYSGEGGNDRLRYGLASMQGWRTTMEDAHTALPRLDECTSFFGVYDGHGGKAVSKFCAKHLHLQVLKNEAYSSGDLATSVLKSFFRMDEMMKGQRGWRELAELGDKGQKFTGMLEGIIWSPKPGESDKPEDTWTEEGPHSHFPGPTSGSTACVAIIRNDELIVANAGDSRCVLSRKGRAYDLSKDHKPDLDAEKERILNAGGFIVAGRVKLSEDDEFIVLACDGIWDCMSSQEVVDFVHKEMNTEDSLSAVCEKLLDHCLAPVSGGDGCDNMTVIIVKFKKPSKSAATSSTNQSVSSEEMRPK

SEQ ID NO: 27719 - protein, 321 aa, Silene conica
RKFKTIIHPGEVNRIRELPQNSNIVATHTDSPDVYIWDLESQPNRPVNLGTPASRPDLTLTGHQDNAEFALAMCSSEPLVLSGGKDKSVVLWSIHDHISTLATEPGSAKSTNSGSNIKKAGNGNSDNPSIGPRGIYLGHEDTVEDVQFCPSSAQQFCSVGDDSCLILWDARAGLTPVTKVEKAHNADLHCVDWNPHDENLILTGSADNSINLFDRRNLTASGVGSPAHKFQGHDAPVLCVQWSPHNKSIFGSAADDGLLNIWDYEKVSKMETEIGGKKSNHPAGLFFRHAGHRDKVVDFHWNSIDPWTLVSVSDDCSSSAG

SEQ ID NO: 27720 - protein, 250 aa, Bordetella pertussis Tohama I
MYKLVLMRHGESQWNLENRFTGWTDVDLTETGREQARKAGELLKREGYAFDLAYTSVLKRAIRTLWIALDAMDAMYTPVGINWRLNERHYGQLQGLNKAETAAKYGDEQVLIWRRAYAIAPEPLDLEDPRHPRFDGRYAKIPADQLPATECLKDTVARVLPFWNESIAPAIRAGRRVLVAAHGNSLRALIKHLDNVSDDDIVGVNIPTGQPLVYELDEDLKPIRHYYLGDAAEIEAAMAAVAAQGKAKKD

SEQ ID NO: 27721 - protein, 608 aa, Magnaporthe grisea 70-15
MATWSGRAAIKGGSDTMRMVLLTCNAVGVTFTWGVEMTYCTPYLLSLGLTKGQTSLVWIAGPLSGLIVQPVIGVISDTWTSKWGRRRPFIMMCSVIVAMGLLTLGFTRDIVSFFIPSSAAGAAAAAAAEVPTAIRRDHPENNGFTGFLTIALAVLALYTTDFAINAVMSCARSLIVDTLPMHKQQDGAAWASRMSAIGHILGYGAGAIDLVALLGTTLGETQFKQLTLIAASGILFFSTLTCWAVSERVLVAPAPEPKGLVAGGERFKVPRQIWSTLMTLPVRIQAICWAVFWSWIGWYPFLIYSSTWVGETYFRYDVPADAKSSSDALGEMGRIGSYALTVYSIITFLGAWLIPPLVRSPEDDDEDDDGIPVTSQAAKSQSFLHSWFPGVARSLGQLGHLKPDLLTVWTFGYIMFAFAMFMAPLASSFRFATILVALCGIPWTISMWAPTALMGVEVNRMTHGITGQPYRRLSTSSAVELLTPVIRVNGEETEVVAAAAAPSSAPQAALLEDGNGTRVGGGGGELSGIYFGILNIYTTLPQFIGTFISAVVFAILEPGKSPELSHGGGGEELPQAPSDGPNAIGICLFIGAISAVGAAYATRRLRYL

SEQ ID NO: 27722 - protein, 208 aa, Brassica napus
MSMKATILILGLVWSFQAALGIRFVIDREECFSHKAEYEGDTLHVSFVVIKSDSQWHFNEDGVDLVIHGPAGEQIHDFREQISAKHDFVVQKKGVYRFCFTNKSPYHETIDFDVQLGHFAYYDQHAKDEHFTPLMEQISKLEEALYNIQFEQHWLEAQTDRQAIVNENMSKRAVHKALFESFALIGASVLQVYLLRRLFERKLGMSRV

SEQ ID NO: 27723 - protein, 443 aa, Synechococcus sp. WH 5701
MPFTTSAPVSTPAELLTSDPQMEPAPQTGPENLAALTRADFPLLADQACLGQPLIYLDHAATSQKPRAVLDALQRYYRHDNANVHRGAHQLSARATDAFEGARDKTARFVGAATPREIVFTRNATEAINLVARSWGDAFLRPGDEIVLTVMEHHSNLVPWQQLAERTGARLRHAGLTASGELDLEDLRDQISERTRLVSVVQISNTLGCHNPIGAIAELTHAAGALLLVDACQSLPHLPVNVQALGADFLVGSSHKLCGPTGMGFLWAREALLEAMPPFLGGGEMIQDVYLDHSTWAELPHKFEAGTPAIGEAVGMGAAIDYLNALGLDRIHAWEQRLTAHLFERLQAIEGLRVLGPTPQQQPERGALAAFVVEGLHANDISALLDASGICIRSGHHCTQPLHRHYGISGSARASLSFTTTIEEIDRFAEELASSVAFLREHG

SEQ ID NO: 27724 - protein, 181 aa, Musa acuminata
MASSVMVSSAAAVVSRASPAQSSMVAPFTGLKSTSAFPVTRKANADLSHLPSNGGRVQCMKVWPIEGKKKFETLSYLPTLVDEVLLKQIEYLLRSKWIPCLEFSHEGFVWRENHRSPGYYDGRYWTMWKLPMFGCTDATQVAKELEECKKEYPRAFVGIIGFDNNRQVQCISFIAHKPDGH

SEQ ID NO: 27725 - protein, 153 aa, Neurospora crassa
MGTFTLELYTNHAPKTCKNFATLADRGYYDSTVFHRIIKDFMIQGGDPTGTGRGGSSIYGEKFEDEIHPGLKHTGAGVLSMANAGPNTNGSQFFITLAPTPWLDGKHTIFGRVKKGMGVIRRMGMVPTDKEDRPATEVKIVKARVVREEDMEA

SEQ ID NO: 27726 - protein, 512 aa, Mannheimia succiniciproducens MBEL55E
MVNNLSNAPTGAEYLRAILISKVYEAAKVTPLQLMPKLSERLGNRIYVKREDHQPVHSFKLRGAYAMISGLTQAQKEAGVITASAGNHAQGVALSAKNAGIRALIVMPQNTPSIKVDAVRGHGGEVLLHGANFDEAKAKAIELSQTEQMTFIPPFDHPAVIAGQGSIGMELLQQNGHINRIFVPVGGGGLLAGVAVLIKQLMPEIKVIGVEAKDSACLYYALKAGRPVDLERVGLFADGVAVKRIGDETFRICQQYVDDVILVDGDEICAAMKDMFENVRAVPEPSGALSLAGLKKYAKQHNLQGETLVNLLSGANLNFHTLRYVSERCEIGEKHEALFAVTIPEQRGSFLKFCQILGQNAVTEFNYRYADEKQACIFVGVRITGEQEKQVIIQQLKQGGYDVQDLSDDDIAKTHIRYMVGGRSSSDLNERLYSFEFPEQKGALLKFLETLGTTDANISLFHYRGHGADYGDVLAGFQINDADLPAFKQHLEKLGYAYQDVTDSPSYRYFLG

SEQ ID NO: 27727 - protein, 428 aa, Zymomonas mobilis [sequence omitted]

SEQ ID NO: 27728 - protein, 176 aa, Mannheimia succiniciproducens MBEL55E
MADFNQILTPGDVDAGIINVVNEIPEGSCHKIEWNRKVAAFQLDRVEPAIFAKPTNYGFIPQTLDEDGDELDVLLITRQPLATGVFLEAKVIGVMKFVDDGEVDDKIVCVPADDRDTGNAYNTLSDLPAQLIKQIEFHFNNYKALKKPGSTKVTHWGDVEEAKEVIRESIKRWNEQ

SEQ ID NO: 27729 - protein, 513 aa, Streptococcus agalactiae A909
MSILEVKNLSHGFGDRAIFENVSFRLLKGEHIGLIGANGEGKSTFMSIVTGHLQPDEGKIEWSKYVTAGYLDQHTVLEEGQTVRDVLRTAFDELFKTEARINDIYISMADDGADVDSLMEEVGELQDRLESRDFYTLDAKIDEVARALGVMDFGMDSDVTELSGGQRTKVLLAKLLLEKPDILLLDEPTNYLDAEHIDWLKRYLQNYENAFVLISHDIPFLNDVINIVYHVENQDLVRYSGDYTNFESVYAMKKAQLEAAYERQQKEIADLQNFVNRNKARVATRNMAMSRQKKLDKMDIIELQAEKPKPSFEFKESRTAGRFIFQAKDLQIGYDRALTKPLNLTFERNQKIAIVGANGIGKTTLLKSLLGIIPPISGNVERGDFIDLGYFEQEVPGGNRQTPLEAVWDAFPALNQAEVRAALARCGLTSKHIESQIQVLSGGEQSKVRFCLLMNRENNVLVLDEPTNHLDVDAKDELKRALKAYKGSILMVCHEPDFYEGWMDDVWDFNQLS

SEQ ID NO: 27730 - protein, 2166 aa, Oryza sativa
MSAAQGMAYKLRTDAAPTGAGRRARRSHSSVAAPYRAARLVQGGVSIEGGLVGGCQLTEERVAARPPRAAARDAEPVRPLSTLPESSIGLYDPSRERDSCGVGFVAELSGDYKRATVNDALEMLERMAHRGACGCEKNTGDGAGILVALPHNFFREVTKDAGFELPQPGEYAVGMVFLPIDEKRRERSKAEFQKVAESLGHVILGWRRVPTDNSDLGESALQTEPVIEQVFLTKSSSSEADFEQQLYILRRLSILSIRAALNLRRGGKRDFYMCSLSSRTIVYKGQLKPCQLKGYYYADLGHENFTSYMALVHSRFSTNTFPSWDRAQPMRVLGHNGEINTLKGNKNWMKAREGLLECEKLGLTKDQFSKILPIVDATSSDSGAFDGVLELLIRGGRSLPEAVMMMIPEAWQNDVNMEPEKKALYEFLSALMEPWDGPALISFTDGRYLGATLDRNGLRPGRFYVTHSGRVVMGSEVGVVDVPSKDVLRKGRLNPGMMLLVDFENHTVVDDEALKAQYSKAHPYGEWLKRQKIYLKDIVESVPETERVAPGISGSLTQKNEKKEHAGVNGIVTPLKAFGYTVEALEMLLLPMAKDGVEALGSMGNDTPLAVMSNREKLTFEYFKQMFAQVTNPPIDPIREKIVTSMECMIGPEGDLLETTEKQCNRLALEGPLVSIDEMEAIKKMNYRGWRSKVLDITYPKKSGRKGLEETLDRICTEARGAIKKGYTVLVLSDRGFSSDRVAVSSLLAVGAVHQHLVANLERTRVGLVESAEPREVHHFCTLVGFGADAVCPYLAIEAIWCLQNDGKIPPNGDGKPYSKEELVKKYFYASNYGMMKVLAKMGISTLASYKGAQIFEALGLSSEVIRKCFDGTPSRIEGATFEMLARDALRLHELAFPSRAPPPGSADAKALPNPGDYHWRKNGEVHLNDPLAMAKLQEAARVNSRAAYKEYSRRIQELNKTCNLRGMLKFKDTADMISVDEVEPASEIVKRFVTGAMSYGSISLEAHTALAMAMNKLGGKSNTGEGGEQPSRMEPLANGSMNPKRSAIKQVASGRFGVSSYYLTNADELQIKMAQGAKPGEGGELPGHKVIGDIAVTRHSTAGVGLISPPPHHDIYSIEDLAQLIHDLKNSNPRARISVKLVSEAGVGVVASGVVKGHADHVLISGHDGGTGASRWTGIKNAGLPWELGLAETHQTLVANGLRGRAILQTDGQLKTGKDVAVACLLGAEEFGFSTAPLITLGCIMMRKCHTNTCPVGIATQDPVLREKFAGEPEHVINFFFMLAEELREIMSQLGFRTITEMVGRSDMLEVDPEVVKSNEKLENIDLSLILKPAAEIRPGAAQYCVEKQDHGLDMALDNKLIALSKAALEKEVRVFIETPIQNTNRAVGTMLSHEVTKRYHMKGLPAGTIHVKLTGSAGQSLGAFLCPGITLELEGDSNDYVGKGLSGGKIVVYPPRDSTFIPEDNIVIGNVALYGATIGEAYFNGMAAERFCVRNSGAQAVVEGIGDHGCEYMTGGTVVILGKTGRNFAAGMSGGIAYVYDIDGKFSVRCNHELVDLYHVEEEEDITTLKMMIEQHRLNTGSVVARDILSNFDTLLPKFVKVFPRDYKRVLDNMKAEKAAAKLAKEPKISNGVSVTTKKVQPEQSTNRPTRVSNAKKYRGFISYERESISYRDPNERVKDWKEVAIESVPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMVPRPPLQRTGKKVAIIGSGPAGLAAADQLNKMGHFVTVFERADRIGGLMMYGVPNMKTDKIEIVQRRVNLMAEEGITFVVNANVGSDPLYSIERLRSENDAVILACGATKPRDLGIPGRELSGVHFAMEFLHANTKSLLDSNLEDGRYISAKGKKVVVIGGGDTGTDCIGTSIRHGCTSIVNLELLTKPPSKRAADNPWPQWPRIFRVDYGHQEASSKFGNDPRTYEVLTKRFIGDENGNVKALEVVRVKWEKVDGRFQLKEIEGSNETIEADLVLLAMGFLGPEATIAEKLGLEKDNRSNFKAQFGNFATSVDGIFAAGDCRRGQSLVVWAITEGRQAAAAVDKYLSRNEQDAAEDITPSGAGFVQPVAA

SEQ ID NO: 27731 - protein, 282 aa, Neurospora crassa
MSSRPGLFTRGLSGLSQSNDASVSSPAAERDDAKRNFLKTMRPLPTQHYWNIWFDRPDKDQQGKSADGSYHSNLEKLGSTIESVQDFWRYNNNMPIENIKMRESIYLFKAGFKPVWEDRRNILGGSWTFRVPKANGADFWTRVQLLAIGEELQDVLEEGDQICGVGLSVRFNAHLISIWHRDASKQKSVDAILQLVLTKAIPDDFPPLKPDNYFYKKHSDHAGFNPSPEMQAVLDSQKAREQHAAAVAKAQAQAAQQTTAQEGGQSQPEPPQIVEVPPSGEA

SEQ ID NO: 27732 - protein, 225 aa, Thermotoga maritima MSB8
MKKGVLFDLDGTILDFEKSEDQALKRTFLKYGIPLTEDQVFLYREINRKWWKLLAEGKVSKDVVVVARFEEFLKTLNIPLDPRKVAKDYLEFLSEEAHFLPGAEEFLERLKKKDLRMAVVTNGVRFVQEKRSRKLKLDRFFEFVLTSEEAGVEKPDPRIFWLALERMKLKKEEVLYVGDDFSSDLEGARNAGIDFVLFSSDGDSSGDFPVARNFKELEKIVEEFL

SEQ ID NO: 27733 - protein, 150 aa, Ostreococcus tauri
MKIDMRMNLKLRKVELKTTAKTEDESALQKSADFVQAFLLGFDVQDAVALLRLDDLYLECFEVKDVKTLRGEHMSRGIGRLAGKNGKTKFTIENATRTRIVIADQHIRILGSFQNIKVARDALCSLILGSPPGKVYSRLRAVTARLAERF

SEQ ID NO: 27734 - protein, 434 aa, Clostridium difficile 630
MHNVCKSGGETDMEASIHTIASNNLLIIFAIVSITGIICSKLSEIIKVPDVVLYLLVGILIGPSFLKFIDIRGFQIENQLILTFGSAFILYLGGKEISLKVLRNVKISVFLLATLGVVISAFIMQQVIGFTFGISAMTALLAGTIIASTDPATLVPIFNQVKIKDRVKQTVISESAFNDATGAILTSAVLAVILSNKFSLGENIYELGTMVIVGVLVGLITGILLLKLVNDKPYGIFKDFAPIISVISVVVAYELSTKLGGSGYMSCFIVGIITGNKKNFKIWLSQKSYDADFYVAETLGTICRMAIFIILGSQVNLAQLSKYFMPSVITVLVLMFIARPLCVLVCTLVDREAKWSKSEILFMMWVRETGVIPAALCGIISAMKVPGYEVISSVVFMTILITLVIQGSTTKLVAKKLGLLEEEVINISEKVSTF

SEQ ID NO: 27735 - protein, 265 aa, Bacillus anthracis str. Ames
MGNILIDAFLETRAVKPSCLTIINRTPAKAYHIKEKYPSVHIAKTIDKVIERSHLIFICVKPIDIYPILQKYAEHFSDEKCLVSITSPISPSQLETLVPCHVARIIPSITNRALSGASLFTFGNNCSEEWQQKLFRLFKNISTPLVIKEDITRVSSDIASCGPAFFSYLLQCFINAAVDKTNITHEEATTLVSEMVVGMGELLEKGIFTLPTLQEKVCVKGGVTGEGIRVLEEHVGDMFHKLIERTHEKFDEDLKCVDQQFNKHT

SEQ ID NO: 27736 - protein, 455 aa, Methanococcoides burtonii DSM 6242
MKKIVSMNPATGEVNEEIELYSEERINRTITKARTTFLEWKNLDISERAHYLKTAATQLRKDKDELGRIITIEMGKPIKESVPEVEKCAWALEYYAENAENFLAPEAVETDALESGVSFEPKGVILSIMPWNFPFWQALRFAAPALVGGNTVILKHASSVPMCALAIEKVFADAGLPEGAFQTLIIDGRTASELIARDEIAAVTFTGSLTAGRKVAEAAGRNMKKAVLELGGSDPFIVLDDANVEMAAKAGVNSRFQNGGQSCIAAKRFIVTEAVADEFLRIFIGSARKLQVGDPMDPQTDVGPLVNAQQVDIIDAQVKDSVDKGAELLLEGGRLDRLGSFYAPVILSNVNENMRVLKEETFGPVAPVIIVKDEEEAIRVAGNSDFGLGASLWTEDREHAMEIEKHIESGILSVNSMVASDPRLPFGGVKKSGIGRELYKYGLYEFMNIKSIKVY

SEQ ID NO: 27737 - protein, 64 aa, Zea mays
  misc_feature (13)..(13): Xaa can be any naturally occurring amino acid
MGQLVKLATDRGXKARPNLNVDIGGEHGGEPQSVALFAKTGLDYVARSLIRVPIAMLAAYHVPV

SEQ ID NO: 27738 - protein, 507 aa, Robiginitalea biformata HTCC2501
MNAIDGQLLVIFGASGDLTERKLIPSLMNLFQGGHLPESFAVLGVSRSDMDDEAFRKKVVLDNPHIPETVGNHGHRKEFAKLLHYYDLGSYEEDYAGLNERIAELDNGIGSPGNMIFYLSVPPRIYETIASRLHDQGLSSEESGTRRLIVEKPFGYDLESARSLNKGLQRYFQESQIYRIDHYLGKETVQNLLVTRFSNSIFEPLWNRNYIRHVEITNAESVGVGKRGGYYDSAGALRDMFQNHLLQIISLVVMEPPIGPEAEAIRNEKVKALKSLRIMRDPETLYAHTIRGQYLAGEIDGEAVPGYREEAGVDPDSTTETYAALKFYVDNWRWAEVPFYVRTAKRMPTKVTEVVIHFKSPHHQIFRDIGMDSKDNKLIIRIQPNEGILIKFGVKVPGQGFQVERANLDFYYSDLADQNIMTAYERLLLDAMQGDATLYARADEVEAAWEFVDPILKYWSEAGDVVTYGYSAGVWGPKNADDLIEGAYGWRNPGAHLTDDPGFCVIS

SEQ ID NO: 27739 - protein, 698 aa, Silicibacter pomeroyi DSS-3
MPEAIGYERVGDIVILAADNPPVNALGHAVRQGLAVGLDRAEAEGARGVLIYGTGRTFFAGADIREFGKPPKEPHLPELCNRIEASPLLVVSALHGTALGGGLEVALATHYRIAVPQAKVGLPEVHLGILPGAGGTQRLPRVAGVEAALDMITTGRHVRADEALRLGVIDRVAEGEPREIGLSYLRELLDEGAPRRPVGEMPAPAPVDFDAIYAAVLRKGRGQLSPATAVRAVQAACEAESFAAGLKRERELFMELMNSDQREGLIHAFFADRAVGKLPELEGVAPRPLAAIGVIGGGTMGAGIATAALLSGLSVTMLEMTPEAAEAAKGRIEGNLSGALKRGKLTAQQFDNLTTKALTLAIDYDALADADLVIEAVFEDMEVKKQVFTKLDAVCKPGAVLASNTSYLDINQIAAVTSRPQDVLGLHFFSPAHVMKLLEVVIADQTAPDVAATGFALGKRLGKVSVRAGVCDGFIGNRILSVYRTCADHMILDGASPYQIDEALEEFGFAMGPFAVADLAGLDIGWAVRKRKRAEGLDPRARDSAYADKLCEAGHFGQKTGKGYYDYAAGAKARVPNPEVLPLIEAERAQQGITPRAFSKDEIVRRYMAAMVNEAAKVVGEGIARRPLDVDVTLLYGYGFPRYRGGPLKWADMQGLPELLADIKRWAAEDAYFWQPAPLLEQLVAEGRTFDDLNKEAV

SEQ ID NO: 27740 - protein, 471 aa, Robiginitalea biformata HTCC2501
MQANNQYAFGLIGLGVMGRNFILNVAEKGFTALGYDLDPGQVEALKREGGNLDRVNATNSLEAFVQGLETPRKIMLLVPAGPIVDSVIEELLPLVSAGDLIIDGGNSFFRDTDRREAYLKEKNIHFFGAGVSGGAEGARRGPSLMPGGDRDAYREVQPIFEAVAAKFEGTPCVAYLGPKSAGNYVKMVHNGIEYGLMQLTAEAYDLLRRAGGLGNAEIQEVFARWNRGRLQSFLVEISSEILGRKDDLDSGDLIDKVRDQGKQKGTGKWTSQNAMDLGIPVPTIDIAVSMRAISAFKQDRERADTLFERPGAGSVDTEKLIADCEAALYFSFLLTYAQGLHQLAEASETYGYELDLATVARIWRAGCIIRAALLEDIASAYETAPELVNLVFSENFREPLQKAATPARRLVSLGVSAGIPVPGLASALSYFDSYTTGRLPMNLVQAQRDYFGSHTYQRTDRDGTFHTDWDA

SEQ ID NO: 27741 - protein, 584 aa, Vicia faba
MGSVEDDSSRLEEALIQDEESKLYTGDGSVDFKGRPVLKKNTGNWKACPFILGNECCERLAYYGIATNLVKPILLAKLHEGNVSAARNVTTWQGTCYLAPLIGAVLADSYWGRYWTIAIFSMIYFIGMGTLTLSASIPALKPAECLGAVCPPATPAQYAVFFIGLYLIALGTGGIKPCVSSFGADQFDDTDSRERVKKGSFFNWFYFSINIGALISSSFIVWIQENAGWGLGFGIPALFMGLAIGSFFLGTPLYRFQKPGGSPLTRMCQVVAASFRKRNLTVPEDSSLLYETPDKSSAIEGSRKLQHSDELRCLDRAAVISDDERKRGDYSNLWRLCTVTQVEELKILIRMFPVWATGIVFSAVYAQMSTMFVEQGTMMDTSVGSFKIPAASLSTFDVISVIFWVPVYDRFIVPIARKFTGKERGFSELQRMGIGLFISVLCMSAAAIVEIKRLQLAKELDLVDKAVPVPLTIFLQIPQYFLLGAAEVFTFVGQLEFFYDQSPDAMRSLCSALSLLTTSLGNYLSSFILTVVLYFTTRGGNPGWIPDNLNKGHLDYFSGLAGLSFLNMFLYIVAAKRYKSKKAS

SEQ ID NO: 27742 - protein, 469 aa, Bordetella pertussis Tohama I
MASTMETDLLVLGGGPGGYTAAFRAADLGLSVVLVEQRPTLGGVCLNVGCIPSKALLHCAKALDEARAMSELGIEFSEPRIRLDKLRAHKEALVAKLCGGLGGLARQRKVEVVTGTGRFDGPHSLAVSDGSRVAFKQAVIAVGSRPVRLPFLPDDPRIMDSTGALELKEIPRRLLVIGGGVIGMELATVYAALGARVTVVELTDGLLPGCDRDLVKPLAQRVASRYEAVLLGTRVSAAQARDDGIHVSFDGPQAPGPQVYDQVLVAAGRRPNGAAIDAERAGARVDEGGFIRVDAQQRTNVGHIYAIGDVVGEPMLAHKAAHEGKVAAETAAGMRVANDARVIPAVAYTDPEVAWVGLTETAAQRDGIAYEKAAFPWAASGRALSLGRGEGLTKILVDPATHALLGVGMVGPQAGDLIAEAALAIEMGAEPGDIALTIHPHPTLSETLAFAAEAYEGTLTELYLTRKKS

SEQ ID NO: 27743 - protein, 516 aa, Saccharophagus degradans 2-40
MAAILYPARPLVDADPNMKFAELGLCPAIQKAVLEQGYETPTPIQAQAIPPVLEGRDVMAAAQTGTGKTAGFTLPILEILAEGIENGRKVKPNQARALVLTPTRELAAQVGENVALYGKYLPIKSTIVFGGVKINPQMMKLRGGVDILVATPGRLMDLYNQRAVKFDQLEMLVLDEADRMLDMGFIHDIRKIMAILPKKRQNLMFSATFSQDIRELAKSIVNNPVEITVNPPNSTATRVKQWICPVDKKEKPALLTHLIKTNKWQQVLVFSRTKHGANKLVKQLEGSGLRAAAIHGNKSQGARTKALAEFKNGTVKILVATDIAARGLDIDQLPQVVNFDLPQVAEDYVHRIGRTGRAGAEGNAVSLVSADEFQMLKEIERLTKTLLTREVIQGFEPDHNLPESRLDTRPIRPNKPKRPKPAGGASNRSGGGNSGGGNNRAKPRGDDSKAANADTPWAGKAKPRKPRPAGAKPATQGKPAGARNGNTGPKGKGGPAGGGARRPTNKPSGAQGAARS

SEQ ID NO: 27744 - protein, 193 aa, Zea mays
  misc_feature (13)..(13): Xaa can be any naturally occurring amino acid
  misc_feature (104)..(104): Xaa can be any naturally occurring amino acid
  misc_feature (116)..(116): Xaa can be any naturally occurring amino acid
  misc_feature (125)..(125): Xaa can be any naturally occurring amino acid
  misc_feature (139)..(139): Xaa can be any naturally occurring amino acid
  misc_feature (146)..(146): Xaa can be any naturally occurring amino acid
  misc_feature (153)..(153): Xaa can be any naturally occurring amino acid
  misc_feature (169)..(169): Xaa can be any naturally occurring amino acid
MSRCCDWNCESNXGCCWGIGCDDCCVYPDENSVSARYSMITRVHSKICNVSDKCLLASSDFHGCILRSLQEPNCLRMAVLHLHNKRISCPIMQQILYDNLYYEXTYIYNAFHEIRXLLTATANNXWFIYAPLRFQEITXYSAQGNXSNVIMRXPDHHLESPSTLLLPVXDAVSPLSESEAIDLVKDEFASATE

SEQ ID NO: 27745 - protein, 436 aa, Borrelia burgdorferi B31
MSNFFENYLRQVDDIETVSFVGRVQKIKGLLVESLGPQCAIGDLCLIDQRNGKKVCAEVLGFNGPYVSLMAYEGFSGIEVGNKVYSLNKGLEINLSDELLGRVIDSLGRPIDNKGSFLNNSYKELIFEKINPINRSIFEDQILTGVKVLDGFLPVAKGQRVGIFSGSGVGKSTLLGMIAKNSNADVNVIAFIGERGRELNEFIEHELGEERLKKSVLVVSTSDESPISRYKGAYVATMIAEYFREQGKDVALLFDSITRFANAKREMSLSLGEPPVAKGYPPSVFVEIPILLERSGFNGNGGSVTGFYTVLVEGDDFTEPVADNIKAVLDGHIILDRDLFDRGIYPSINVLSSTSRSIHRIMSLEKQKLIMKARNLLSIYKDYEDLIRTGIYLKGSNKDVDFAISKYPKIINFISQGINETFDFENLEDEIKEILS

SEQ ID NO: 27746 - protein, 625 aa, Haemophilus influenzae R2846
MTNNMNNYPLLSLINSPEDLRLLNKDQLPQLCQELRAYLLESVSQTSGHLASGLGTVELTVALHYVYKTPFDQLIWDVGHQAYPHKILTGRREQMSTIRQKGGIHPFPWREESEFDVLSVGHSSTSISAGLGIAVAAERENASRKTVCVIGDGSITAGMAFEALNHAGALHTDMLVILNDNEMSISENVGALNNHLARIFSGSLYSTLRDGSKKILDKVPPIKNFMKKTEEHMKGVMFSPESTLFEELGFNYIGPVDGHNIEELVATLTNMRNLKGPQFLHIKTKKGKGYAPAEKDPIGFHGVPKFDPISGELPKNNSKPTYSKIFGDWLCEMAEKDAKIIGITPAMREGSGMVEFSQRFPKQYFDVAIAEQHAVTFATGLAIGGYKPVVAIYSTFLQRAYDQLIHDVAIQNLPVLFAIDRAGIVGADGATHQGAFDLSFMRCIPNMIIMTPSDENECRQMLYTGYQCGKPAAVRYPRGNAVGVKLTPLEMLPIGKSRLIREGQKIAILNFGTLLPSALEASEKLNATVVDMRFVKPIDIEMINMLAQTHDYLVTLEENAIQGGVGSAVSEVLNSSGKSTALLQLGLPDYFIPQATQQEALEDLGLDTKGIEEKIINFIAKQDNL

SEQ ID NO: 27747 - protein, 585 aa, Oryza sativa Japonica Group
MNPATILGHIQLVHMHPDVSCGVHFVTCFQEPRDKAGRNPNRSEMICRSLLLLRSNAASKASNIVKHVAATGCLPKYSSEAPARYFSSEPSLQVDSTEENGFKGHGMLAPFTAGWQSTDLHPLVIDRSEGSYVYDINGKKYIDALAGLWSTALGGNEPRLIKAATDQLNKLPFYHSFWNRTTKPSLDLANEILSMFTAREMGKIFFTNSGSEANDSQVKLVWYYNNALGRPNKKKFIARSKSYHGSTLVSASLSGLPALHQKFDLPAPFVLHTDCPHYWRFHLPDETEEEFATRLATNLENLILKEGPETIAAFIAEPVMGAGGVIPPPKTYFEKIQAVLKKYDILLIADEVITAFGRLGTMFGCDMYDIKPDLVSIAKALSSAYMPIGAILVSPEITDVIYSQSNKLGSFAHGFTYSGHPVSCAVAIEALKIYKERNIIEHVQKIAPRFQEGIKAFSGSPIVGEIRGLGLILGTEFVDNKSPNDPFPAEWGVGSLFGAECEKRGMLIRVAGDNIMLSPPLIMTPDEVEEIICKYGDALKATEERIAELKAKRVIDDGDDKLTMFNVYRVVSSVDANNELYGLNL

SEQ ID NO: 27748 - protein, 196 aa, Zea mays
KKFRPAFPVGSPLIESILAARAEATGKAGRNLLEEIRKKIEKWQEPPPAKLPKPLPVPDSEPKKKRGGRRLRKMKERYAQTDMMKLANRMQFGIPEESSLGDGLGEGYGMLGQAGSGKLRVSAGQSKLAAKVAKKFKEKSYGSSGATSGLTSSLAFTPVQGIELSNPQVQGNLLGGGTQSTYFSETGTFSKIRRTQ

SEQ ID NO: 27749 - protein, 474 aa, Schizosaccharomyces pombe 972h-
MGGSDFEDDELFKDLYGEENEKKVESASGNQETSNVTPTKENEGYEELEKSGEAGAERTKENPFREEPGADFDRSGSDQQYSAEAEANQEDDLNETSQQAPDPSSYDIRGQALSSATWDNAEDGENSKNDNYNENQSALTGSGAMESNEDNAEETSPFNREDGKMFIGGLNWETTDDSLRDYFEQFGEVLDCTVMRDSTTGRSRGFGFLTFKNPKCVNEVMSKEHHLDGKIIDPKRAIPREEQEKTAKMFVGGVPGDCTEEEFRNFFNQFGRVLDATLMMDKDTGRPRGFGFVTYENESAVEATMSQPYITIHGKPVEVKRATPKASLRDSHDRHQHGYHGNANPYYAQNMNMYGGMTPAMMAQYYRQMQQYMEAMRNMPAAAGAVPYPQPVMPAGMADWQQQQQQGAAYFDPSKMNQGTGDGVPFSPSMPSGSSRGGYHGRNPGGPNRQRYRGRRDGRGGNTGGGHSFHPYRR

SEQ ID NO: 27750 - protein, 492 aa, Schizosaccharomyces pombe 972h-
MSQKEVADFGLIGLAVMGQNLILNGADKGFTVCCYNRTTSRVDEFLANEAKGKSIVGAHSLEEFVSKLKKPRVCILLVKAGKPVDYLIEGLAPLLEKGDIIVDGGNSHYPDTTRRCEELAKKGILFVGSGVSGGEEGARYGPSLMPGGNPAAWPRIKPIFQTLAAKAGNNEPCCDWVGEQGAGHYVKMVHNGIEYGDMQLICETYDIMKRGLGMSCDEIADVFEKWNTGKLDSFLIEITRDVLRYKADDGKPLVEKILDAAGQKGTGKWTAQNALEMGTPVSLITEAVFARCLSSLKSERVRASKKLTGPNTKFTGDKKQLIDDLEDALYASKIISYAQGFMLMREAAKEYGWKLNNAGIALMWRGGCIIRSVFLKDITEAFREDPNLESILFHPFFTNGVEKAQAGWRRVVAQAAMLGIPVPATSTGLSFYDGYRSAVLPANLLQAQRDYFGAHTFRVLPEAADKSLPADKDIHINWTGHGGNISATTYDA

SEQ ID NO: 27751 - protein, 439 aa, Kineococcus radiotolerans SRS30216
MTTTHDAPPTGLARAISGKLLFLFILGDVLGAGIYALVGTLAGEVGGAVWVPLLVALVLASLTAASYAELVTKYPKAGGSAVFAQRAFGKPVVSFLVGFSMLAAGVTSVAGLALAFSGSYLSELIDVPATPAALVFLVLVALLNARGIKESLRANLVMTVVEVGGLLLIIALAAAVLGRGDGNPGHVLEFDGASTPVAGILAASVIAFYSYVGFETSANVAEEAIDPARTYPRALFGGLAVAGVVYVGVALAVSVAVDTATLSGSSGPLLEVVRVADVGLPGWLFSLIALIAVANGALLTAIMSSRLTYGMATDGLLPSALGRVLPGRRTPWVAIVVTTLVSMLLVLSGDLETLAATVVLLLLIVFISTNLAVLVLRKDEPGHRHFRTPTVLPVLGIVSCVVLLTQQEAGVWLRAGLLLAVGVVLHLLTRRFSHRAVEV

SEQ ID NO: 27752 - protein, 162 aa, Solanum lycopersicum
MAPIAVGDVIPDGTVSYFDEQDQMQTVSVYSLAKGKKVIIFAVPGAFTPTCSMKHVPGFIEKAAELKSKGVDEILCISVNDPFVMKAWAKTYPENKHVKFLADGAGKYTHALGLELDLSDKGLGVRSRRYALLVDDLEVKVANIESGGEFTVSGADEIVNAL

SEQ ID NO: 27753 - protein, 161 aa, Musa acuminata
SSMMVSSAATVSRASPAQSSMVAPFTGLKSTSAFRVTRKANADLSHLPSNGGRVQCMKVWPIEGKKKFETLSYLPTLVDEPLVKQIEYLLRSKWIPCLEFSHEGFVWRENHRSPGYYDGRYWTMWKLPMFGCTDAVQVVKEVEECKKEYPKAFVRIIGFDN

SEQ ID NO: 27754 - protein, 186 aa, Glycine max
MSMAKVEEEEQPTSPIHTSPSSYVLLLQIMSKRKTWVCIFVLVYGLLFTSSWNFLKSMVSWYKLRAAESSITSWWPALYASVLLGAVFGVLSMVAALAVVVPAVLVTWIALVGLLAFFGKPKRTLVVEGRMITKEIFGFVMQVLLKEGNIVAAVCAVLGYFVLGRTNGKGVGGGGRSGVELTELGV

SEQ ID NO: 27755 - protein, 161 aa, Musa acuminata
SSMMVSSAATVSRASPAQSSMVAPFTGLKSTSAFPVTRKANADLSHLPGNGGRVQCMKVWPIEGKKKFETLSYLPTLVDEPLVKQIEYLLRSKWIPCLEFSHEGFVWRENHRSPGYYDGRYWTMWKLPMFGCTDAVQVVKEVEECKKEYPKAFVRIIGFDN

SEQ ID NO: 27756 - protein, 314 aa, Kineococcus radiotolerans SRS30216
MLRYAFFGPVGTFSEAALRSVVADAPAVAMPSVDATIEAVRSGAADVGCVPIENSVEGGVPATLDGLAAGDPLVVVAEVVLPVTFVLAVKPGTALADVERVSTHSHAHAQVRGWLRTHLPDALYVPATSTAAAAQALADELAGGAPAGFEGAVCAPTAARGLGLDVLAERIEDRAGAQTRFVLLSRPGAGTVPAPTGDDKTSLVVFLREERPGALVEALEQFVTRGINLTRIESRPAGDALGRYCFSIDCDGHVSEARVGEALMGLHRVSDHVRFVGSYPRAGGGRPPAGTGPTEDDFAAAQGWLDRLRAGAGS

SEQ ID NO: 27757 - protein, 521 aa, Vitis vinifera
MDGADGTVKFGPLNMKADPYLDCAQDVAVSSPVTRQKAAAAKQFIENHYKNYLQGLQDRKERRRALQRRAQEAQVSNEEQEQMLRSLERKETEYMRLQRHKIRIDDFEQLTIIGKGAFGEVRLCRGKSTGEIFAMKKLKKSEMLSRGQVEHVRSERNLLAEVDSRCIVKLFYSFQDSDFLYLIMEYLPGGDIMTLLMREDVLSEDVARFYIAESILAIHSIHQHSYVHRDIKPDNLILDKNGHLKLSDFGLCKPLDDKYSTILLENDVFNTQESTSETEGYSGYDRAPWSMPKERLQQWKRNRRALAYSTVGTLDYMAPEVLLKKGYGMECDWWSLGAIMYEMLIGYPPFCSDDPRITCRKIINWKTCLKLPEEPKISDEAKDLICHLLCDVETRLGTGGVEEIKAHPWFRCIQWDKLYEMEAAHKPTVTGELDTQNFEKFDEVEGPPSTIPRVGPWRKMLTSKDANFIGYTFKKSDIMKSIGTSGTDVRSNGSSKAPSLVSLFGTVNFLQLLFISHENLV

SEQ ID NO: 27758 - protein, 462 aa, Arabidopsis thaliana
MMLRAVFRRASIRGSSSASGLGKSLQSSRLVASSQFHSVSATETLVPRGNHAHSFHHRSCPGCPDCSRTVINGFQGTALQRWVRPFSSDSGDVVEAVVPHMGESITDGTLAAFLKKPGDRVEADEAIAQIETDKVTIDIASPASGVIQEFLVKEGDTVEPGNKVARISTSADAVSHVAPSEKAPEKPAPKPSPPAEKPKVESTKVAEKPKAPSPPPPSKQSAKEPQLPPKDRERRVPMTRLRKRVATRLKDSQNTFALLTTFNEVDMTNLMKLRSQYKDAFLEKHGVKLGLMSGFIKAAVSALQHQPVVNAVIDGDDIIYRDYVDISIAVGTSKGLVVPVIRDADKMNFADIEKTINGLAKKATEGTISIDEMAGGSFTVSNGGVYGSLISTPIINPPQSAILGMHSIVQRPMVVGGSVVPRPMMYVALTYDHRLIDGREAVYFLRRIKDVVEDPQRLLLDI

SEQ ID NO: 27759 - protein, 233 aa, Oryza sativa Japonica Group
MAGGGDELKLLGMWASPYVLRVKLALSLKGLDYEYVEEDLKNKSELLLSSNPVNKKVPVLIHNGKPVCESQIILQYLDEAFPDAGATLLPADPHERAVARFWAAFCDDTIAKASQQASSGKTEEEKAEGEKKVVEALEKMEVGLSECSKGKPFFGGDTVGYVDIVLGSFLAWVRAGDAMKGVKRFDPATTPLLAAWAERFVELDVAKAAMPEVDKLIELAMARMAGAAAAATN

SEQ ID NO: 27760 - protein, 309 aa, Shewanella sp. MR-4
MVNINRFFPLFALLGTGTAYLMPAWFSGLKTSIVPLLVVIMLSMGLTLDVRDFANAFKQKRAVITGLILQFTLMPLSALAISLLLGLNRELTIGMVLVGSVAGGTASNVICYLAKGDVALSITMTALSTLAGVVLTPLIIELLIGEMVAIPLMDMLVSLVKIVLVPVTVGVVLNHFFKPQVAKLAPALPIISIVAIVLAICIIVALNAGQFSQVGPVILLAVFLHNGVGLALGYTCCRLLGFNHTVCKTISIEVGLQNSGLATALCIKFFSPLSAVPSAIFSIWHNLSGALLAGYWASLEQKKQSEEVE

SEQ ID NO: 27761 - protein, 615 aa, Chlamydomonas reinhardtii
MAEARSFDDFIEKDLGWRGFGPAQWVLLLIGGLAYVTMGAVMFLNVFQVGTQSEWLCVAPDASGLCGGSLDAGRALLSRLPTGQLLQPPPTAPTSPRAAAHAPFGPSTAAVPNPEPAATAATIGTVAAAAVKRQLRSSSGAAAAAPDAAAPGASMCGLSPGTQYVWAHPTLTLASEYNLVSLLETLFFGGFMAGNGIFGRMADRHGRRATMAGCAAATAALTALSAAPHLVATGPGALGAYVLATEVVGPAWRGTAGMLTQTFYILGEFLLVGLSLALPAWRHLTLATALGCGLVAALVPLVPESPRWLLLHGRHRQAHAALMSKEASRGHEAALLARCERALGDATADPVTGLAAAGGDRADADGAAGAAAAAATEAESGSLRLILAHGVTRSLLLSASFVMFALSVAYYGVTLALGTLAGSLHLNFFLTAVAELPGYLAIAATTDKLGRRVVIGGGTALAGVACLLCAFASGGPIQVALAMAGKLGCSGAWAVGLTFASELFPTSLRSVALSVASQSGDLGGLVTPVLLLLGPKGSRLERLPFAGMGLMALAAVALVWRLPETRGMPQLETFEELLEWLRRRGPGVSLDAERAGDAAAGHAVSRRVGLGYMSY

SEQ ID NO: 27762 - protein, 219 aa, Streptococcus suis 89/1591
MSHYKIAPSILAADYANFEKELKRLEKTGVEYVHIDVMDGHFVPNISFGADVVAAMRPHSKLVFDCHLMVSNPENHIETFARAGADILTIHAEATVHLQGTLQKIRAAGMKVGVVINPGTPLVTIEPVLNLVDQVLLMTVNPGFGGQAYIPEVAEKIEALVKLREARGLNFDIEVDGGIDDKTIHSAKNAGANVFVAGSYLFKGDLDANVAKLRAALND

SEQ ID NO: 27763 - protein, 229 aa, Silicibacter pomeroyi DSS-3
MSFDRKIKIAPSILSADFANFGAEIRAIEAEGADWVHVDVMDGHFVPNLTFGPMAVKAFRPYVKTVMDVHLMIAPVDPYIDAYADAGADVLTAHIEAGPHIHRTLQAIRGAGMKAGVALNPGTPAESVAHLLDLTDLICVMTVNPGFGGQKFIDMTAKIARLRQMIGDRPVHIEIDGGVDPKTAPLVAQAGADVLVAGSAVFRGGSVDNPGVYGQNIAEIRAAAEGVWA

SEQ ID NO: 27764 - protein, 433 aa, Ostreococcus tauri
MDNVLSIILGGGAGTRLYPLTKKRAKPAVPLGANYRLIDIPVSNCINSDINKVYCLTQFNSASLNRHLAQAYNTNIGTHTRQGFVEVLAAQQSPVNKAWFQGTADAVRQYLWLFEESKCEEYLILSGDHLYRMDYRPFIMKHRETEAAITVAALPCDEKRASSFGLMKIDNTGRVIEFAEKPKGAELQAMKVDTTVLGLDADKAQEMPFIASMGIYVFDAKKMRECLLENFKEADDFGGEIIPMAAQMGLKVQAFLYEGYWEDIGTVDAFFHANLSCNDPNPAFNFHEMNAPIYTQSRFLPPSKVQDCEIERSTIGDGCFITKAKLKNVMVGLRSTVNANCDLEDTLVMGADYYETYDEAKTSALPGGVPIGIGAGTKIRKAIIDKNARIGENCQILNEAGVMDKDCENEGYIIRDGIIVVIKDAVIKPGTVI

SEQ ID NO: 27765 - protein, 876 aa, Arabidopsis thaliana
MRFLSFLIFVFAVLGLVQAQDQSGFISLDCGLVPTEITYVEKSTNITYRSDATYIDSGVPGKINEVYRTQFQQQIWALRSFPEGQRNCYNFSLTAKRKYLIRGTFIYGNYDGLNQLPSFDLYIGPNKWTSVSIPGVRNGSVSEMIHVLRQDHLQICLVKTGETTPFISSLELRPLNNNTYVTKSGSLIVVARLYFSPTPPFLRYDEDVHDRIWIPFLDNKNSLLSTELSVDTSNFYNVPQTVAKTAAVPLNATQPLKINWSLDDITSQSYIYMHFAEIENLEANETREFNITYNGGENWFSYFRPPKFRITTVYNPAAVSSLDGNFNFTFSMTGNSTHPPLINGLEIYQVLELPQLDTYQDEVSAMMNIKTIYGLSKRSSWQGDPCAPELYRWEGLNCSYPNFAPPQIISLNLSGSNLSGTITSDISKLTHLRELDLSNNDLSGDIPFVFSDMKNLTLINLSGNKNLNRSVPETLQKRIDNKSLTLIRDETGKNSTNVVAIAASVASVFAVLVILAIVFVVIRKKQRTNEASGPRSFTTGTVKSDARSSSSSIITKERKFTYSEVLKMTKNFERVLGKGGFGTVYHGNLDDTQVAVKMLSHSSAQGYKEFKAEVELLLRVHHRHLVGLVGYCDDGDNLALIYEYMEKGDLRENMSGKHSVNVLSWETRMQIAVEAAQGLEYLHNGCRPPMVHRDVKPTNILLNERSQAKLADFGLSRSFPVDGESHVMTVVAGTPGYLDPEYYRTNWLSEKSDVYSFGVVLLEIVTNQPVMNKNRERPHINEWVMFMLTNGDIKSIVDPKLNEDYDTNGVWKVVELALACVNPSSSRRPTMPHVVMELNECLALEIERKQGSQATYIKESVEFSPSSASDFSPLAR

SEQ ID NO: 27766 - protein, 330 aa, Thermoplasma acidophilum
MSGCQWQYQGSVMIEIWTEKYRPKSLSEIYGEDENIQKLKSFVEKKEIPHLLFAGSVGTGKTSTAIALAIELFGDSWKENMVEMNASNENGIDVIRNKIKDIARIKPSNPLGFKILFLDEADQLTAEAQAALRRTMEIYSETTRFIFSCNYSSKIIPPIQSRTVVMRFRPVPDEYISRKLQEIAKNEGFQIDEESMHALVEVSAGDMRKAINVLQAVYTSGEISPKKIYEIIGYASPEKIQKMISRAINGLFDEAREIVDGMLIYDGLSGIDIVRSLHSYVRSSMISPKQKIEIIKALADAEFRIVEGSNDRIQLDALIAKLAEIGSRTD

SEQ ID NO: 27767 - protein, 396 aa, Saccharomyces cerevisiae
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSLFGGYVAWEMGKAEDGHDSMAVQIADSSDWPQMKACVLVVSDIKKDVSSTQGMQLTVATSELFKERIEHVVPKRFEVMRKAIVEKDFATFAKETMMDSNSFHATCLDSFPPIFYMNDTSKRIISWCHTINQFYGETIVAYTFDAGPNAVLYYLAENESKLFAFIYKLFGSVPGWDKKFTTEQLEAFNHQFESSNFTARELDLELQKDVARVILTQVGSGPQETNESLIDAKTGLPKE

SEQ ID NO: 27768 - protein, 353 aa, Haemophilus influenzae R2846
MKLSKTFLFITALCCAAPTLAIQNSTSSSGEQKMVMENTQNIREIYLAGGCFWGMEAYMERIHGVKDAISGYANGNTGKTSYHMIGLTDHAETVKVTYDANQISLDKLLKYYFKVIDPTSVNKQGNDRGRQYRTGIYYQDGADKAVIEQALAQLQTKYKKPVQIEVQPIKNYIVAEEYHQDYLKKNPNGYCHIDITKADEPVIDEKDYPKPSDAELKAKLTPLQYSVTQNKHTERSFSNEYWDNFQPGIYVDVTTGEPVFSSNDKFESGCGWPSFTKPIIKDVVHYETDNSFNMQRTEVLSRAGNAHLGHVFDDGPKDKGGLRYCINSASIKFIPLAEMEKAGYGYLIQSIKK

SEQ ID NO: 27769 - protein, 266 aa, Mycobacterium avium subsp. paratuberculosis K-10
MNALARLRGRKVVPQRSDGELDAMAAAGAVVAAALQAVRAAAVAGVSTLSLDQIAESVIRDAGAVPSFLGYHGYPASICASVNDRVVHGIPSAAEVLAPGDLVSIDCGAVLDGWHGDAAITFGVGALDPADEALCQGTRESLEAGIAAMVPGNRLTDVSHAIELGTRAAETRHGRAFGIVEGYGGHGIGRQMHMDPFLPNEGSPGRGPLLAPGSVLAIEPMLTLGTGKTVVLDDQWTVITTDGSRAAHWEHTVAVTDAGPRILTIG

SEQ ID NO: 27770 - protein, 77 aa, Carboxydothermus hydrogenoformans Z-2901
MAGVFERVKKIIVDQLGVEEDEVTMEASFIDDLGADSLDIVELIMAFEEEFELEIPDEDAEKIRTVGDAVNYIQERV

SEQ ID NO: 27771 - protein, 825 aa, Ostreococcus tauri
MRYRAADALDAMGFGSFQVMILAFVGLAWTADAMEMMLLSFLGPAMRCEFGVGKTAEGLLTSVVFAGMMIGAPSWGAMSDQRGRRPALLGSATATLAGGVGSALAGSFGAMLFFRFCVGVGLGGVPVAYGLFIEFLPSGNRGMNLCLIELFWTLGSAIESGLAWIVLPHGSWRLLLLLSTTPLFAFIVCIIIVPESVMYSVSAGRMDEAKETLRRVSKANGKPLPPGELVASHAGDAPELEDRTVFLGSESRTKKFLRKHVPTSFRALLSKTHAKTSLLVWLIFFGCAFLYYGVVLLTTTLNVRENASASLKCLQNNSPYLTSGEYADIFFSSLAEVPGVLIAVAVIDRIGRRGSMALTLAATAVFTFPVAFKSIGVGIRDVALFCSRSAAFASFTILYVFTGEIYPTRIRSSGLGVGNSFARIGGIACPLFAVTLVETGHRVLAVTFFLVVAVVAVAATLSLDIETTGRKLDADDEPGVELAPVTYARSSIRSRRLSRFVARRERRPQNHPRHLSHRACTMGERKVLNKYIPPDFDPAKIPRGKAPKGGQIKVRIMLPMTICCNTCGNFITKGTKFNAKKEDVVGEDYLGMRIFRFYFRCTRCSAVLAMKTDPKNGDYVVEAGASRNYEMWKDTTEEDAERAKEEDEENNEMRRLENRAEESKREMDIMAALDEMRSLNARHAGVSSAAALSAMAARNADVSDERCVNGAIDLMRRSYVESGDLERERLTLGLNARREAELDAETARAVFNQQRGQLIKRIDSESDSDDGPSKKAKMEPPPASIVIKRSTAAAKTKVKPTAAAKPEPSPAGLGGLLCDYGSESD

SEQ ID NO: 27772 - protein, 161 aa, Musa acuminata
SSMMVSSAATVSRASPAQSSMVAPFTGLKSTSAFPVTRKANADLSHLPSNGGRVQCMEVWPIEGKKKFETLSYLPTLVDEPLVKQIEYLLRSKWIPCLEFSHEGFVGRENHRSPGYYDGRYWTMWKLPMFGCTDAVQVVKEVEECKKEYPKAFIRIIGFDN

SEQ ID NO: 27773 - protein, 393 aa, Saccharomyces cerevisiae
MGLILRWKEKKQLSSKQNAQKSRKPANTSFRQQRLKAWQPILSPQSVLPLLILMACVFAPIGIGLVVSTISVQRLVVNYTECDALAPAKHFETIPSEYVDYHFSKKVAVQPQWMVLTDPELGNQTCRIQFEVPNHIKKSTYVYYRLTNFNQNYREYVQSLDLDQLKGKALIGNDLDPNCDPLRTVENKTIFPCGLIANSMFNDTFGTTLTGVNDTADYLLTTKGIAWDTDSHRYGKTEYNASDIVPPPNWAKLFPNGYTDDNIPDLQNWEQFKIWMRTAALPNFYKLAMKNETNGLGKGIYIADIELNYPVRSFYGTKSFVLTTNSIIGAGNEALGIVYLIVAGIATLFAILFLIKVIFKPRPMHDHSYLNFENSDTPFDESSVVSIPLREIL

SEQ ID NO: 27774 - protein, 570 aa, Aspergillus nidulans FGSC A4
MRRSLLRAVESTKPLARVSRSVSRGYSTVNETGTKDPAELDQITTLPNGIRVATESLPGPFAGVGVYVDAGSRYEDASLRGVSHIMDRLAFKSTKTRTADQMHETLESLGGNIQCASSRESLMYQSASFNSAVPTTLGLLAETIRDPLITEEEVLQQLATAEYEINEIWAKPELILPELVHTAAYKDNTLGHPLLCPRERLTEINKAVVEKYRATFFRPERMVVAFAGVPHHEAVRLTESLFGDMQGPSTNNGPSLSGTGVDTTLSDSKSEGQFAAAPQFTPTSTVASAPATTDSSILSKLPFLKKFGSNNPSSSESAPVDLTQASHYTGGFLTLPPIPPPANPMLPRLSYIHLAFEALPISDPDIYALATLQTLLGGGGSFSAGGPGKGMYSRLYTNVLNQHGWVESCIAFNHGYTDSGIFGISASCSPTRINQMVEVMCRELQNLTLDTGYTSLQPQEVNRAKNQLRSSLLMNLESRMVELEDLGRQVQVHGRKIGVTEMCKHIESLTVEDLRRVARKVFGGQVHNKGQGTGKPTVVLQEGELEGFKLRPFAWDEIQERIARWKLGRL

SEQ ID NO: 27775 - protein, 302 aa, Arabidopsis thaliana
MGEVWRWNKEVEMDSIRDCLKHFSSIAIDTEFPGCLKETPMDASEEIRYRDMKFNVDNTHLIQLGFTLFDRRGITKTWEINLSDFNEHKCFKNDKSIAFLKSNGLNLDKIGEEGIGIEEFFRDFSQILKEKDGKITWVNFQGSYDNAYLVKGLTGGKPLPETKEEFHETVEQLLGKFVFDVKKIAESCSGLSSRFGLQRIADVLQMKRVGKAHHAGSDSELTARVFTKLTFDLLNSRKQCVRRVDHQQYQLEQQQLMMTRCYIPIPIPIPRPRSVMFAAHHPNPYFGGGYFGMPVQGRNYVL

SEQ ID NO: 27776 - protein, 444 aa, Sulfitobacter sp. EE-36
MKNWLRKHPQVRTIRVAAADLNGQARGKRIPTRFADKVVEDGTRFPMSVLNLDIWGEDIDDSPLVFESGDADGILHPTERGFLPMPWLDAPSALLPIWMFHEDGRPYGGDPRHALRAVVERYKDRGLTPVCAVELEFFLIDDSGRKLQVPLSPRSGKRRKAAETLSIRALDQFDEFFTDLYDACEEMDIPADTAISEAGLGQFEINLMHCDDALRAADDAWLFKMLVKGLARRHGFAASFMAKPYEDYPGSGLHTHFSVLDKNGNNVFDDGGPQGTAIMRHAVAGCMNAMAGCALVFAPHANSFDRMVPGAHAPTGISWAYENRTSSIRIPSGSHKARRIEHRVSGGDVNPYLMLAAVLGAAMNGIEDGAEPPAPITGNAYAADLPQIPGDWKSAIDAFENSAEVKRIFAPEMVRNFILTKRQELHYMQELTPQEQVEIYLDTV

SEQ ID NO: 27777 - protein, 183 aa, Crocosphaera watsonii WH 8501
MSEVVNANRIRNTLIAVAAITLSIAIFFGFQTQTGSVSLESQAKDSTPIEVAIANGKPTLTEFYADWCTSCQAMAPELAQLKQKYGDSVNFVMFNVDNNKWLPEILRYRVDGIPHFVFIDDQGKEIAQAIGEQPSSVMQANLEALIDHQTLPYAASTGETSDLKSPNNPISDPRSHSSQAKSG

SEQ ID NO: 27778 - protein, 375 aa, Mannheimia succiniciproducens MBEL55E
MSEPAILVLADGSIFRGTSIGAAGHTIGEVVFNTSMTGYQEILTDPSYFKQIVTLTYPHIGNTGTNSEDLESNGVYAAGLIIRDLPMIHSNFRANQSLSDYLKDNNVVAIADIDTRRLTRLLRDKGAMAGCIMSGEVDEQKALELALSFGSMAGKDLAQEVTAQQSYRWTQGEWVLGKGYAEQQNASFNVVAYDFGVKHNILRMLAERGCKLTVVPAKTSAEEVLALNPDGIFLSNGPGDPEPCDYAISAIQTLLATKKPIFGICLGHQLLGLASGGKTKKMAFGHHGANHPVQDLDTQKVMITSQNHGFEVDEHSLPANVRVTHRSLFDNSVQGIELTDQPAFSFQGHPEASPGPHDVAYLFDKFIDAMKQAKA

SEQ ID NO: 27779 - protein, 427 aa, Spiroplasma citri
MVKFKFADIGEGLTEGKVAKIMIEVGDKIKDGVEMFAVETDKVNTEIYAPCDGIVSKINMAVGDTIYVGDVVVEIDDGTAGDSPAPATSEQPTTVPVEEEKAAGVVGAVSISNTVLAPRHLPNNGSANVDSNKNVLSTPIVRKMAADLKIDLTKIQGSGQNGKIMKADLVQGAKSTTTGPTLSTMPINIPQINATGAVRREAMSPIRKAIAKQMTLSKTVIAEATLMKNIDVTKLIEIRAQLKGQAEQQGVKLTYMPFFMKACAIALKDFPILNAAYDQEQQEIIFKDYYNIGMATDTPTGLMVPVVKGVDQLNIMQIAKMINDLATKTRERKLKPDEMKDGTFTITNFGSAGIEFATPVINFPEVAILGVGIIKKAPVINKNNEIEISSILPLSLTIDHRLIDGADGGRFLARVTELLESPALLLL

SEQ ID NO: 27780 - protein, 374 aa, Glycine max
QTIKCKAAIAWEAGKPLVIEEVEVAPPQAGEVRLKILYTSLCHTDVYFWDAKQTPLFPRIFGHEASVGGIVESVGEGVTHLKPGDHALPVFTGECGDCAHCKSEESNMCELLRINTDRGVMIHDGQSRFSKNGQPIHHFLGTSTFSEYTVVHAGCVAKINPAAPLDKVCVLSCGICTGFGATVNVAKPKPGSSVAIFGLGAVAVAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEINKAFDLMLKGSIRCIIRMQE

SEQ ID NO: 27781 - protein, 460 aa, Spiroplasma citri
MENKYDVIIVGAGPGGYVTAIKAAQEGLKTLIIEKEYYGGVCLNVGCIPTKALLKSSKVYDMMKHADNYGIDVAKAAVAPNWVKMQERKAKVVTQLTKGVEFLLKKNKVDLIKGEAKAIDKNTVEVAGKRYLCANLIIATGSVSRRLPLPAFEQAEKAGYVISSTEALSLPTIPKKLIIIGGGVIGIEFACLYHRLGTEVTILQGLDTILELLDKDIREELTKLLIKNKVKIETSVKIKAIKGKSVIYDNSEGKEVKLTSDYCLVSVGRTPVTTGFENIGLKIGERKNIEVDEQCKTNLPGVYAIGDVVGRAMLAHVAWAQGILVIDNIKGKNVKMNYNRIPSCIYSFPEVATVGITEEQAIKDKIAYKAFKFPLAANGKAIADGETDGFVKILCDPKYGEILGAHIVAATATDMISEITACMETEGTIHELAKTVHPHPTLSEIIMEVSHGLEGRAIHI

SEQ ID NO: 27782 - protein, 163 aa, Brassica napus
KPPIYDINAPDLYIPFMAFGTYVVLAGLSLGLDGKFSPEALNWLFVKGLVGWFLQVMLLKVTLLSLGSAEAPLLDIAAYGGYAFAGLCLAGFAKIMWGYSYYALMPCTCLCTGVFLVKTMKRVLFAEVRSYDSSRHHYLLLFLALVQSPLLIRLGNISVNWLF

SEQ ID NO: 27783 - protein, 430 aa, Bacillus subtilis subsp. subtilis str. 168
MPYIVDVYAREVLDSRGNPTVEVEVYTETGAFGRALVPSGASTGEYEAVELRDGDKDRYLGKGVLTAVNNVNEIIAPELLGFDVTEQNAIDQLLIELDGTENKGKLGANAILGVSMACARAAADFLQIPLYQYLGGFNSKTLPVPMMNIVNGGEHADNNVDIQEFMIMPVGAPNFREALRMGAQIFHSLKSVLSAKGLNTAVGDEGGFAPNLGSNEEALQTIVEAIEKAGFKPGEEVKLAMDAASSEFYNKEDGKYHLSGEGVVKTSAEMVDWYEELVSKYPIISIEDGLDENDWEGHKLLTERLGKKVQLVGDDLFVTNTKKLSEGIKNGVGNSILIKVNQIGTLTETFDAIEMAKRAGYTAVISHRSGETEDSTIADIAVATNAGQIKTGAPSRTDRVAKYNQLLRIEDQLAETAQYHGINSFYNLNK

SEQ ID NO: 27784 - protein, 381 aa, Candida maltosa
MSESTVGKPITCKAAVAWEAAKPLSIEDVTVAPPKRHEVRIKLYDTGVCHTDAYTLSGVDPEGAFPVILGHEGAGIVESIGEGVTNVKVGDHVIALYTPECGECKFCKSGKTNLCGKIRATQGKGVMPDGTSRFTCKGKEILHFMGCSTFSQYTVVADISVVAINPKAEFDKACLLGCGITTGYGAATITANVQKGDNVAVFGGGIVGLSVIQGCAERGAAQIILVDISDKKEEWGQKLGATAFVNPTKLPEGTTIVDKLIEMTDGGCDFTFDCTGNVGVMRNALEACHKGWGTSVIIGVAAAGKEISTRPFQLVTGRTWKGAAFGGVKGRSQLPGIVNNYLDGKLKVEEFITHREPLAAINKAFEEMHAGDCIRAVVDLS

SEQ ID NO: 27785 - protein, 76 aa, Populus trichocarpa
MSDTGRPLPKFGEWDVNDPASAEGFTVIFNKARDEKKTGGQPESPGKVVDSHVKPGLNPAKSQPVSFFFSHHIMLF

SEQ ID NO: 27786 - protein, 502 aa, Rhodococcus sp. RHA1
MTESVSQGASSRAKTNRSLQGASGDDVGYRKSLKPRHIQMIAVGGAIGTGLFMGAGGRLSASGPSLVLVYALCGFVAFLVLRALGELVLYRPSSGSFISYAREFYGEKMAFVVGWLYFLMWAMASIVDVTAIALYLKFWAPAVPLIDAAPQWTLALVALFVVTLLNLVSVKLFGEMEFWFAIIKVTALVAFLVFGTLFLVLNGETDLGATGFSIVLDHGGVFPTGAITPILAAGGVIFAYASVELVGIAAGETENPSRIIPKAINTVIIRILLFYVGSVLLLSLLLPFGAYTAQTSPFVTFFSHIGSPETAAVASSVMNFVVLTAALSSLNAGLYATGRVLRSMALNGSAPSFTSKLSGNGVPFGGILLTVGCALLGVGLNAIVPTKAFEIVLEISALGIIAAWGTIMLCQLKLRKWANEGRVERPSFRLFGAPFTSYFVLAFLAFVLVTMGFSETGQWVLGSLVVIVPLLIVGWRRSRARLSTTTDHRDFVPVEIPPRTSH

SEQ ID NO: 27787 - protein, 253 aa, Bacillus subtilis subsp. subtilis str. 168
MRKPIIAGNWKMNKTLGEAVSFVEEVKSSIPAADKAEAVVCAPALFLEKLASAVKGTDLKVGAQNMHFEESGAFTGEISPVALKDLGVDYCVIGHSERREMFAETDETVNKKAHAAFKHGIVPIICVGETLEEREAGKTNDLVADQVKKGLAGLSEEQVAASVIAYEPIWAIGTGKSSTAKDANDVCAHIRKTVAESFSQEAADKLRIQYGGSVKPANIKEYMAESDIDGALVGGASLEPQSFVQLLEEGQYE

SEQ ID NO: 27788 - protein, 371 aa, Oryza sativa Indica Group
MPRRGGAAKKPAGGGELSRFLQSHLQTINDTFQMMAEAAPGGLERTEWSEVVKLGEQVSRQATVAGMVWSGDLPDVETLKENIVAYFNILQGFLLGCHGSTVGAGPTLHKSICSSAKNVVDSSFSLFNQAVSAYESRSPDRKTTIPQVTGTVWEACLALNKVPTTNCVAIGRAMTQIGVYLKDILREMKELPIGDSNGTAEKSSNGAVDTTSCSDRDGSSSDLELDEDFTEEEVAVAKLVVTVASDALVVVKETIRFITCLLKISGNRSGANEEKVETMEQLLSCCRQAADQINDLGASVYPPQDLSEMKSSVKRLYGGANAMRREIGSLGGSPEGAFVALERFEKSLGALEVEIADDVANEMENLTISSS

SEQ ID NO: 27789 - protein, 394 aa, Bacillus subtilis subsp. subtilis str. 168
MNKKTLKDIDVKGKVVFCRVDFNVPMKDGEVTDDTRIRAALPTIKHLADQGAKVLLASHLGRPKGEVVEELRLTPVAARLGELLGKEVKKADEAYGDAVKAQISEMKDGDVLVLENVRFYPGEEKNDPELAKAFAELADVYVNDAFGAAHRAHASTAGIAEHLPAVAGFLMEKELDVLGKAVSNPDRPFTAIIGGAKVKDKIGVIESLLDKVDNLIIGGGLAYTFVKALGYEVGKSLLEEDKIELAKSFMDRAKEKGVNFYMPEDVLVADDFSNDANVKIVPISEIPSDLEAIDIGTKTRETYADVIKNSKLVVWNGPMGVFEIDLFAQGTKAVAEALAEAKDTYSVIGGGDSAAAVEKFGLADKMSHISTGGGASLEFMEGKELPGVAALNDK

SEQ ID NO: 27790 - protein, 335 aa, Bacillus subtilis subsp. subtilis str. 168
MAVKVGINGFGRIGRNVFRAALNNPEVEVVAVNDLTDANMLAHLLQYDSVHGKLDAEVSVDGNNLVVNGKTIEVSAERDPAKLSWGKQGVEIVVESTGFFTKRADAAKHLEAGAKKVIISAPANEEDITIVMGVNEDKYDAANHDVISNASCTTNCLAPFAKVLNDKFGIKRGMMTTVHSYTNDQQILDLPHKDYRRARAAAENIIPTSTGAAKAVSLVLPELKGKLNGGAMRVPTPNVSLVDLVAELNQEVTAEEVNAALKEAAEGDLKGILGYSEEPLVSGDYNGNKNSSTIDALSTMVMEGSMVKVISWYDNESGYSNRVVDLAAYIAKKGL

SEQ ID NO: 27791 - protein, 240 aa, Burkholderia pseudomallei K96243
MSFPLPSKSAPADAFSDFPLLDAEPVPPRIAAALAALREGRAVVLQDDHDRENEADLIVAAERLTDETMALLIRECSGIVCLCLTDEKVRALELPPMAQLNESKNGTAFTVSIEARAGVTTGVSAADRVTTIRAAIADNASPHDIVRPGHVFPLRAAPGGVLARRGHTEGTVDLAILAGLKPAGVLCELMNPDGTMARGADVERFAAQHGLPMLTIAELVAFRERLASLRARDACCADLA

SEQ ID NO: 27792 - protein, 343 aa, Methanococcoides burtonii DSM 6242
MSDKPVKFIDENGLRLDGRRVDEIRPMTVEMGVLSRADGSCYLEWGNNKVLAAVYGPRELHPRRLQRPSEALVRYRYNMAAFSVEDRIRPGPSRRSTEISKVSGEAFETVVMKQFYPGAVIDVFAEVLQADAGTRTAAINAATLALVDAGIPMKGLVAACAVGKVDGQLVIDLNKPEDNYGDADLPIAMTEDGEITLLQMDGNLTADEIAKGVEMVRKGCEQIFAIQKEALLSKFGTTDEMEILEEAELQAEVEKSGIVEDVEAVSDAEDEELEGEENEELELPDEEEAFTDDGEEDASDEAEDLFGEDVSEFEITENAESEDNSSSETEGNESDEDEGEKNE

SEQ ID NO: 27793 - protein, 259 aa, Methanococcoides burtonii DSM 6242
MSEAISRLKKDYLFNLALKGQREDGRGFDETRDLIIETNVIDKAEGSAKVLLGDTQVLVGVKLQVGSPFADSADKGVIITSMELNPIASPNFEAGPPREKAIEMARVVDRGIRESGAIDLNKLCITEGEEVWIVFIDVHVLNDSGNLLDAASLGAIAALMTATIPGEREGRGEDVKLPIREMPVSLSFIDIGGELVIDATNNEESVSDLRLTIVTNQDGSICAMQKSGPGTLSEENFLRSVEKSREVGAKIREEYLLNI

SEQ ID NO: 27794 - protein, 1018 aa, Silicibacter pomeroyi DSS-3
MLTEFWAEALRVHWGIEAVLERLDGEYDLNFLARARNGQDYVLKVMRPGCEAGLVEMQVAALDHIAEVAPGLPFPKVFAALDGAMLPEIADEAGAPRLAWLLERLPGRCYARAKPHSEELILKLGRVLGATDRALEGFAHDGLARNFKWNLMQAGWIGAELQAIADPARRALLREIAAEFSGLRDRLAALPVQAIHNDVNDYNILVKGGLDETRRVSGLIDLGDMCAAPRVCDLAIAGAYVVLDHPKPERALAALVRGYHAANRLSAAEVDLIWPLLRMRLAVSVVNSTLMAAQNPDDPYVTISQAPAWRFLENASVNGGLMAARLRVACGLPVTDGAERVHAYLNQNRGRFAAMFGTDLGEAPMGSLSVENSTWPQNPFHMPIEEAARVGEEFGTGLWLGYYNEPRLIYAEPGFRKGPWKASDRRTVHLAVDVFAPAGTVLHAPLSGRVEAVENRTGHLDYGGVVILHHETPQGDAFYTLYGHLDPEVCDRLKPGDPVAQGAGFARLGDAGQNGGWAPHVHFQLALTTQGMETDWPGVGDPDEMDLWHAVCPNPAALLNLPDDKVFYRPSDKAAVLAGRRAHFGGNLSLTYDDPVMLVRGWKHHLFDEWGRPYLDAYNNVPHVGHAHPRIQAVAADQLQRMNSNTRYLHPAQLAFAEKVLSKLPARFEVCFFVNSGTEANELALRLARAHTGNMGMVTPDHGYHGNTTGAIAISAYKFNKPGGVGQADWVELVEVADDYRGSFRRDDAERATKFADFVDPAIARLQEMGHGVAGFIAETFPSVGGQIIPPKGYLAAVYDKIRAAGGVCIADEVQTGLGRLGDYYFGFEHQGAEPDIVVMGKPIGNGHPLGVLVTTKAIAQSFDNGIEYFSTFGGSTLSCRIGKEVLDIVDDEGLQENARLMGERLMTGLRVLEGEFGCVGDVRGMGLFLGVELINPDGSEGTEICRYVKNRMRDHRILIGSEGPKDNILKIRPPLTIEAEDVDMILWALREVLAEVGDWAPAPACDHDHHHTGCGCC

SEQ ID NO: 27795 - protein, 122 aa, Thermotoga sp. RQ2
MSKKILLVDDSAVLRKIVSFNLKKEGYEVIEAENGQIALERLSEFTPDLIVLDIMMPVMDGFTVLKKLQEKEEWKRIPVIVLTAKGGEEDESLALSLGARKVMRKPFSPSQFIEEVKHLLNE

SEQ ID NO: 27796 - protein, 290 aa, Silicibacter pomeroyi DSS-3
MAKVAFLGLGVMGYPMAGHLKSAGHDVTVYNRSAAKAEKWVTQHGGAMATTPRAAAEGAEFVMACVGNDDDLRSVCAGPDGALAGMAAGSVFVDHTTVSAKVTRELYAAARDGGVGFVDAPVSGGQAGAENGVLSVMCGGDQAEYDRAEPVIAAYARICRRIGESGAGQVTKMCNQIAIAGLVQGLAESLHFAEKAGLDGRAVVEVISQGAAGSWQMANRYETMLDDHWTHGFAVDWMRKDLGICLDTANETGASLPVTALVDQFYKDVQKMGGGRWDTSSLLARLRKLD

SEQ ID NO: 27797 - protein, 158 aa, Haemophilus influenzae R2846
MKKLTLALVLGSALAVTGCFDKQEAKQKVEDTKQTVASVASETKDAAANTMTEVKEKAQQLSTDVKNKVAEKVEDAKEVIKSATETASEKATEIKEAVSEKASEMKEAASEKATEIKEAVSEKASEMKEAASEKATEMKEAVSEKATQAVDSVKEATK

SEQ ID NO: 27798 - protein, 153 aa, Triticum aestivum
GKLKRTKKSPGDFDIYGGHRINVEPIGTIGEDNRPEIRLMGDRDLDNQHILQLEEKEVVSSVATVLSDLCGPGQYMPMRELHAELVGRFGNVWHHSRVRKYLTWEDWSPIIAKGRPWFGLLELLRKHPEHFVINTKWKGREISEFVSLVSLLS

SEQ ID NO: 27799 - protein, 433 aa, Saccharomyces cerevisiae
MQSMNVQPRVLAVGGEQFFSQRQASEQHQQQNMGPQVYSPKVNRARMFPQGMPVNTINGSVNQEMNNAYLLKQKNEPLLTQQQQQQQQQQQPFNIGTPVSVASLPPGLNVLQQQQQQQQQQQQQQQGVGLNRPLASQLPKHLTNQSMPPIFLPPPNYLFVRDVWKSNLYSEFAVIRQLVSQYNHVSISTEFVGTLARPIGTFRSKVDYHYQTMRANVDFLNPIQLGLSLSDANGNKPDNGPSTWQFNFEFDPKKEIMSTESLELLRKSGINFEKHENLGIDVFEFSQLLMDSGLMMDDSVTWITYHAAYDLGFLINILMNDSMPNNKEDFEWWVHQYMPNFYDLNLVYKIIQEFKNPQLQQSSQQQQQQQYSLTTLADELGLPRFSIFTTTGGQSLLMLLSFCQLSKLSMHKFPNGTDFAKYQGVIYGIDGDQ

SEQ ID NO: 27800 - protein, 295 aa, Saccharophagus degradans 2-40
MSTELTHFLAKYREHTNGLLEERLIGLKHYNTDLIEAMRYSLLLGGKRVRPVLVYAAAYATGGISAAADDCACAIEAIHTYSLIHDDLPAMDDDALRRGQPTCHIAYSEATAILAGDALQCQAFEWLANSQHMPASAALQAIAALAKASGASGMVLGQAIDLAAVDKSVDLQHLETMHQHKTGALISASVEMGAIAAGATPTQTAQLRQYASAIGLAFQVQDDILDVTANTATLGKEAGADAERNKPTYVSLLGLDGAKHKASELLQQALASIKDFDERADILRQLATYIVQRDH

SEQ ID NO: 27801 - protein, 174 aa, Streptomyces viridifaciens
MAKHTLSVLVENTPGILARIAALFSRRGFNIDSLAEGLTEHPAIGRITIVVHAEDDLLEQVVRQVSKLVNVLRIVELERDSAVERGLVLAKIRADNRTRPQIIEIVQLFRAKTVDVSPEAVTIEATGTSDKLSALLKMLEPYGITELVQSGTIAIGRGADSISHRAAYELERIA

SEQ ID NO: 27802 - protein, 300 aa, Silicibacter pomeroyi DSS-3
MTGIDDILLNFSPASLMLLNAILAVVMFSIAIDLTLDDFRRLSRGPKPVLVGLFSQFVVLPVLTFALVWLTAPHPSIALGLILVAACPGGNISNFITHRAGGNAALSVSMTAFATVGAIVMTPANIALWGSLYPPTRAILQETHIDPVQIAITVGLMLILPLILGVTLNMRRPALTARLRRPLQLLSMGIFIAFIILALAANWGYFLSFAGAVAGLVILHNALALGGGWVVATLTRLSPYDRRAVTIETGIQNSGLGLVLIFAFFNGLGGMAVAAAFWGIWHAISGLGLAMIMSRTEARR

SEQ ID NO: 27803 - protein, 306 aa, Ostreococcus tauri
MGEAAIFFVRATQGGVSGSIAKTATAPIERVKLLIQTQDANPRIMSGEVPRYTGIVNCFTRVTAEQGFGSFWRGNLANIVRYFPTQAFNFAFKDTIKGLFPSYSPKEAFWPFFAVNMASGGLAGAGSLLIVYPLDFARTRLAADVGNKSTREFTGLVDCLTKIAKRSGPMALYQGFGVSVQGIIVYRGSYFGLYDTGKGALLTKDSRHQRCRRLVLPLRYRPSSSHDELGLRQEVVQRHHGCLRQNLPARRCRRLLQGRILQRSSWCRWRSCARDVRRNQGCHQPVNKRARDVGLFTPRSRANSRT

SEQ ID NO: 27804 - protein, 420 aa, Staphylococcus aureus subsp. aureus Mu50
MKLTVVGLGYIGLPTSIMFAKHGVDVLGVDINQQTIDKLQSGQISIEEPGLQEVYEEVLSSGKLKVSTTPEASDVFIIAVPTPNNDDQYRSCDISLVMRALDSILPFLEKGNTIIVESTIAPKTMDDFVKPVIENLGFTIGEDICLVHCPERVLPGKILEELVHNNRIIGGVTKACIEAGKYVYRTFVQGEMIETDARTAEMSKLMENTYRDVNIALANELTKICNNLNINVLDVIEMANKHPRVNIHQPGPGVGGHCLAVDPYFIIAKDPENAKLIQTGREINNSMPAYVVDTTKQIIKALSGNKVTVFGLTYKGDVDDIRESPAFDIYELLNQEPDIEVCAYDPHVELDFVEHDMSHAVKDASLVLILSDHSEFKNLSDSHFDKMKHKVIFDTKNVVKSSFEDVSYYNYGNIFNFIDK

SEQ ID NO: 27805 - protein, 1187 aa, Aspergillus nidulans FGSC A4
MPKTHQESSRVVAIMKKYLLSLLAAVTYTTAQSVSGSAEGFASGVTGGGGATPVYPADTAELESLLSSEGEQVIVLTKTYDFTGTSATGTACYSWGTGEGCQLILQDDCGDTPSTTVTYDAAGKTPIPVASDKTLLGVGSEGVIKGKGLSFTDNVSNIIVQNIKITELNPEYVWGGDALTFDGSSNICIDHVETSLIGRVHYVFGYNPNSGITLSNNFINGETTYSTSCDGYQYWGLELVGKNDSITFKGNYLYKTSGRSPALSGSTKFHACNNVWSDNNGHAIEGNEKGQGLFEGNVFQEVATVVSSTFWEAGDLFLSSADGTGNDACASYIGRNCASSIYMNDGGDYTSYTDVSWLGDWSAHKGGEKMTSGRITGVWQMYYGLFAFSEDPKLFSIINRLRPSTGGYYENRLVRRAVMPHMAKPKRVAIIGAGPSGLVTAKTLLRNFPPGTFSAVIFEKKPRIGGLWAVDYPSTPYLLRPTPHFSHDYELHCRKQYQGRALVNPWMRTNLSRFSVAFSDLAWETALGDAVPLFPYAWEVRKYLEKYAETYIPKECFKLGKRVLSVTRRGTEIRAKDWAVWEMWRGPSSGHFGSPSIPLIPGLEDISSVHSSELQSPDDIGRLLEKSPKSGKLVVVGGSMSGVETATSLALHLSSLSFRPGSSAQQHNYEVWHVGPGPYWVLPTYLPHNYAKDTEGDAMPFVPLDLSLYDIARRPLGMTGIAFGPTSQDQNRKRNQFFRDMLGEEYSKVGSFHLGDNQGREIQRSPWVGIADHYAEFVRSGAIKTLAGRASSFTNESGLETLNIDTSAGMVRLTEIAAVVMATGFKPSGSLSFLPDDVLSTLEYSKDDHFLPLVLDSMSSAHSEIPDLGFVGFYRGAFWGPAELQAQSLAQTWAAADLENGVSASLSEEEKRSRDGERQQVRDFRDVRPTSLRGQFPLGDYVGLMESFARRLHRSRFPLGISPDANIRTTGPVVPARYALIDHGTLFEYPTLKEVEITMKALKSTLLPDPGQASVTTTAAIFRALHGNWGFERIVSHAGGEDIKSCGKTTFYPRYPSSPMYEAEYLCKEDANDGAAMKTAISVYRHLNTFRFPGQAGISVWFVDGKSCPNSATEFALKLQVEPMGKVTDSGEILVRAVAICESAAKEHTYEFYFDRVAISNWCHRVVWSAKSRDRRQTTWYSRPNDD

SEQ ID NO: 27806 - protein, 495 aa, Staphylococcus aureus subsp. aureus Mu50
MAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGDPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 27807 - protein, 112 aa, Populus deltoides x Populus maximowiczii
TFVGKKWFVTYHAYAMGRMESIWGKNCRDFVPERWLENGIYRQESPFKFPVFHAGPRMCLGKDMAYIQMKSIAASVIERFEIDVQNKEKCPDHLLSLTLRMKGGLQVKVKER

SEQ ID NO: 27808 - protein, 669 aa, Magnaporthe grisea 70-15
MPPKKAAATKAAAAPAAKKAAPAKKSAGVTKTTAPAKKTAAAAKPKAAPAKAAPAKAAPVKAAPAKAAATKAAPKKRKVAEEPEPEKEEEEEVEQAQDEDSEEEEEKPAKGSRKSAPPATKKRSTPVPAPKRAASAQPKKAKAAATKKKTPAPEADKENADPEPKVTGASSPTKRKREDTVEPSHDRGAAKDESEAEDKPAPEREIKQPRPVKRVRTAAPVSKVKIGAKINNAPDAVLDVFVFGEGSSGELGLGSMKYENKKPIDVKRPRINHNLSADKVGVVQLDCGGMHAIALTKDNKVLTWGVNDQGALGRDTTWDGGLRDADAEDSDSDSEDGEDSGLNPVESNPAEIDMSDVAEGTRFVQVAASDSASFALTEDGRVYGWGTFRASDGVLGFTPTIKIQKFPTLLAEPKKVVQIAAGSNHAMALDSAGKLYTWGCPEQNQLGRRCVQRELLASALRPGGVGLKRGVKVVKISCGSYHSFAVDKEGGVYTWGLNNFGQLAIEQDAGDSDAAVLTAVKVESLMDYKIVDIAGGEHHSLACTDDGRLLVWGRIDGHQTGLPFDSFTEENAIYDDYKKPRILKTPTVIPGLPKIVSVAAGTDNSFAITEDGKVYSWGFSINYQTGQGTSDDVEAPTLIDNTAVRDRNITFAGAGGQYSMLACHAEKKA

SEQ ID NO: 27809 - protein, 109 aa, Mycobacterium sp. MCS
MADSATVTVTDDSFSEDVLTSSTPVLVDFWATWCGPCKMVAPVLEEIASEKAGALTVAKLDVDANPTTARDFQVVSIPTMILFKDGEPVKRIVGAKGKAALLRELTDLL

SEQ ID NO: 27810 - protein, 345 aa, Oryza sativa Japonica Group
MSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEVLEMEASVLNYLKFEMTAPTAKCFLRRFVRVAQVSDEDPALHLEFLANYVAELSLLEYNLLSYPPSLVAASAIFLAKFILQPAKHPWNSTLAHYTQYKSSELSDCVKALHRLFCVGPGSNLPAIREKYTQHKYKFVAKKPCPPSIPTEFFRDSTC

SEQ ID NO: 27811 - protein, 177 aa, Plantago major
MASSMLSTSSTAVAGRAQATMVAPYAGLKSTSVFPATRKTGNAKLARNAGKVRCMQVWPPLGKKKYETLSYLPDLTVEQLAKEIDYLLRSKWIPCLEFELEHGFVYRENNRSPGYYDGRYWTMWKLPMFGCTDASQVIAELEECKKEYPNAWVRIIGFDNVRQVQCISFIAAKPPGL

SEQ ID NO: 27812 - protein, 2240 aa, Oryza sativa Indica Group
MSAAQGLALKLRAAPAAAAAAGGVRGEKRRRAASATAAAAARPRHGAMSLEGGFLGGALPAEDRVAPRASASRQAEAGAGAGAARPPPRSMSKIPESSIGLYDPSMERDSCGVGFIAELSGEYNRKTVDDAIEMLERMAHRGACGCEKNTGDGAGILIALPHNFFREANLLEVTKDAGFELPPPGEYAVGMFFMPTDDKRREKSKLLFREKAELLGHTVLGWRRVPTDNSGLGQSAVDTEPVIEQVFVTKSASSKADFERQMYVLRRFSVMSIREVLGVKNGGPKDFYMCSLSSRTIVYKGQLKPSQLKGYFFADLGDESFTSYMALIHSRFSTNTFPSWDRAQPMRVLGHNGEINTLRGNKNWMKAREGLLKCEGLGLTRDEMLKLLPIVDATSSDSGAIDNVLELLIQSGRSAPEAVMMMIPEAWQNDVNMDPERKALYEFFSALMEPWDGPALISFTDGRYLGATLDRNGLRPGRFYVTYSGRVIMASEVGVVDVPPQDVSRKGRLNPGMMLLVDFENHCVVNDDELKKEYSKVRPYGEWLKRQRIQLTDIIESVNEAERIAPSISGALPITKENKADMGICGILTPLKAFGYTREALEMLMLPMAKDGQEALGSMGNDTPLAVMSNREKLTFEYFKQMFAQVTNPPIDPIREKIVTSMECMIGPEGDLSETTERQCHRLTLKSPLLNTNEMEAIKKMNYRGWRSKVLDITYPKKNGRMGLKQTLDKICAQAREAIHEGYTILVLSDRERVAVSSLLAVGAVHQHLVSHLERTRIGLLVESAEPREVHHFSTLIGFGADAICPYLAIEAIWRLQIDGRIPPNDGKPYTQEQLIEKYFYASNYGMMKVLAKMGISTLASYKGAQIFEALGLASEVVSKCFEGTPSRVEGATFEMLAQDALRLHEIAFPSRTLPPGSADANALPNPGDYHWRKNGEVHLNDPFSIAKLQEAARINSREAYKEYSRRIYELNKACTLRGMLKFREIPNQISLDEVEPAKEIVKRFCTGAMSYGSISLEAHTSLAEAMNTLGGKSNTGYITIKNGSKGQLTTQTLTFFHGTVEPFALGRWCCENFVPFNLNTNDAQSLCAFPKKNNPRISAIKQVASGRFGVSIYYLTNAVEVQIKMAQGAKPGEGGELPGHKVIGDIAVTRNSTAGVGLISPPPHHDIYSIEDLAQLIHDLKNANPGARISVKLVSEAGVGIVASGVVKGHADHVLISGHDGGTGASRWTGIKNAGLPWELGLAETHQTLVANGLRGRAVLQTDGQMKTGRDVAVACLLGAEEFGFSTAPLITLGCIMMRKCHTNTCPAGIATQDPVLRAKFAGKPEHVINYFFMLAEEVREIMAQLGFRTVNEMVGRSDMLEIDPKVLEGNEKLENIDLSRLLKPAAEISPGAVQYCVEKQDHGLDMALDNKLIASSTAALRKGVRVFIETPVRNINRAVGTMLSHEVTKRYHIHGLPSDTIHIKLNGSAGQSFGAFLCPGITLELEGDSNDYVGKGLSGGKIVVYPPRNSRFNPQDNIVIGNVALYGATKGEAYFNGMAAERFCVRNSGAQAVVEGIGDHGCEYMTGGTAVILGKTGRNFAAGMSGGIAYVYDVDGKFSSRCNYELVDLYAVVEEDDITTLRMMIQQHRLHTQSDLARDVLLNFDTLLPKFIKVYPRDYKRVLDKLKEEKAAKEAEQKAREVVDKKPVEVIQAPNGISVKTEKVMNEEPSSRPSRVSNAVKYRGFIKYEREGTSYRDPNERVKDWNEVAIELVPGPLLKTQSARCMDCGTPFCHQEGSGAGCPLGNKIPEFNELVHQNRWHEALDRLLETNNFPEFTGRVCPAPCEGSCVLGIIDNPVSIKSIECAIIDKGFEEGWMVPRPPLRRTGKRVAIVGSGPAGLAAADQLNKMGHFVTVFERADRIGGLMMYGVPNMKADKEGIVQRRVELMAKEGVQFIVNAHVGSDPLYSVEKLRSENDAIILACGATKPKALSLSRDLPIPGRELAGIHFAMEFLHANTKSLLDSNLEDGNYISAQGRKVVVIGGGDTGTDCIGTSIRHGCTNLVNLELLPEPPRKRAPDNPWPQNWPRIFRVDYGHQEATSKFGKDPRSYKVLTKRFIGDENGNVKALEVIRVEWGKVNGRFQFKEVEGSEEIIEADLVLLAMGFLGPEATVANKLGLEQDMRSNFKAQFGNFATNVEGVFAAGDCRRGQSLVVWAITEGRQAAAAVDNYLSKDDEGETNGTEDIAVSSEGLVQPVVA

SEQ ID NO: 27813 - protein, 336 aa, Spiroplasma citri
MMKKTQKNITIIGTGAYGTVLANVLTDNDHNVIMYGINNKEVDDINNAHLNRHFFGNLKINKEIKATTNFAEAVEDAEYIILGIPVVAIKLIIEKINKTVTKPVVIINVAKGLDPDTHEVLSKSIIKLMNPKILKEYAGIYGPSIAKEVLQRKPTCIMAVSQDFAIAQEVRELFNNEYFVTFANTDVIGTEYAVALKNALAIASGIFNGLYESDNAKASLITMGLNEIQLFAKTKGAQIETFFNFAGLADLILTATSSKSRNYSLGFEIAQVDNAQKVLSEQVKTVEGVLTCKTIVLDARANNITLPLFEALYDILYHNKRPSVIINNVFTKAILS

SEQ ID NO: 27814 - protein, 447 aa, Bacillus subtilis subsp. subtilis str. 168
MKNDNQTLKRTMTSRHIMMMALGGAIGAGLFKGSSSAIDVAGPSVIIAYLLGGIILLFIMQGLAEMAVRNRNARTFRDLVQQVLGNYAAYFLDWIYWKMWVLNIAAEAVVAAIFIQYWLPGCPIWVLALGISLIVTIVNLLSVKIFAETEYWLAMIKITVIIIFIILGLLLLFVSFGDHTASGFSNLTDHGGFFPHGGTGLITAMLVVIYSYGGTEIIGVTLAETKNPEKVVPKAVRSTLTRIVAFYLLPFFIIVSLIPWNQVNSVPESPFVMVFKMVGIPGADHIMNAVILLAIISSMNSGLYGSSRILYTQASDGRLPKVFSKLSSKNVPMFAILMCTSSLYIGVLISLFAGSQTFNYLMGSLGYTVLFIWLIIGFAHLKSRKQQTETPAYYVKWFPYTTWFAIVALLAILIGVIMTTSIVITGITAAIYLLITVAYLVKGRKHQ

SEQ ID NO: 27815 - protein, 122 aa, Zea mays
KLGQKYRVPLRIARAPGFPSLACPPKGPYAYACLVERVPPPQSPIVAPCDSDLKRRISRVPGVPTMSIPSHGFSIDRPPEAPIGGAPRICSVQPRDVLGCNTRAGLVHPTKSLFHVWVPAKA

SEQ ID NO: 27816 - protein, 535 aa, Arabidopsis thaliana
  misc_feature (413)..(413): Xaa can be any naturally occurring amino acid
  misc_feature (428)..(428): Xaa can be any naturally occurring amino acid
MAEDKNNGRVNDESEYSSEDEGTEDYKKGGYHTVRVGDTFKNGAYVIQSKLGWGHFSTVWLAWDTQESRYVALKVQKSAQHYTEAAMDEIKILKQIAEGDSGDKKCVVKLLDHFKHTGPNGKHVCMVFEYLGDNLLSVIKYSDYRGVPLHMVKELCFHILVGLDYLHRELSIIHTDLKPENVLLLSTIDPSRDVRRSGVPLVLPITKDKIVSESAVKPETKSYTYNGDLTKNQKKKIRKKAKKVVAQDFGGEEALEESERDSNSEARINGNSTVERSEGSSTRLMEGEEAREKANKKNGRGSRRGSRSTRQKLLSDIECKCKLVDFGNACWTYKQFTSDIQTRQYRCPEVVLGSKYSTSADMWSFACICFELATGDVLFDPHSGENYDRDEDHLALMMELLGMMPRKIALGGXRYSRDFFNRQGELRXFRRLRFWPISKVLKEKYDFSEQDAKDMSDFLVTILEFVPEKRPTAAQCLKHPWFNPGPRLLEPSLKPQQPKGEEEGAANENIEKEKDEREAMEAGVGNIAIDVSEPK

SEQ ID NO: 27817 - protein, 336 aa, Bacteroides thetaiotaomicron VPI-5482
MIKVGINGFGRIGRFVFRAAMKRNDIQIVGINDLCPVDYLAYMLKYDTMHGQFDGTIEADVENSKLIVNGQAIRITAERNPADLKWDAVGAEYVVESTGLFLSKDKAQAHIEAGAKYVVMSAPSKDDTPMFVCGVNEKTYVKGTQFVSNASCTTNCLAPIAKVLNDKFGILDGLMTTVHSTTATQKTVDGPSMKDWRGGRAASGNIIPSSTGAAKAVGKVIPALNGKLTGMSMRVPTLDVSVVDLTVNLAKPATYAEICAAMKEASEGELKGILGYTEDAVVSSDFLGDTRTSIFDAKAGIALTDTFVKVVSWYDNEIGYSNKVLDLIAHMASVNA

SEQ ID NO: 27818 - protein, 507 aa, Bacteroides thetaiotaomicron VPI-5482
MQEKIIILDFGSQTTQLIGRRVRELDTYCEIVPYNKFPKEDPTIKGVILSGSPFSVYDKDAFKVDLSEIRGKYPILGICYGAQFMAYTNNGKVEPAGTREYGRAHLTSFCKDNVLFKGVRENTQVWMSHGDTITAIPDNFKKIASTDKVDIAAYQVEGEKVWGVQFHPEVFHSEDGTQILRNFVVDVCGCKQDWSPASFIESTVAELKAQLGDDKVVLGLSGGVDSSVAAVLLNRAIGKNLTCIFVDHGMLRKNEFKNVMNDYECLGLNVIGVDASEKFFAELAGVTEPERKRKIIGKGFIDVFDVEAHKIKDVKWLAQGTIYPDCIESLSITGTVIKSHHNVGGLPEKMHLKLCEPLRLLFKDEVRRVGRELGMPEHLITRHPFPGPGLAVRILGDITREKVRILQDADDIYIQGLRDWGLYDQVWQAGVILLPVQSVGVMGDERTYERAVALRAVTSTDAMTADWAHLPYEFLGKISNDIINKVKGVNRVTYDISSKPPATIEWE

SEQ ID NO: 27819 - protein, 510 aa, Burkholderia pseudomallei K96243
MTQQNRYDLLVVGGGINGAGIARDAAGRGLSVLLCEQDDLASHTSSSSTKLIHGGLRYLEYKEFGLVRKALQERETLLRAAPHIMWPLRFVMPHMPNLRPAWLIRVGLFLYDHLAKRELLPGSRGIDMRRHPAGAPLVDSIKRGFVYSDGWVDDARLVVLNALDAQERGARILTRTKLVSAERRDGQWHARLQRADGSTLDVRARAIANAAGPWVGEVLHGALGRGAQHSVRLVKGSHIITPRLFDHDHAYIFQNPDKRIIFAIPYERDFTLIGTTDVEYRDDPSRVAIDRDETRYLCESINRYFKRKISPADVCWTYSGVRPLLEDENADNPSAVTRDYRLELDDGEGAPLLSVFGGKITTFRKLAEEATDMLGGALGAARGAWTAGVPLPGGDIANARFAPFAEAFAKRHPWLPAALARRYARAYGTRAERVIGRARSLAELGEQLAPGLYEAELRYLRDVEWAGCADDVLWRRSKLGLHVAPGTLEPVTAALDAWFGAAREAASAAH

SEQ ID NO: 27820 - protein, 557 aa, Burkholderia pseudomallei K96243
MPAMNLHSNLSGAPFSWRNPYPTTRVPVFARNVVSTSHPLAAQAGLRMLWKGGNAVDAAIAAAAAITVVEPVSCGLGGDAFALVWDGAKLHGLNASGVAPAAWSVDYFRRRHGEAGNGLARQPVRGWDTVTVPGVIAGWEALHAKFGTLPFADLLEPAIELAERGHAVAAVVAHKWAAAVPELSGQPGFAQTFMPHGRAPEVSERVRLPGHARTLRTIAAEGARAFYEGSLAESIAAFFRDGGGALTLDDLRAYRPEWVEPIGKDFRGYTVHEIPPNGQGIAALIALGIVERFGLDDLPLDSAQAQHVQIEAMKLAFADVYRYVADPRAMELTPAQMLDDAYLAARAKLIDPRRATHFSFGMPRAGGTIYLSAADERGMMVSFIQSNYMGFGSGLVVPGTGIALQNRGCGFSMDPASPNVVAGGKRPFHTIIPAFVTQQAGSARHAVMSFGVMGGDMQPQGHLQTIVRMLGYGQQPQAACDAPRWKVSRSFTLDVEATFDASVVEALAARGHTIQAIDDPYMDFGSGQFIWRLDRDEPDRGYVAASDSRRDGLAAGF

SEQ ID NO: 27821 - protein, 108 aa, Ustilago maydis 521
MDLSSLTGKSAAAGGATSAERKEAIKQQVSSELAMANAQQLITKATEKCYSKCIPAPGASLSGKEQTCLTRCMERYFEAFNIVSSTPYVVEYHTIAYVGLKCTLYHHP

SEQ ID NO: 27822 - protein, 74 aa, Triticum aestivum
FAAGWGVMVSHRSGETEDVTIADIVVGLRAGQIKTGAPARSERLAKLNQILRIEEELGDKAIYAGDKFRTAINM

SEQ ID NO: 27823 - protein, 485 aa, Burkholderia pseudomallei K96243
MSFASLGLAEPLVRAVNELGYTQPTPIQAQAIPAVLGGGDLLAGAQTGTGKTAGFTLPILQRLHAFYAENRSARRAVRALILTPTRELAAQVEESVRAYSKYVKLRSTVMFGGVSINPQIDALKRGVDIVVATPGRLLDHMQQKTIDVSSLDILVLDEADRMLDMGFIHDIKRVLAKLPAKRQNLLFSATFSDEIKSLADSLLDSPALIEVARRNTTAETIAQKIHPVDRDRKRELLTHLIREHNWFQVLVFTRTKHGANRLAEQLTKDGISAMAIHGNKSQSARTRALSEFKSSTLQVLVATDIAARGIDIDQLPHVVNFDLPNVPEDYVHRIGRTGRAGANGEAVSLVCVDEKQLLRDIERLIKREIPQQVIPGFEPDPNAKPEPIQRRGQRGAVAGNGGSGNGNSGGAGNGGRGNRAPRAASQPQAQQGQAAARRDGGTQAKAAKPQQARGGNSRPAGNGNSNGGGAHANRSRSSRSGQRGR

SEQ ID NO: 27824 - protein, 377 aa, Zea mays
MEQVVNTVMDLVVPPASMVMLAFAWPTLSFLRGVEWALKTLTKEDMLGKVVVITGASSAIGEQIAYEYARRNANLVLVARREQRLFAIRDNARLLGAGHVLVIAADVVKEDDCRRLVADTVSYFGQLNHLVNTVSLGHDFSFEEAGDTTAFPHLMDINFWGNVYPTHAALPYLRRSHGRVVVNASVESWLPMPRMSLYSAAKAAVVDFYETLRYEVKEEVGVTVATHGWVGGDAGGSKFTLDQQQQHQEGAAADQVQWKQQQGEREAAAAALPGGHVEAYARALVAGACRGDAYVKRPSWYDVFLVFRVFAPDVLAWTFRLLLSTSTPAPAGPSAIAARRPPPAALPAPPLRPLLEYPPAAVSRGPAHAQQVVQKLE

SEQ ID NO: 27825 - protein, 119 aa, Populus deltoides x Populus maximowiczii
AGDMFQAVPPAEAILLKCILHDWSDEDCVKILKRCKQAIMSEGQQKAGKVIIIDMVRENQNGDEGSIETQLIFDLAMMVVVSGVERNEKEWAKLFFDSGFLNYKIHPVPGTRAVIELYP

SEQ ID NO: 27826 - protein, 499 aa, Trametes versicolor
AIGPAASLVVANAPVSPDGFLRDAIVVNGVFPSPLITGKKGDRFQLNVVDTLTNHTMLKSTSIHWHGFFQAGTNWADGPAFVNQCPIASGHSFLYDFHVPDQAGTFWYHSHLSTQYCDGLRGPFVVYDPKDPHASRYDVDNESTVITLTDWYHTAARLGPRFPLGADATLINGLGRSASTPTAALAVINVQHGKRYRFRLVSISCDPNYTFSIDGHNLTVIEVDGINSQPLLVDSIQIFAAQRYSFVLNANQTVGNYWIRANPNFGTVGFAGGINSAILRYQGAPVAEPTTTQTTSVIPLIETNLHPLARMPVPGSPTPGGVDKALNLAFNFNGTNFFINNASFTPPTVPVLLQILSGAQTAQDLLPAGSVYPLPAHSTIEITLPATALAPGAPHPFHLHGHAFAVVRSAGSTTYNYNDPIFRDVVSTGTPAAGDNVTIRFQTDNPGPWFLHCHIDFHLEAGFAIVFAEDVADVKAANPVPKAWSDLCPIYDGLSEANQ

SEQ ID NO: 27827 - protein, 476 aa, Zea mays
MAHPHLVLPSPKSLLPAAATPSRRAVAIRAALSTALSPAKAAAGAEAVRSIRARQIVDSRGNPTVEVDLVAGDGRLHRSAVPSGASTGIYEALELRDGDKAVYGGKGVLQAVRNINEVIAPKLIGVDVRNQSDVDAVMLDIDGTQNKSKLGANAILGVSLSVCRAGAGAKGVPLYKHIQELAGIKELVMPVPAFNVINGGSHAGNNLAMQEFMILPVGATTFAEALRMGSEVYHVLKSIIKSKYGQDACNVGDEGGFAPNVQDNREGLILLMDAIEKAGYTGKIKIGMDVAASEFLTKDGNYDLNFKNQPNDGAHILSAQHLGDLYRDFVKDFPIVSIEDPFDQDDWSSWASLQSSVDIQIVGDDLLVTNPKRIADAIDKKACNALLLKVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 27828 - protein, 1333 aa, Saccharomyces cerevisiae
MECVSVEGLDSSFLEGQTFGDILCLPWTIIKGIRERKNRNKMKIILKNVSLLAKSGEMVLVLGRPGAGCTSFLKSAAGETSQFAGGVTTGHISYDGIPQKEMMQHYKPDVIYNGEQDVHFPHLTVKQTLDFAISCKMPAKRVNNVTKEEYITANREFYAKIFGLTHTFDTKVGNDFISGVSGGERKRVSIAEALAAKGSIYCWDNATRGLDSSTALEFARAIRTMTNLLGTTALVTVYQASENIYETFDKVTVLYAGRQIFCGKTTEAKDYFENMGYLCPPRQSTAEYLTAITDPNGLHEIKPGFEYQVPHTADEFEKYWLDSPEYARLKGEIQKYKHEVNTEWTKKTYNESMAQEKSKGTRKKSYYTVSYWEQIRLCTIRGFLRIYGDKSYTVINTCAAIAQAFITGSLFYQAPSSTLGAFSRSGVLFFSLLYYSLMGLANISFEHRPILQKHKVYSLYHPSAEALASTISSFPFRMIGLTFFIIILYFLAGLHRSAGAFFTMYLLLTMCSEAITSLFQMVSSLCDTLSQANSIAGVVMLSIAMYSTYMIQLPSMHPWFKWISYILPIRYAFESMLNAEFHGRHMDCGGTLVPSGPGFENILPENQVCAFVGSRPGQSWVLGDDYLRAQYQYEYKNTWRNFGIMWCFLIGYIVLRAVFTEYKSPVKSGGDALVVKKGTKNAIQRSWSSKNDEENLNASIATQDMKEIASSNDDSTSADFEGLESTGVFIWKNVSFTIPHSSGQRKLLDSVSGYCVPGTLTALIGESGAGKTTLLNTLAQRNVGTITGDMLVDGLPMDASFKRRTGYVQQQDLHVAELTVKESLQFSARMRRPQSIPDAEKMEYVEKIISILEMQEFSEALVGEIGYGLNVEQRKKLSIGVELVGKPDLLLFLDEPTSGLDSQSAWAVVKMLKRLALAGQSILCTIHQPSATLFEQFDRLLLLGKGGQTIYFGEIGKNSSSVIKYFEKNGARKCQQNENPAEYILEAIGAGATASVQQNWPDIWQKSHEYANINEKINDMIKDLSSTTLHKTATRASKYATSYSYQFHHVLKRSSLTFWRNLNYIMAKMMLLMISGLFIGFTFFHVGVNAIGLQNSLFACFMAIVISAPATNQIQERATVAKELYEVRESKSNMFHWSLLLITHYLNELPYHLLFSTIFFVSSYFPLGVFTEASRSSVFYLNYAILFQLYYIGLALMILYMSPNLQSANVIVGFILSFLLSFCGAVQPASLMPGFWTFMWKLSPYTYFLQNLVGLLMHDKPVRCSKKELSLFNPPVGQTCGEFTKPFFEFGTGYIANPDATADCAYCQYKVGDEYLARINASFSYLWRNFGFI

SEQ ID NO: 27829 - protein, 450 aa, Crocosphaera watsonii WH 8501
MSYDFDLFVIGGGSGGIATARRAAEYGAKVGLAEYNRLGGTCVNVGCVPKKLMVYTSHFSAQFQESQGYGWSPVKSTLDWSKMITAVNEETQRLNGIYLRMLDNSKVKLYRDYAKLLDPHTIEVGNSKITADKILIAVGGHPVRPDIPGIENTIISDQMFTLAEQPKRMVIWGGGYIGVEFACIMRGLGSDVIQVIRRDKILRGFDEDIRSTIQESMENHGIKILKNCTITAIEKTSQGLKIAVQGDQNNEMVLVDTIGLAATGRKPSLDNLGIENTAVEVNNGAIAVDQYGCTAQDNIYAVGDCTDRINLTPVAINEGRAFADTHFGGKSRVMSYENVPSAVFSTPEAATVGLTEEEAKQQYGEDAIKVYRSKFRPMYYVLPGKEEKTLMKLIVHQESEKVLGAHMVGDYAAEIIQGVAIAVKMGAKKSDFDATVGIHPTSAEEFVTMR

SEQ ID NO: 27830 - protein, 525 aa, Spiroplasma citri
MKAKQPILLAILDGWGIAPDSKGNAVTQGHMVNVEKLKTKYPWVSAHAAGEWVGLPEGQMGNSEVGHIHLGAGRIKYESLTLINKTIKDGTFNQNPELLAAINFAKKSNGAFHIMGLFSVGGVHSHLNHIFAAYKLAAQEGIKEIYLHIFGDGRDTKPECIKIYLEQFQQLQNQLKVGEIATIGGRYYAMDRDKKYDRVQIAYDVLVSRKGSEFSDPIEYINREYQAGRNDEFLMPAYNINTPKGYIKSGDGVFFANFRPDRAIAIASALTNPNFPGNEAQTYFMPKLHDIYFVSMMEYAETVASKHVAFKPIKVVNGLGEWLSKKGYRQLRIAETEKIAHVTFFFDGGKDYFKNGLATQAEITLTGASADLIPSPKVATYDLKPEMSAYEITDKLITELNQNEFDVIILNFANCDMVGHTGILPAAIEAVKTIDNCLGKIYTAIQKVNGIMIITADHGNVEIMIDETGGPNKKHTSQLVPIIITKEGLQLRQDNPAIADIAPTILDLLGEGIPPEMTQPSLIIK

SEQ ID NO: 27831 - protein, 363 aa, Salmonella enterica subsp. arizonae serovar 62:z4,z23:--
MGFKCGIVGLPNVGKSTLFNALTKAGIEAANFPFCTIEPNTGVVPMPDPRLDQLAEIVKPQRILPTTMEFVDIAGLVKGASKGEGLGNQFLTNIRETEAIGHVVRCFENDNIIHVAGKVNPAEDIDVINTELALADLDTCERAIHRVQKKAKGGDKDAKAELAALEKCLPHLAEAGMLRSLDLTDEDKAAIRYLSFLTLKPTMYIANVNEDGFENNPYLDQVREIAAKEGSVVVPVCAAVEADIAELDDEERDEFMAELGLEEPGLNRVIRAGYRLLNLQTYFTAGVKEVRAWTIPVGATAPQAAGKIHTDFEKGFIRAQTIAFDDFITYKGEQGAKEAGKMRAEGKDYIVKDGDVMNFLFNV

SEQ ID NO: 27832 - protein, 174 aa, Plantago major
MASAMMSSAATVTAQTSMVGQFSGLKFGSTFPIAKKTGRVSSPSSGLKVRCMQVWPPTGKKKYETLSYLPDLTVEQLAKEIDYLLRSKWIPCLEFELEHGFVYRENARSPGYYDGRYWTMWKLPMFGCTDASQVIAELEECKKEYPNAWVRIIGFDNVRQVQCISFIASKPPGL

SEQ ID NO: 27833 - protein, 552 aa, Salmonella enterica subsp. arizonae serovar 62:z4,z23:--
MPFRALIDACWKEKYTASRFTRDVIAGITVGIIAIPLAMALAIGSGVAPQYGLYTSAVAGIVIALTGGSRFSVSGPTAAFVVILYPVSQQFGLAGLLVATLMSGFFLILFGLARLGRLIEYIPVSVTLGFTSGIGITIGTMQIKDFLGLQMAHVPEHYLQKVGALFMALPTVNIGDAAIGVVTLGTLISWPRLGIRLPGHLPALLAGCAVMGIVNLLGGDVATIGSQFHYILADGTQGNGIPQLLPQLVLPWNLPGSDFTLSWDSLRALLPAAFSMAMLGAIESLLCAVVLDGMTGTKHKANSELIGQGLGNMVAPFFGGITATAAIARSAANVRAGATSPVSAVIHAILVILALLVLAPLLSWLPLSAMAALLLMVAWNMSEAHKVVDLLRHAPKDDIIVMLLCMSLTVLFDMVIAISVGIVLASLLFMRRIARMTRLAPVNVDVPDDVLVLRVIGPLFFAAAEGLFTDLESRIKGKRIVVLKWDAVPVLDAGGLDAFQRFVKRLPEGCELRISNLEFQPLRTMARAGIKPIPGRLTFFPNRTAALADLIS

SEQ ID NO: 27834 - protein, 197 aa, Pseudomonas sp. Y2
MTCYSLNGLIPVVHPSAYVHPSAVLIGDVIIGPNCYVGPLASLRGDFGRIVLEEGANIQDTCVMHGFPDSDTVVGCNGHIGHGAVLHGCRIGEDVLVGMNAVVMDGAEIGARSFVSATAFVKAGFSCAEQSLVMGAPASVKRPLSDQEVAWKQAGTREYQLLAQRCLQDMVACQPLAEVEEQRPRIADRGLRPKGQV

SEQ ID NO: 27835 - protein, 480 aa, Triticum aestivum
  misc_feature (439)..(439): Xaa can be any naturally occurring amino acid
  misc_feature (448)..(448): Xaa can be any naturally occurring amino acid
  misc_feature (471)..(471): Xaa can be any naturally occurring amino acid
  misc_feature (478)..(478): Xaa can be any naturally occurring amino acid
PLLVRCRPIPGDFVEQVCTKKQAGTGPEFPGYRRPTRPHKWELEGHPMDAFRVSLSSAVSSSSHGSGHDDGDALGDVFIWGEGTGEGILGGGNSRVGSSSGAKMDCLLPKPLEFAGRLDVQNISCGGRHATLVTKQGEVYSWGEESGGRLGHGVDCDVPQPKLIDALAHMNIELVACGEYHTCAVTLSGDLYTWGNGTFNFGLSGHGNEVSHWMPKRLNGPLEGIHVSSISCGPWHTAAVTSAGQLFTFGDGSFGVLGHGDRQSISVQREVESLKGLRTVRAACGVWHTAAVVEVMVGNSSSSNCSSGKIFTWGDGDKGRLGHGDKETRLVPTCVASLVEPNFCQVACGHCFTVALTTSGHVYTMGSSVYGQLGNPQADGMVPARVEGKLHKNFVEEISCGAYHVAVLTSRTEVYTWGKGANGRLGHGDTDDRNSPTLXEALKDKQVXSVVCGINFTAAICIHKWVSGVDXSMCSGCXLP

SEQ ID NO: 27836 - protein, 269 aa, Bacillus subtilis subsp. subtilis str. 168
MNEAILSRNHVKVKGSGKASIMFAPGFGCDQSVWNAVAPAFEEDHRVILFDYVGSGHSDLRAYDLNRYQTLDGYAQDVLDVCEALDLKETVFVGHSVGALIGMLASIRRPELFSHLVMVGPSPCYLNDPPEYYGGFEEEQLLGLLEMMEKNYIGWATVFAATVLNQPDRPEIKEELESRFCSTDPVIARQFAKAAFFSDHREDLSKVTVPSLILQCADDIIAPATVGKYMHQHLPYSSLKQMEARGHCPHMSHPDETIQLIGDYLKAHV

SEQ ID NO: 27837 - protein, 312 aa, Oryza sativa Japonica Group
MVPHGRVHPAAAASSSDFSGEMNQSAASSDPSSSPPYSFHFEKPLPPTAAAPPPADARRYQQLLPAPQPGTYVVQMPKDKVFRVPPPENARLFQHYTRRARRRARCSCARVCSWLLLALVLLAAALAASAAVVYLVFKPRQPDYTLLSLAVSGLGGILGNASSTAAPAPVSFSPEFDATVRADNPNGKIGVHYEGGGSHVAVSYGGVRLADGAWPAFYQGPRNVTVLVATAKGLGIRFSERLLGDIAAAGRLRSVPFDVDVKVPVRLQVGGVRTWAVPVRVRCAVVVDRLAADAKVVSKSCRVKARFLFWKD

SEQ ID NO: 27838 - protein, 618 aa, Thermotoga maritima MSB8
MRKMAVQKLPEKDFFAPLKAWKFLVRKPVTIEVPNKIRREASERYRGFHVNDWGKCIGCGTCAKICPTDAITMVEVPDLTQEDGKLPQRPVIDYGRCSFCALCVDICTTGSLKMTREYIHISEDPEDFIFMPTDKGLNAKKGLYEFGKAPLGWVRDENSELLDLERIEMPVEPPEVRIKSFIEIVKGYSREQAMQEAARCVECGVCTYTCPEHMDIPQYIKSVYEDNLEEGLRWLYRTNPLSMVCGRVCTHRCETACSVGVRGEPVAIQWLKRYIVDSIPLERYGEILDIKPERKGKSVGIIGSGPAGLAAAYFLATMGYDVTIYESESKPGGVMRYGIPKYRLPDEALDKDIAFIEALGVKILLNTRVVQDVSFEDVRKRHDVVFLATGFGLGRSTGVPGTDHPDVKQALPLLKMIRDYLRGDGPKPPVPERLVVIGGGNVAMDISRSMARLQFMEYGRVNVQVLSLEGCFEDMPADMEEIEEALEEGIVINPGWGPMEVVIENDRIKGVKFKKCVSVFDGEGRFNPQFDEKEQIFVEADMVVEAIGQAPDYSYLPEEIRSKLEFFRGRIKTNEYNQTSVEWLFAGGDIVHGPDIIHGIADGYAAAKGIDMYLRKEK

SEQ ID NO: 27839 - protein, 422 aa, Shewanella sp. MR-4
MNSHSGTIGRWQGAGLMATTLLGTGVFILPQMTIDKAQAGALIAWSLLTLAIIPVALIFGRLASVFPHAAGPAYFVEKAFGRTAGRTIGLIFLLVVPMGAPAAILMTFQFVNALIPLDGWSKVGAEVLVIFGLFLLNLRGIQVSAKLQFGLTLCIMAIVVLLFGASSVQPGHLTSLASYGTPEIPTIMIAAGIAFWSFLGIEAMTHLADDFRRPQQDMIPAMMMGTVLVGIIYVACTLILLLVPTDKSVAMIGVFDALLGGYGAQVIGVLGIASGLATVNVYAASAARLIWSFGNEGILPRCFAVKNRHGVPIRALAALLSVMASVIVLTHTTGQELEHLIAWSNGVFVVIYLMAMLAAAKLLPRSNLPLVVLGCGFCLALGIALGASMAYVLVLILFVAPFLWWQKTHISRKQSLAVNKAS

SEQ ID NO: 27840 - protein, 557 aa, Galdieria sulphuraria
MEAITEFQQAAEPKNDLYDSTELQKEAGVTDLDDEYLTEEERLHPWRQTRTFYWSVIVASVAVLFYGIDITAISGAQVGYIPHFGLENRTYHQGVMVSCIYFGCFVGVFIALFTNTYFGRRFTISLASFISTGACIWEAVSPSWQVFIPGRIILGFSYGMIGETAPVYLAEMSPASIRGAIVSLYQQVVTIGIFLAYLCNLIFVWVNYQNVGWRIMIGFPMVPSVIEMFLIWTVPESPRWLIKRRRYEDAKRNLFKLRRTAETAERDFVRIKKGVEEDEILQKGKNLLVEVIPVPYIRRALLIGIMEMLFQQMSGMNVFMNYIDEVFEENINMGARTSVAVSLFPGFVNMVATVIVYFTIDRYGRRTLQLVTFPVMFLMLLMVLFSFYGDKKVNLAFFIIGVVFFIVAYSPGAGPVPWTFCAEVFPTYVRAAGTTITTFFVNAFNFALSFSWPSMKAAWGPQGGFGFYAGFNFLGIVMQFLFLPETKGFTLEQMRVVFEEGLFTIAAYHCRAGWRSLRKLLGLSVPDTPLVSPYDKAFAIDRAKREEEMMHAGEVSK

SEQ ID NO: 27841 - protein, 98 aa, Oryza sativa
  misc_feature (23)..(23): Xaa can be any naturally occurring amino acid
  misc_feature (31)..(31): Xaa can be any naturally occurring amino acid
AIATPGTLPTCAALGHMSGPKPXSILPAEYXRSMSDLSAQIEESGYETATAADHWMSKGKSADRPWVWSTTDDYGYDAVKAMTQHNGGAPAGGKPGPD

SEQ ID NO: 27842 - protein, 482 aa, Salmonella enterica subsp. enterica serovar Typhi str. CT18
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQTDKRLLVIKQPIGVTAAITPWNFPSAMITRKAGPALAAGCTMVLKPASQTPFSALALAELAQRAGILAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 27843 - protein, 427 aa, Salmonella enterica subsp. enterica serovar Typhi str. CT18
MNTNNTLMQRCHNAVPRGVGQIHPIFAERAENCRVWDVEGREYLDFAGGIAVLNTGHLHPGIVSAVEAQLKKLSHTCFQVLAYEPYLALCERMNQKVPGDFAKKTLLVTTGSEAVENAVKIARAATKRSGAIAFSGAYHGRTHYTLSLTGKVHPYSAGMGLMPGHVYRALYPCPLHNISDDDAIASIERIFKNDAAPEDIAAIIIEPVQGEGGFYAASPAFMQRLRALCDQHGIMLIADEVQSGAGRTGTLFAMEQMGVAADITTFAKSIAGGFPLAGVTGRADVMDAIAPGGLGGTYAGNPIACVAALAVLDIFEQENLLQKANTLGKTLRDGLMEIAETHREIGDVRGLGAMIAIELFENGDPGKPNATLTADIVARAREKGLILLSCGPYYNILRILVPLTIEASQIRQGLEIIAQCFDEAKQA

SEQ ID NO: 27844 - protein, 115 aa, Burkholderia pseudomallei K96243
MLYTGSCHCGKVRFEVEGEIDGACACNCSMCARKGSLLWFVPRDALRLQTPDEDIATYLFNKHVIRHRFCPTCGIHPFAEGTDPKGNAMAAVNLRCVDGVDLDALSVRHFDGRAL

SEQ ID NO: 27845 - protein, 507 aa, Rhodococcus sp. RHA1
MTVYARPGSPDAVMSFQSRYDNWIGGQWVAPVKGQYFENPTPVTGQPFCEVARSTSEDIELALDAAHAAAPAWGKTSVAERAIILNKIADRIEENLESIALAESWDNGKPIRETLYADIPLAVDHFRYFAGAIRAQEGALSEIDSDTVAYHFHEPLGVVGQIIPWNFPILMAVWKLAPALAAGNAVVLKPAEQTPASILHLISVIGDLLPAGVLNIVNGFGVEAGKPLASSPRIRKIAFTGETTTGRLIMQYASQNLIPVTLELGGKSPNIFFSDVLSSNDDYQDKALEGFTMFALNQGEVCTCPSRSLIQEDIFDEFLAMAAIRTKAVRQGDPLDTDTMIGAQASNDQLEKILSYIEIGKGEGAKVVTGGERAELGGDLSGGYYVQPTIFTGQNKMRIFQEEIFGPVVSVTSFKDYDQAIEIANDTLYGLGAGVWSRDGGVAYRAGRDIQAGRVWTNTYHQYPAHAAFGGYKQSGIGRENHLMMLEHYQQTKNLLVSYAQKAQGFF

SEQ ID NO: 27846 - protein, 466 aa, Salmonella enterica subsp. enterica serovar Typhi str. CT18
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALSKVIAILAFIALGAAAISGFYPYAEVSGISRLWDHGGFMPNGFGAVLSAMLITMFSFMGAEIVTIAAAESDTPDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 27847 - protein, 408 aa, Zea mays
  misc_feature (19)..(19): Xaa can be any naturally occurring amino acid
  misc_feature (55)..(55): Xaa can be any naturally occurring amino acid
  misc_feature (84)..(84): Xaa can be any naturally occurring amino acid
  misc_feature (150)..(150): Xaa can be any naturally occurring amino acid
  misc_feature (191)..(191): Xaa can be any naturally occurring amino acid
  misc_feature (228)..(228): Xaa can be any naturally occurring amino acid
  misc_feature (243)..(243): Xaa can be any naturally occurring amino acid
  misc_feature (349)..(349): Xaa can be any naturally occurring amino acid
MASVTDSFVADLDELLEYXDREDYPGDENAETENLEDDANDSVPDLKSLDLDSVXKHQKAQWYKDIMKMHLKGDSNQGAILQDXRYQLVVDCNASSVDIDNEITIIHNFIRDKFKLKDPLLESCVHYPIDYARVVWKIGNDMDLTLDLKXYLPSADMITMAETTTGGEPLSEDNLVNTIEASDRALNLDAXKKMILEFLKGRMGYVARNLAAIVGSAVASKPSRAAVXGGLGALAKMPACNVXLLLLGAKKTNLSGFSTASVQSRIGYLEQTEVLFESTPPSLRFQSSRLIAAKSTLATRIDYDPTRTVVQNLLEEISKKIENWQQLPPARLPKPIPIPDFMPKKKRGXLYAQTNTMKLVNRMKFSMPEESTLGDGLGKGYGLLGQAGSGKLRVSAGQSKLSTKIAKM

SEQ ID NO: 27848 - protein, 412 aa, Galdieria sulphuraria
MEALVNIWGLLLTARVILGVSFGIFSSTVPIYLSECAPARVRGMLTGTYQLSVTLGLFLGSVSDAIFVNVSNGWRFMLGTVIIPPCLCLIGLLFTPESPRWLIYKRKYPQALDSLRKVKTTEAEALADLNSIKESITRTWRERSGHGAIYKIITTPYIRHALVIGMFLQLSRQLSGVNAMLYYFDVVLRSAGMSISHAVYVNVAYGAATFLFTLPMFWIVDRFGRRVLLVYTMPIIACMCLLVGLSFLGSRRVRMALSIVGFLLFRLFYSPGLGPISWVITAEIFPLEVRSECLSICTFFSYAFNFVVSFSFPDMMDQMKTEGAFAFFAGCTLIDWIIFFLFVPETKGLDMEVVDQLFRQSWTSQAKQNLKQLKDLFPCIASNNIETCENRNTNSTDITDPSCAEKESQEMK

SEQ ID NO: 27849 - protein, 117 aa, Methanococcoides burtonii DSM 6242
MVKFEVPDELADKALEAIELARDTGKIKKGTNEATKAIERGITKLAVIAADIEPSEIVAHIPALCEEKNTPYIFVKQQKELGAACGIGVGCAAVVITDAGKGSELVEDVAQKVAALK

SEQ ID NO: 27850 - protein, 430 aa, Oryza sativa Japonica Group
MAMSRAAAAAAGTPVARRRLMGAVAARSMASWFGHVEPAAKDPILGVTEAFLADPSPDKVNVGVGAYRDDSGKPVVLECVREAERRIAGSMNMEYLPMGGSIKMIEESLKLAYGENCEFIKDKRIAAVQALSGTGACRLFADFQKRFLPDSQIYIPTPTWANHHNIWRDAQVPQKTFTYYHPESRGLDFAGLMDDIKNAPDGSFFLLHACAHNPTGVDPSEEQWREISHQFKVKKHFPFFDMAYQGFASGDPERDAKAIRIFLEDGHQIGCAQSYAKNMGLYGQRAGCLSILCDDEMQAVAVKSQLQQIARPLYSNPPVHGALIVSTILGDPELKSLWLKEVKGMADRIIGMRTALKENLEKLGSPMSWEHITNQIGMFCYSGMTPEQVDRLTKEFHIYMTRNGRISMAGVTTGNVAYLANAIHEVTKTK

SEQ ID NO: 27851 - protein, 252 aa, Thermotoga sp. RQ2
MFDLRGRVALVTGGSRGLGFGIAQGLAEAGCSVVVASRNLEEASEAAQKLTEKYGVETMAFRCDVSNYEEVKKLLEAVKEKFGKLDTVVNAAGINRRHPAEEFPLDEFRQVIEVNLFGTYYVCREAFSLLRESDNPSIINIGSLTVEEVTMPNISAYAASKGGVASLTKALAKEWGRYGIRVNVIAPGWYRTKMTEAVFSDPEKLDYMLKRIPLGRTGVPEDLKGVAVFLASEEAKYVTGQIIFVDGGWTAN

SEQ ID NO: 27852 - protein, 509 aa, Arabidopsis thaliana
MAFFSMISILLGFVISSFIFIFFFKKLLSFSRKNMSEVSTLPSVPVVPGFPVIGNLLQLKEKKPHKTFTRWSEIYGPIYSIKMGSSSLIVLNSTETGKEAMVTRFSSISTRKLSNALTVLTCDKSMVATSDYDDFHKLVKRCLLNGLLGANAQKRKRHYRDALIENVSSKLHAHARDHPQEPVNFRAIFEHELFGVALKQAFGKDVESIYVKELGVTLSKDEIFKVLVHDMMEGAIDVDWRDFFPYLKWIPNKSFEARIQQKHKRRLAVMNALIQDRLKQNGSESDDDCYLNFLMSEAKTLTKEQIAILVWETIIETADTTLVTTEWAIYELAKHPSVQDRLCKEIQNVCGGEKFKEEQLSQVPYLNGVFHETLRKYSPAPLVPIRYAHEDTQIGGYHVPAGSEIAINIYGCNMDKKRWERPEDWWPERFLDDGKYETSDLHKTMAFGAGKRVCAGALQASLMAGIAIGRLVQEFEWKLRDGEEENVDTYGLTSQKLYPLMAIINPRRS

SEQ ID NO: 27853 - protein, 259 aa, Carboxydothermus hydrogenoformans Z-2901
MKPAVGIIGVGQMGGAIARGLLKQQPSPIKKLYLSDKNQECLKPFLEQAEPVTNELLVKKADVVIVAVKPYLVESVIKEISPGLSGKILVSVAAGVSLKKIAEWGVPGECEVVRVMPNTPALIGQGFIAITPSKANALLAEIFDSLGEVVFLEEKYFDQITALAGSGPAYIYLVAEALIDGAVRLGLPRDVARSAVVQTLIGAGAMLKETQEHPGILRDAVVTPGGTTAAGLYQLEKQGIRGMFADCLESAYERAKNLT

SEQ ID NO: 27854 - protein, 254 aa, Staphylococcus aureus subsp. aureus Mu50
MKFIVIKIGGSTLSDMHPSIINNIKHLRSNNIYPIIVHGGGPFINEALSNQQIEPHFVNGLRVTDKATMTITKHTLIADVNTALVAQFNQHQCSAIGLCGLDAQLFEITSFDQQYGYVGVPTALNKDALQYLCTKFVPIINSIGFNNHDGEFYNINADTLAYFIASSLKAPIYVLSNIAGVLINDVVIPQLPLVDIHQYIEHGDIYGGMIPKVLDAKNAIENGCPKVIIASGNKPNIIESIYNNDFVGTTILNS

SEQ ID NO: 27855 - protein, 329 aa, Nocardioides sp. JS614
MPVPFILDTDTAQDDCVAIIAGILDPEADLRALTMVAGNVSFDQQVRNAQLTLNALGRLGEVPIHLGCRQPMVLPWVSAENVHSDGSGGLDMDFAGTTTEDEHAVDALIRMTAEAPGEISVVAIGPLTNIAMAAVKDPAFVRNVRHLVIMGGSNNGRGNITPAAEFNLYVDPHAAKVVFEAGFDITVVPWAPLTLNDAVFSREQLAGIESLGTTLSQFFLQVCGPTLAFDESVGIPGTTHPDSLSVAVLLHPDLVLDAAEYHVAVEADSELTRGYSSMSWGVHGLAPNARVIEHIDAVAFHRYLTGLLATPTEPTVPLRFGAPFTARQG

SEQ ID NO: 27856 - protein, 706 aa, Oryza sativa
MAKSNASRASATRRKFYFLQKSLLVSSLLAVVAADVVGAGPNQQCFPSSCGDLGNISYPFRLASDSRPCVGTLRPWYNLSCSSGRATIQINTRTYYVTSINYTGEIFSVVDATLQDDDTNGTSCPLPRSDHLPYIDYWPPYLGESSTDSYGFVYLATASDTWACFVNCSRARTDTMPWYRPVTCLLPNNSFVFVSFDDCAVGELQPSCRYLAMIPVDRWNLPDNSSQLQNASYTDIIGFIRKGFSVRFPYRPDQYQSPRMSARECLKDSNRYFKERISHPSILNLTRAIFWSETNSEVDCGYEVAPQKDRIFLGTIVSAIDIIKFHFVLFRLVLGSLVVFIFLAHKYWKTGITIDAVEKFLRMQQMIGPTRFAYTDIIAITSHFRDKLGQGGYGSVYKGVLLPGNVHIAVKMLTGSSSCNGDEFISEVSTIGRIHHVNVVRLVGFCSEEMRRALVYEYMPRGSLDKYIFSSEKSFSWDKLNEIALGIARGINYLHQGCEMQILHFDIKPHNILLDDNFVPKVADFGLAKLYPRDKSFVPVSAARGTVGYIAPEMISRSFGVISSKSDVYSFGMLLLEMAGGRRNADPNAANSSQAYYPSRVYRELTRRETSEISDIADMHELEKKLCIVGFWCIQMRSCDRPTMSEVIEMLEGGSDELQVPPRPFFCDDERFPGVESYNMPSDLTAISEEHEDDDDESICLFESYQ

SEQ ID NO: 27857 - protein, 394 aa, Staphylococcus aureus subsp. aureus Mu50
MNSIIELTDYYSSNNYAPLKLVISKGKGVKVWDTDGKQYIDCISGFSVANQGHCHPTIVKAMTEQASKLSIISRVLYSDNLGKWEEKICHLAKKDKVLSLNSGTEAVEAAIKIARKWGSEVKGITDGQVEIIAMNNNFHGRTLGSLSLSNHDAYKAGFHPLLQGTTTVDFGDIEQLTQAISPNTAAIILEPIQGEGGVNIPPKGYIQAVRQLCDKHQILMIADEIQVGLGRTGKWFAMEWEQVVPDIYILGKALGGGLYPVSAVLANNDVMRVLTPGTHGSTFGGNPLAIAISTAALDVLKDEQLVERSERLGSFLLKALLQLKHPSIKEIRGRGLFIGIELNTDAAPFVDQLIQRGILCKDTHRTIIRLSPPLVIDKEEIHQIVAAFQDVFKN

SEQ ID NO: 27858 - protein, 275 aa, Bacillus halodurans C-125
MKIGFIGTGSMGTILIESFLESSALTAEQIVITNRTQEKADALARRYPGLSVVDRPEEVVQQTDCFFVCVKPMQFHRVLMDIRPHCSANKLLVSITSPISIAQLENSVDCKVARAIPSILNRACAGSTLVSFSERCLEEDRSFLCGLLGTISEPLLIEEKITRVSSDIVSCGPAFFSYLTQRFIEAAVRQTAISEEDATALATEMLIGIGKLLDQELYTLPSLQKRVCVPGGITGEGIRVLEEDVGHMFDRLFQKTHQKYYHEQEKISSQLTLKG

SEQ ID NO: 27859 - protein, 304 aa, Nocardioides sp. JS614
MRIAVVGSYGVGMTMRMPRLPVAGETLLGGEYRSGHGGKGSNQAVAASRLGAEVTLLTAVGGDAIGRAARDMWAAEGVDATATITAPAATMVGMILVEPSGENRIVIATGALDHLTPRHVQDFAPQLAAADIAVVSLEIPMATAVAALRAAHEAGTRTLLNPAPAQPIPDEAWSNVDLLTPNRTEAAILLGLPPDAAGPAEELARQLHERGGATIVLTLGAEGALICDAGGLTPVAAVPPAEVVDTTGAGDAFTAALAVELAGGGSVPGAVAFAARVGAFAVAHHEVFPGLPRRTDLDTEPDLT

SEQ ID NO: 27860 - protein, 546 aa, Staphylococcus aureus subsp. aureus Mu50
MKQRIGAYLIDAFHRAGVDKIFGVPGDFNLAFLDDIISNPNVDWVGNTNELNASYAADGYARLNGLAALVTTFGVGELSAVNGIAGSYAERIPVIAITGAPTRAVEQAGKYVHHSLGEGTFDDYRKMFAHITVAQGYITPENATTEIPRLINTAIAERRPVHLHLPIDVAISEIEIPTPFEVTATKDTDASTYIELLATKLHQAKQPIIITGHEINSFHLHQELEDFVNQTQIPVAQLSLGKGAFNEENPYYMGIYDGKIAEDKIRDYVDNSDLILNIGAKLTDSATAGFSYQFNIDDVVMLNHHNIKIDDVTNDEISLPSLLKQLSNISYTNSATFPAYHRPTSPDYTVGTEPLTQQTYFKMMQNFLKPNDVIIADQGTSFFGAYDLALYKNNTFIGQPLWGSIGYTLPATLGSQLADKDRRNLLLIGDGSLQLTVQAISTMIRQHIKPVLFVINNDGYTVERLIHGMYEPYNEIHMWDYKALPAVFGGKNVEIHDVESSKDLQDTFNAINGHPDVMHFVEVKMSVEDAPKKLIDIAKAFSQQNK

SEQ ID NO: 27861 - protein, 357 aa, Wigglesworthia glossinidia endosymbiont of Glossina brevipalpis
MGLKIGIIGLPNVGKSTLFNALTNSQVKAKNFPFCTIKPNIAIAPVPDVRLFKLKNIVKSKKIVPNFIEFIDIAGLVKGASKGEGLGNSFLNQIRNVNVVCHVIECFSEKLISKSEYVKNILKDIKIINDELRISDINLCKKKIESLKNKNNEKKDLFEIEQYLDILLNKNICTLQIYKNSKKINSNIDLLVFKPKMYIVNIKEKNKNNDFYLKNIKYFTNKYDIPTIEICAKSESDYISSIKHNSSNFDINSNLLNTSLGKIINCGFNLLKLKTFFSVGPKEVKAWSSDLNSTAIQAAGKIHTDFQKGFIRAKVISFSDFIFYKNFLTAKKYGKIKIEGKNYIIKDGDIIEFLFNV

SEQ ID NO: 27862 - protein, 199 aa, Zea mays
NNQHMDCSSPASDAVARSARSGDDRKSEGEEKLGLGLLDSSGGEKAKKKRSKKKPPRPPRPLTPTPLDVSDQKLLNELSELAALKRARVERMKALKKMKNAKQGFSGGNLCPLIVTVIFCVVILWQGFFSGHGPAVSFHGSPESSIRVARSSLISIRFYKNHSNTRPPPFSETTAAPQNVVETGPRLRNRNQARRLLAR

SEQ ID NO: 27863 - protein, 258 aa, Plantago major
VIFHTFCEDIASQLPAVVVSVEYRLAPENRLPIAYDDALNAILWAKDQALGKGGRDPWMEYADFTKVFILGSSAGANIAYHVALRALDFDISPLQIKGVMMNQGYFGGVARTASEIRLKDDAYVPLYVNDVLWTLALPTNLNRDHEFCNPISGGTYLGRIYRLPKIYIKGDYGDPLVDRSVQLAQYLINNGRTVFYRFNAGGFHGIELQNTTAAQELYDDFKYFVNNPFIMNENGISKEPLSYDMKEIMSGGVSRASA

SEQ ID NO: 27864 - protein, 443 aa, Wigglesworthia glossinidia endosymbiont of Glossina brevipalpis [sequence omitted]

SEQ ID NO: 27865 - protein, 165 aa, Oryza sativa Indica Group
ASQLHFYDCTYFSFDKCCLPKSAVIPLHNHPGMTLFCNILIGNVHLISYDWAKSAPYNDSNALENSDGARLANANTDDVFDASMDTTFQYPENGGNLHCFTAMTSCAVLDVTGPPYNHADGPHCSYYDESPFLNSSEAHALYSWLKDIHSTFHIKVIMMPQRFIV

SEQ ID NO: 27866 - protein, 357 aa, Pseudomonas sp. Y2
MSKFHSLTIKEVRPETRDAVSIAFDVPAELADSFRFTQGQHLVMRTQLDGEEVRRSYSICTGVNDGELRVAIKRVAGGRFSAYANESLKAGQRLEVMPPSGHFHVELDAARHGNYLAVAAGSGITPILSIIKTTLETEPHSRVTLLYGNRSSASTLFREQLEDLKNRYLQRLNLIFLFSREQQDVDLYNGRIDADKCGQLFSRWIDVKALDAAFICGPQAMTETVRDQLKANGMAAERIHFELFAAAGSAQKREARESAAQDSSVSQITVISDGRELSFELPRNSQSILDAGNAQGAELPYSCKAGVCSTCKCKVVEGEVEMDSNFALEDYEVAAGYVLSCQTFPISDKVVLDFDQI

SEQ ID NO: 27867 - protein, 238 aa, Bacillus subtilis
DLQLGRGETVADTAKVLSGYVDAIMIRTFEHEKVEELAKEADIPVINGLTDKYHPCQALADLLTIKEIKGKLKGVKVAYIGDGNNVAHSLMIGCAKMGCDISIASPKGYEVLDEAAEAAKTYALQSGSSVTLTDDPIEAVKDADVIYSDVFTSMGQEAEEQERLAVFAPYQVNAALVSHAKPDYTFLHCLPAHREEEVTAEIIDGPNSAVFQQAENRLHVQKALLKAILYKGESSKNC

SEQ ID NO: 27868 - protein, 274 aa, Oryza sativa Japonica Group
MASPSSSSSLCSTFASPRAASLGRRLAFSSPRKAFRVRASSRVDKFSKNDIIVSPSILSANFSKLGEQVKAVEVAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQKPVAVPA

SEQ ID NO: 27869 - protein, 349 aa, Oryza sativa Japonica Group
MAGCGGGWVARLAALLVVGFVLGSVDASLGDVDPQYRTCVEECHTTGIIGENIISHCQSPGNDDASVGSSWYTQEPLYMQWKQLNCMNDCRYYCMMQREGERQSRGLNPVKYHGKWPFIRVSVFQEPLSAALSAVNLLMHFTGWLSFFLLVNYKLPVRPQTKRTYYEYTGLWHIYAILSMNAWFWSSIFHTRDIDLTEKLDYSSAVALLGYSLILSLLRTFNVKDEATRVMFAAPILAFVTTHILYLNFYELDYGWNMKVCVVMAVVQLLAWAIWAGITQHPSRFKLWVVVFGGALAMLLEVYDFPPYKGYADAHSLWHASTIPLTYLWWSFIKDDAEFRTSTLIKKAK

SEQ ID NO: 27870 - protein, 410 aa, Wigglesworthia glossinidia endosymbiont of Glossina brevipalpis
MNYPIKEIRSDFPILSEKINNSPLIYLDNAASSQKPKCVLQREIIYSSKEHSAVHRGIHTLSKNATKNMEDIRSKIAKFINAKSDSEIIFVKGTTEGINLVANTWGETFIKKGDNIVITQMEHHANIVPWQLLSMRKKVDIKYIPLLPSGKLDICKIDDIINNNTRIFCITHVSNILGTCNLIEKIIKKIKNNYDIKVLIDGAQAIMHMKIDVQKIDCDFYVFSGHKIYGPSGIGVLYGKKKLLKKMPPWEGGGGMIKKVCLFSGTTFNEIPWRFEAGSPNISGIIGLGKSIEYVKKIGIKKIQKYEKKLIKYALLKIKNIPNIKIYSSEINTSIIPFNLKGCHSYDVGILLDKYGVAIRTGHHCSMPIMNFFKVHSMCRISVAMYSDESDIDNFIKSLLKVQKFLRRFN

SEQ ID NO: 27871 - protein, 149 aa, Methanococcoides burtonii DSM 6242
MERTYVMVKPDGVQRCLVGEIVSRIEKKGLKIAALRMNVMTEAAAKEHYKEHSERPFFGSLVSFVTSGPSVSMVIEGNNAIKIMRAINGATNPVDALPGTIRGDLAVDMGRNVVHASDAPESAEREIGLHFEESEISGYPRADDEWLYE

SEQ ID NO: 27872 - protein, 469 aa, Thermotoga sp. RQ2
MKSHIGLIGLAVMGQNLALNIARKGYKVSVYNRTAQRTEEFVKNRVTNEEIEPHYDIESFVKSLERPRKIILMVKAGKPVDDTISQLLPHLEPGDLIIDGGNSHYMDTERRFKELSEKGILFLGMGVSGGEYGALYGPSLMPGGSREAYNLVEEILLKIAAKTEEGPCCTYVGERSAGHFVKMVHNGIEYAIMQAIAEVYHIMRDVLSLSSEEMSSIFEEWNRGELSSFLVEITYKILRKKDEETGKPMVDVILDKAEQKGTGKWTSQAALDLGIPTPSINLAVVERVISHFKDIRTRLSKLYNKRRSATQGSEEFLRDLRNSLFFAMFMAFSQGMWLIAEASKEFGYGVNLSEVLRIWKGGCIIRAKLIDTLRRYISNENAYLLENEEVMNLLKGKIDSLKNILKASIENEIPVPVLNSSYNYFMSLTEERLPANLIQAQRDFFGAHTFERVDREGVFHINWEEGEIG

SEQ ID NO: 27873 - protein, 503 aa, Ostreococcus tauri
MEQTLEVQAEGEGVEDEMREIAVDARAPRVRRDRAKTASRELKRRFQSRDARCVILAGGADETNPLTRRRARSAVHLAGTYRVIDFPMTNLINSGMRQLYVLTQFNSHSLVTHVNKAFPSELFGGEVNGFVEVLPTSQTREHGETWSLGSADCVARHLSSGSLTKYTYEMRMEDECLRQLGSLDECLMSELDGTTIILSAEALYSMNFAELLEQHFLKGADVTIATCNQISSDQANAFGILDVDEMTAQVNCFIEKPTKAQLEEFMQCTTEELESCKLDANMGVYVFNNSALLELLTASKSGVAPGDRHEFGKDVIPYAIDMGYDVKAFRHSDYWKPLRSLRDLYEANISIAVGGDAASLLTHGRQVYTKPNFLPPTTFHGSVYTEKTIFSDGCLVQDGSRIVNSVIGACTSIDKNVDLEGVVVVGRDEIMKRSGGVNSVPDIGANTIIRKCIIDSDATIGANVRIVNAAGIEELDRTDEGYVITEGIVTILGGAIIPDGFVI

SEQ ID NO: 27874 - protein, 705 aa, Bordetella pertussis Tohama I
MTNPDFEHIKPVVSVARHRNVAVLSVDNPPINALSDTVRAGLCSALREAEADPAVRAVVLACEGNTFVAGADIREFARAKGAAEAIDVPAVIESCRKPVVAALHGQALGGGLELALACHGRVALAGCRLGLPEITLGLIPGGGGTQRLPRLIGLEAAAELILSGATIDAETARESGLLDAVWPDRLRERAIEFAASLADSPAGVRRASTLAHPPMSPQTGQDLRKIAESRPAALRAPQAGAAAVEALSAAAQPDFARGRALERELFARLRDGEESRALRALFFAERSARRVGLDDATSAPPMAHDAAVVGAGTMGRGIAIALADAGLRVRFIDVEQASLDRALEAIRAHYRSLAARGRMTEAAARDAVARISPASDMQAAAEADVVVEAAFEDLAIKQAIFRQLDSIVRPGAVLATNTSTLDVDAIAAATRRPQDVVGTHFFSPANVMRLLEVVRGARTAPRTLGAVLALGRRMGKVCVTVGVCDGFVANRMSAHRARQIELLLQHGALPQDIDQAAREFGFSMGPCAATDLAGLDISWRIRRGKGARSPIADALCELGRFGQKVGRGYFSYAPGSRVAVPDPEVEALIRRMAEQLGIRRQSFDLATITDRLILPVINEGARVLQDGVARQARDIDLIWVHGFGWPARRGGPMFHAERVGLASVCDRLARLADALEDASLQPAPLLRDLATRGAGFASLHAARQA

SEQ ID NO: 27875 - protein, 141 aa, Legionella pneumophila str. Lens
MAKELTLSIIKPDAVAKSVIGEIYTRFEKAGLDIVAAKMTQLSREQAESFYDIHRARPFFKDLVDFMISGPVMIQVLKGENAVAKNREIMGATNPKEAAPGTIRADFADSIDANAVHGSDSLENAAREIAFFFEPHELCNR

SEQ ID NO: 27876 - protein, 425 aa, Saccharophagus degradans 2-40
MTLIALGINHNTASLDVREKVAFSSTQIESALRAAIAGAGLSEVAILSTCNRTELYAYGSSQANSLIQWLAEYKQVNVAELEQSHYLYTASEAASHMMKVASGLDSLVLGEPQILGQMKSAYAVAREAGVLGGHLHDVFQRVFSVAKRVRSETAIGENPVSVAYAAVSLAQQIFSDLKQDTALLIGAGETIELVARHLAEQGIKKLIVANRTLGNARSLAEQFGAEAILLADIPEHLHRADIVISSTASQLPLLGKGAVEQALKRRRHKPMFMVDIAVPRDIEAQVGDLADVYLYTVDDLKEVIDENMRSRQQAAKIAEEIIVEGLLHYEREQRALTSVDTIKALRQTMDALREQELEKSRKALEAGADPAQVLEQLARSLTNKFLHTPSTQLKQAGADGEQDMLRTVRTLFSLPSANESKSEKE

SEQ ID NO: 27877 - protein, 433 aa, Borrelia burgdorferi B31 [sequence omitted]

SEQ ID NO: 27878 - protein, 313 aa, Saccharophagus degradans 2-40
MADLMVFSGNANPELAKRVVAQLGIPLGEITVDQFSDGEISVELLENVRGRDVFVMQPTCAPTNDNLMELLVIVDALHRASAGRITAVVPYFGYARQDRRVRSARVPITAKVVADMMATVGVDRVLTVDLHAEQIQGFFDVPVDNVYGSPVLLADIEEQGFEDLVVVSPDIGGVVRARAVAKQLDIDLAIIDKRRPKANVAEVMHLIGEVENRTCLLVDDMVDTAGTLCNAAKALKERGAKKVIAYATHPVLSGPAIERLNASEMDELVITDSIPLSDAAKASPKIRQLTLSHMLAEAMRRISNEESLSAMFR

SEQ ID NO: 27879 - protein, 481 aa, Oryza sativa Japonica Group
MSDVRSRRSVASSTRRQQDAELAAAEERRRATAQTATAAARAARLAAAELAAVRAEVEAEAAEDAARAAEVEVETLRSSINGSIAGDITADRELEELARGGARERAERWAAAHLHGGGGDPRDRALADGNPDGRGRAGGSPEPARGPRRQRGSPSPDRRHGHHGVQTVVRDFGPGGGWPTLTKTNYIEWAAVMRVRLQVWHMWEAVRYGDVDYNEDGKEPRLPRTEQAHPGEFHLFRTASTPLAYFSVARTAAFGCPLGQHPIQISNFRLGGCSNRLAASYGYIYMYPTSLGYEYYFALLRDFPDVQFTLNGGITTIDQVTASIRQGAHRVMVGRAAYNNPWNMLGHVDSEVYGMPTRRSSRRQILESYQVYGDSIMGQYGPSRPNVRQLVKPLLNLFHSEPGNGLWKRKADSTLRHCKTLESFLEETLDAIPNSVLDAPIGKEAYIEEGHFADMDSLLPPRYSSLTNGSCEIPALVTAST

SEQ ID NO: 27880 - protein, 363 aa, Saccharophagus degradans 2-40
MGFKCGIVGLPNVGKSTLFNALTSAGIDAENFPFCTIEPNSGIVPVPDPRMDKISALVKPQRELPATMEFVDIAGLVAGASKGEGLGNQFLANIRETEAIAHVVRCFDDPNVIHVEGKVDPAADIDTINTELALADLDAVEKAIFRYTKLAKGKDAHAVAIKALLETLLPHLNEAKPLRAFPLTDDQLKLLKELSLLTLKPTMYIANVEEDGFENNPLLDKVREIAAAENAVVVPICNKLEAEIAELDDEEKAEFLGEMGMTEPGLNRVIRAGYELLGLQTYFTAGVKEVRAWTIPVGATAPQAAGKIHTDFEKGFIRAEIIGYDDYIACKGEAGAKEAGKWRLEGKEYIVKDGDVIHFRFNV

SEQ ID NO: 27881 - protein, 287 aa, Haemophilus influenzae R2846
MVHQVANFVTWHETAKKCGAKIRVLPILDNWLIDENALISALSEKTKLVALNFVSNVTGTEQPIKRLIQLIRIHSHALVLVDAAQAISHIKIDLQDLDADFLAFSAHKIYGPNGLGVLTGKLTALSQLQPLFFGGKMVDRVSNNRITFAELPYRLEAGTPNIAGVIGFNAILNWLQKWDFTAAEQHAISLAESVKVRLKSYENCRLFDSPQPSTVVCFIFDGIDCSDLSTLLNEQNIALRVGEHCAQPYLARLGERTTLRLSFAPYNTQEDVEAFFTALDKALDLLQ

SEQ ID NO: 27882 - protein, 546 aa, Triticum aestivum
MGLDLGALALKYTGLAVSDHDSIVAINIFIALLCGCIVFGHLLEGNRWVNESTTALVLGLITGGVILICTKGVNSRILIFSEDIFFIYLLPPIIFNAGFQVKKKQFFRNFATIILFGAAGTLISFVIITFGAMGLFSKLDVGPLELGDYLAIGAIFSATDSVCTLQVLNQDEAPLLYSLVFGEGVVNDATSVVLFNAIQNIDINHFDVFVLLQFIGKFLYLFFTSTVLGVAAGLLSAYIIKKLCFARHSTDREVAIMILMAYLSYMLSMLLDLSGILTVFFCGIVMSHYTWHNVTESSRVTTKHTFATLSFIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLIPPRPGTAADISSQSFLDPLTASLLGSDFDVGQLTPQTNLQYLLTMPTRSVHRVWRKFDDKFMRPMFGGRGFVPFVPGSPIERSVHGPGLLGTVTEAEDRS

SEQ ID NO: 27883 - protein, 315 aa, Sulfitobacter sp. EE-36
MKDTTFGPKGWTPDRLGSLKGKTYLITGTTAGAGFQATRILLSKGAKVVMLNRNADKSIAAVKTLKDTFGPNAEVSFVRMDLSDLASVRAAAEEVQSTVPRIDALICNAAIAQVPTQQLTVDGFESQLGTNHYGHFLLCGMLFDRIQESAGRIVVVSSLGYNMGIKTIQFDDMNWDKNYSANAVYSQSKLAQMMFAYELQDRLKATDSRVEVYVCHPGASATSLISTSGGLFTRVTWWMMSKTPMVQSAEKGAYPEVMCATEDGLAQRALYGPTGWLQTGGPVGKGTLNPHAYDKPVMEKLWTVSEKATGFHWEI

SEQ ID NO: 27884 - protein, 183 aa, Aspergillus nidulans FGSC A4
MGLAISKLFDRLWGKKEMRILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDALLLVFANKQDLPNAMSPAEITQQLGLQSLTRRPWYIQSTCATTGDGLYEGLEWLAETLRKTGRD

SEQ ID NO: 27885 - protein, 258 aa, Zea mays
MTSSRSKSKSRSRSRSRSRSRSRSPRRRDRLRSERAPHRSRSRSRSPYRRRERRGHRDFACKNCRRPGHFAKECPSAPMCNNCNLPGHFAAECTLQTVCWNCKESGHIASECKNEALCHACNKTGHLARDCPTSGANVKLCNKCFKSGHIAVDCTNERACNNCRQPGHIARECKNDPVCNLCNVSGHVARVCPKTTLASVIHIQGGPFRDILCRICGQPGHISRNCMATVICDTCGGRGHMSYECPSARIFDRGFRRF

SEQ ID NO: 27886 - protein, 197 aa, Wigglesworthia glossinidia endosymbiont of Glossina brevipalpis
MQIKRITEANLPTPWTNFLMIGFEEIKTKCNHIALLHGNMSKNTSILTRIHSECLTGDALFSLRCDCGFQLQSALSHIANEKCGILIYHRQEGRNIGLINKIKAYSLQDKGIDTVDANYHLGFEADERDFTVCVEILNLLQIKSIRLLTNNPNKVNVLTSAGILITERVPLIVGSNPSNTKYLYTKAKKMGHLLNNK

SEQ ID NO: 27887 - protein, 195 aa, Plantago major
VTTIFYLLCGCMGYAAFGDQAPGNLLTGFGFFDPYWLLDIANIAIVVHLVGAYQVYCQPLFAFIEKWSVRKWSRSDFVTAEYDIPIPLCGVYQLNLFRLVWRTIYVVFTTLIAMLLPFFNDVVGILGALGFWPLTVYFPVEMYIAQNKVRKWTSQWIGLQLLSIACLLVSVAAAVGSIAGVILDLRTFKPFKTVY

SEQ ID NO: 27888 - protein, 541 aa, Vitis vinifera
MGQSASTSAISSGSSRRGSNHPHRSRSKSMVQIPSMQVEENVQFRQIDEDLDYISDLPDECLACIFQSLGSGDRKQCSLVCRRWLRIEGQTRHRLSLNAHSDLLTVVPSLFSRFDAVTKLALKCDRRSVSIGDDALILISLGCRNLTRLKLRACRELTDAGMGVFAKNCKGLKKLSCGSCTFGAKGMSAVLDNCSALEELSVKRLRGISDGSAVDQIGPGVAASSLKTICLKEQYNGQCFWPLIIGAKNLRTLKLFRCSGDCDNLLQLVANRTTSMVEIHLERLQVSDLGLVAISHFLDLEILHLVKTSECTNAGLVSVAERCKLLRKLHIDGWKANRIGDEGLSAVAKCCPNLQELVLIGVNPTKLSLEMLAANCQNLERLALCASDTVGDAEISCIAAKCLALKKLCIKSCPVSDQGMRALACGCPNLVKVKVKKCRAVTYEGADGLRASRESLAVNLDTGETEHQDASASDGGAQENAVELPPLASQNGAANIASSSSGRSNSLKARLGLLTGRNLVASTLRRWTSSNSSSRGNQRSN

SEQ ID NO: 27889 - protein, 247 aa, Glycine max
MDHKSAKDEDAEVDLESGLVLTDYESKDVSTQGNTKQGKIILTKISCGFAGDCIKGEDRYSGCCKESKLTVVSMDMVKVTNKLYSVEYAENNTPEKEKRKMSSNKKAPKPPRPPRAPSWDVADQKLIREITELAMLKRARIERMKALKKMKAAKASSSSSSSTFAMVFTVVFCIVVLLQGMSSGKSSVTIFQGSPEPAGVMEGGLIDVQHQLNPSSSDSNAPGLEPHKIVQQVTGLDLPAQLRRGAG

SEQ ID NO: 27890 - protein, 458 aa, Wigglesworthia glossinidia endosymbiont of Glossina brevipalpis
MFLIKIRNIKMKVTVFGIGYVGLVQAAVLAEIGHSVLCVESNQDKLSDLKKGIVPIYEPGLKTLIKKNLKLNRLKFTNNHKDGVNHGVMQFITVGTPIEKNKIINTIEVYKVAEIIANNMRDYKIILEKSTVPVGTTEKIFSFVKKILKNKKRKLKFDVVYNPEFLKEGTAVYDCMFPNKIIIGTNNINLKSVLKRLYDPFDKKQNCIIFMDIRSAELTKYASNCMLATKISFMNEMSNLAEIFGADIENVRKSIGKDPRIGDNYIYPGCGYGGSCFPKDIRGLIYASKMLGYQPKLLEAVEEINNKQKNKIFELIKYHFGKNLNKKTFALWGLSFKPNTNDVREASSIILIESLWKYGAKIQAFDPKAMEEIHKIYGNRKDFVLMKSKESVLNHADALIICTEWKNFYFPNFKKIKSKLKQPVIFDGRNLYDPKYLKNKGFIYYGIGRGDSLSMINN

SEQ ID NO: 27891 - protein, 279 aa, Wigglesworthia glossinidia endosymbiont of Glossina brevipalpis
MKIKKVVIPIAGLGKRMLPITKVIPKELLPLIDKPLIQYAIHECINSGLKNIIFVTNYKKYLIKNYIENIFLKKKCNFQKKLNIDYIYQKSVNGLGNAILSALPKIGYKSFAVILPDVIINSYSCNNLKINNLLSMLNRFEKTGRSQVLVKLSYNTKDYGIVNCKKSKLNPNDISKIINIIEKPYIKNSIPSLSVVGRYVFSKNIWGMLEKIKPGIENEFQLTDAIKMLIKNEIVEAYCIKGSSYDCGNKLGYMKAFVKYGLYNKYFGKVFKKWLKKIL

SEQ ID NO: 27892 - protein, 441 aa, Clostridium difficile 630
MPMSEITSQMISTEEKKYVAKTQKIPYYPVAFKSGDGAMLYDYEGNEYVDFLASAGSANVGHGNKEISQAVKEQMDDITQYTLAYFHSDPPVKLAEKLVEIAPGDNDKKVLYSATGSACIDAAIKLARGYTGRTKIISMCESYHGSTYGAISISALSTNMRRKMGPLLPEVYHFHYPDKNRTAKECLDEIEYAFAHYLPAEEVAAIFIEPIAGDAGIIVPPVEWVQGLSKICKENGILLVSDEIQQGMGRTGKWFGIENFGVEADLIVLGKSVGGGLPLGAVVGRTEIMQSLDAPAHLFTLAGNTTVCVAALKSIEIIEKENLLQKSIEMGDYIKAGFEKLKEKYDIIGEIRGIGLSIGVDIVKGKGSNEKHPDATAKICYRCIQTGLIMIFLGQSTLRVQPPLVITKEQVDKAMNIIDSAIDDYLNGRIGDEVYEVTQGW

SEQ ID NO: 27893 - protein, 424 aa, Bordetella pertussis Tohama I
MSVAVLAFGLNHTSAPVSVRERVSMPVDLVKPALEGLRATFGGAVREAAILSTCNRTELYCAAEGQVAEHLPAWLAEHNRLEAAALRPHLYRHQHDDAVRHAFRVASGLDSMVLGEPQILGQMKDAVRAANEAGALGTLLHQLFQRTFSVAKEVRSQTAIGAHSVSMAATAVRLAERVFGQLEDARTLFIGAGEMIELCATHFAAQRPRSMVVANRTIERAETLAGRFSAQTMKLADLTERLAEFDVIVSCTASSLPILGLGMVERATRQRRHRPMVMIDLAVPRDIEPEVGRLDDVYLYSVDDLGRLVQSGTDARRAAVVQAEAIIETRVQGFMHWMQSREVVPVIRDLHQAADDVRAAELERARRMLARGESPEAVLEQLAHGLTQKYLHGPLAALNRSEGDERRQLLAWVPRLFPGRDSRR

SEQ ID NO: 27894 - protein, 357 aa, Thermotoga maritima MSB8
MGIVGLPNAGKSSFFNFLTDNSVPAESFPFCTIEPNVGILVVPDERIEILAKNEGSKKVVHPFVEVVDIAGLVKGASKGEGLGNQFLDHISKVDVIAHVVRLFEDGRVSHPYQNVDPKRDIEIVETELILKDLETVQKRLEKRMKVARTGDKEAKREVELLQNLREFLSQGKKASKFPRHDRFEEEVIESLFLLTDKPQILVFNVDELDEEKRKLIEEIVKEKDEEYIIINVKLEEELKFLPEEEAEVFRREYNLFGDKRKEFFEKVLKLLNLIRFLTATQNEARSWTIKKGSTAYEAAGLIHSDIQKGFIKVEVIPFERYVEFGSLKKAREAGAVETHGKDYIVREGDVIHFLFRA

SEQ ID NO: 27895 - protein, 199 aa, Magnetospirillum magnetotacticum MS-1
GAEIVLTPASKGMTGAVRQAEELLASTPGAIMPQQFKNAANPAIHERTTAEEIWNDTDGKVDIIVSGVGTGGTISGIGRVLKARKPGLKMVAVEPEDSPVLSGGAPGPHKIQGIGAGFVPDILDRGVIDEILQIGNETALSTARKAAKLEGVPVGISSGAAIAAALELGSRPENAGKVIVAIIPSFAERYLSTALFDQV

SEQ ID NO: 27896 - protein, 266 aa, Magnetospirillum magnetotacticum MS-1
MDFTEEQIHRYARHIILPEVGGIGQAKLLGSSALVIGAGGLGSPVILYLAAAGVGTIGVIDDDDVELSNLQRQIIHRTSNVGMAKVASAASAVADINPDVRVVPIRARLDKDNAREIFRDFQVVADGSDNFPTRFLVNDAARLEGKTLVSAAILRFDGQLATYKPGGPCYRCIYREAPPEGHVPTCSSAGVLGAIAGTMGAMQATEVIKELLGIGESLAGKLVIYDALSVAWRTVRVPRDPGCPLCGDHPTITDLSAHGSTSNVCG

SEQ ID NO: 27897 - protein, 216 aa, Oryza sativa Japonica Group
MDANRRQGGIQQLLAAEQEAQQIVNAARSVPRKLSEKHAFLLLFFCTLTKAKEEAEREIAEYRAQMEAEFQRKVAESSGDSGANVKRLEQETDTKIAQLKEQAANVSPEVIQMLLRHMEPFFCLAIFVNYGAGKWVILKDDESETATSMDADCRRLRDRSTTRRAADRRLPDCAGACPCRASFGSPCGAGGVVSAPRHRRRMAVRRRADIVTLLHC

SEQ ID NO: 27898 - protein, 481 aa, Xanthomonas oryzae pv. oryzae KACC10331
MFPGEPMSSASIDGAPDAGENTRFIILISCVATIGGFLFGFDSGVINGTVDGLKQTFQSTAAETGFEVASMLLGCAIGAFFAGRLADRSGRRAVLIISAALFLLSAIGAGASHSSGFFIFARVMGGFAVGAASVISPAYIAEVASARYRGRLATMQQIAIISGLFCAFLSNYLLANAAGASTEPLWAGQAAWRWMFWMQAVPSLLFLLLLLVIPESPRYLVVKGRREQALVVLKRLYGNAAAQTKLGEISASMSADRHKPKFSDLINQATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDLNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKCVYETKGKELEQMEG

SEQ ID NO: 27899 - protein, 477 aa, Borrelia burgdorferi B31
MISKLTKIVATISDLRCEPEHIKDLHDAGVNVIRLNTAHQSHEDTIKVIDNVRKISNKIALMIDTKGPEVRTANIENPIIVKTGDKVIISTSPINEPNNFQTNYDGFVKEVPQGSKVLIDDGELEMTVVAKLPDRLICEIKNDGQIKNKKSINTPGISLKLQSVTEKDKGFIELAAKYNVDFIAHSFVRHSKDVQDVQEILTASGNPDVKIISKIENQEGIDNIEEIAKASYGIMVARGDMGVEIPAEDVPIAQLKITQTCIKYGIPVITATQMLHTMIENPRPTRAEVSDIANAILNGTDAIMLSGETAYGKYPIEAVKMMTSIAKKVEKHRKMTLYKDELFYDKSITRNYIIKCAIDATKLMDIKAIIVDSLKGKTARIMATYRASVPLFITTNSERLARELALSYGVYSNLVDNNFKRTTEFVVTSLKMLKEQGVVNDKDTVIIISGNPNRNIEKGTEFMEINTVEDAIKGRNI

SEQ ID NO: 27900 - protein, 193 aa, Plantago major
VFYMLCGCMGYAAFGDLAPGNLLTGFGFYNPFWLLDIANAAIVIHLVGAYQVYCQPLFAFIEKYANAKWPDREFITNDIEIPIPGLQEPYRLNFFRLVWRTAFVILTTVISMLLPFFNDVVGILGAFGFWPLTVYFPVEMYIAQKKIPKWSTKWICLQMLSMACLVISIAAAAGSVAGVILDLKVYKPFKTSY

SEQ ID NO: 27901 - protein, 302 aa, Salmonella enterica subsp. arizonae serovar 62:z4,z23:--
MAALNSKVKKAVIPVAGLGTRMLPATKAIPKEMLPLVDKPLIQYVVNECIAAGITEIVLVTHSSKNSIENHFDTSFELEAMLEKRVKRQLLEEVQSICPPHVTIMQVRQGLAKGLGHAVLCAYPVVGNEPVAVILPDVILDEYESDLSQDNLAEMIRRFDETGNSQIMVEPVEDVTAYGVVNCKGIELAPGESVPMVGVVEKPKADVAPSNLAIVGRYVLSADIWALLAKTPPGAGDEIQLTDAIDMLIEKETVEAYHMKGKSHDCGNKLGYMQAFVEYGIRHNSLGAEFKAWLEEEMGIKK

SEQ ID NO: 27902 - protein, 668 aa, Staphylococcus aureus subsp. aureus Mu50
MVINLNDKQTKTSKEGLISVSHPLAAKIGKDVLDQGGNAMDAVIAIQLALNVVEPFASGIGGGGYLLYYEQSTGSITAFDARETAPEHVDKQFYLDDSGEYKSFFDMTTHGKTVAVPAIPKLFDYIHKRYAKLSLEDLINPAIELAIEGHAANWATEKYSRQQHARLTKYHETAQVFTHENQYWREGDWIVQPELGKTFQILREQGFNAFYKGDIAKQLVNVVKACGGTIILEDLANYDIQIKAPISATFKDYDIYSMGPSSSGGITVIQILKLLEHVDLPSMGPRSVDYLHHLIQAMHLAYSDRAQYLADDNFHEVPVQSLIDDDYLKARSTLINSNKANIDIEHGVVSDCISHTDVEENHTETTHFCVIDKEGNIASFTTSIGMIYGSGITIPGYGVLLNTTMDGFDVVDGGINEIAPYKRPLSNMAPTIVMHHGKPILTVGAPGAISIIASVAQTLINVLVFGMDIQQAIDEPRIYSSHPNRIEWEPQFSQSTILALIARGHAMEHKPDAYIGDVHGLQVDLNTRDASGGADDTREGTVIGGDVLSIRKQPLPSPKIYDNDTHRVYFNDMQLPLYAEQVRWMHDKYWVDESVIRIIFPEVSVHIEDLRSYEIAGKNYIDIAWLARKKGYQVTLKDDSLYLTDETYHSVKANTNAYYRYDRDSITR

SEQ ID NO: 27903 - protein, 262 aa, Sulfitobacter sp. EE-36
MTGELSPIDKAKFVAAKRAAQFVEDGMRVGLGTGSTAAWLVRCLGEMVRDDGLRIKGVPTSTRTAQLAREVGIEVISLDEAKWLDLTIDGADEFDGELNLIKGGGGALLQEKIVATASDQMVVIADIGKEVETLGAFPLPVEVIPFGWQTTQALVEETLVSMDVLGRNSTLRMNGDIPFVTDEGNYILDLHLKRIGNTRQMALVMNQMPGVVENGLFIDICDAVVIGYGDGRVEVRDINEGTVDRDKMEFVETDNLFSDLSD

SEQ ID NO: 27904 - protein, 234 aa, Plantago major
SIKSYVAEFIATLLFVFAGVGSAIAYNKLTSDASLDPAGLVAIAIAHAFALFVGVSMAANISGGHLNPAVTLGLAVGGNITIITGLFYWIAQCLGSIVACFLLSFVTNGLAVPTHGVSAGQTALQGVVMEIIITFALVYTVYATAADPKKGSLGTIAPMAIGFIVGANILAAGPFSGGSMNPARSFGPAVAAGDFSQNWIYWVGPLIGGGLAGLVYGDVYIASYAALPASEDYA

SEQ ID NO: 27905 - protein, 343 aa, Triticum monococcum
MAPPRVHLLLALALCLAFARADAAVRELRVGYYAQTCPRAEEIVRRVMARALAREARSVASVMRLQFHDCFVNGCDGSVLMDATPTMAGEKEALSNINSLRSFEVVDEVKSALEEQCPGVVSCADIIIMAARDAVVLTGGPNWDVRLGREDSLTASQEDSDNIMPSPRANASALIRLFAGYKLTVTDLVALSGSHSIGEARCFSIVFRLYNQSGSGRPDPHMDPAYRQALDALCPLTGDQNVTGGLDATPVVFDNQYFKDLVHLRGFLNSDQTLFSDNEGTRRVVTQFSQNQDAFFRAFIEGMVKLGELQNPRKGEIRRNCRVANGGRPPLEKQVAPFRVLDF

SEQ ID NO: 27906 - protein, 211 aa, Zea mays
MGCATSKQFSRSAPAHADPAVLATQTSFTMNEVEALYELYKKLSCSIVKDGLIHKEEFQLALFRNSRRANLFADRVFDLFDLKRNGVIDFEEFVRSLSVFHPKADTSEKTAFAFKLYDLRGTGYIEKEELREMVLALLDESDLCLSDSTVETIVDNTFSQADSNGDGRIDPEEWEEFVKRNPATLRNMTLPYLQDITMSFPSFIMRSEASD

SEQ ID NO: 27907 - protein, 488 aa, Sulfitobacter sp. EE-36
MSDFDYDLFVIGGGSGGVRAARVAAGEYGAKVALAEEDRYGGTCVIRGCVPKKLMVFASGYAELVDEAQCFGWDIKPGTFDWHAFKTRLNTELDRLEGVYRKLLANSDVDTFDQRATIKDAHTVQLANGETRTAKHILLATGGRPVRPDVPNAQLGIVSDDIFHLESLPKSILIVGGGYIGCEFACILNGLGVEVTMYNRAAQILRGFDDEARGLIAESMTNAGVDIHCGTSIVEMALESEHEAGTMPSNSDAAMGATAEQSNELNNCDARAGTQGPIWVKASNGAEKVFDMVLFATGRAPNTDGMGLEEVGVSLGRRHEVEVDEYSQSGVPSIYAIGDVTDRVNLTPVAIREGMAFVQTVFGGNPTPVDHDLIPSAVFTQPEFGTVGLTEEQAAEQEPVEIYSASFRPMQTAFAEKNKRVMMKLIVSKETRVVLGCHIVAPNAGELIQLVGIAVKAGLTKEQFDATCAVHPTMSEELVTMRSPTRTA

SEQ ID NO: 27908 - protein, 505 aa, Oryza sativa Indica Group
MEYLSSAAGPEFFVPASQGELFLKSEQQPSKRRHLTTLATESSGVGREYPTDGFIESFVLVVLILQAVVIGCSSLDELPVQLSNRRLLHDRNHAALLYKDHFPTVGNMTFPTSHQLQNDPNYKPLDSSSHPAEASAKKGSSKGFKKWLYMVVIPVAGLIMLAGMAWMFLPCRKKSVATIGPWRTGLSGQLQKAFVSGVPQLQRPELERACEDFSNIVASHPYYTVYKGTLSSGVEIAVVSTTIKSSKDWSKHCEDCFRKKIESLSRINHKNFINLLGFCEEEEPFTRVMVFEYAPNGTLYENLHDEAFDHIDWRSRMRIIMGIAYCIQHMHELNPANVHPDLHSSAVFLSEDCAAKIADLSVWQEVVSDGKKSTANNNHHEPISARLAGNVYSFGILLLEIISGKPPYSENEGSLANLALGCIIKGRSIASLLDPVLESHKENELDVICQIIMECIQSDPTKRPGMREITTRLRETIAISPDAATPRLSPLWWAEVEVLSPVEPR

SEQ ID NO: 27909 - protein, 282 aa, Plantago major
EDVNLGANKYSERQPIGTAAQTHDDKDYKEPPPAPLFEPGELSSWSFYRAGIAEFVATFLFLYITVLTVMGVSKSDSKCATVGIQGIAWAFGGMIFALVYCTAGISGGHINPAVTFGLFLARKLSLTRAVFYMIMQCLGAICGAGVVKGFGQTLYMTKGGGANVVAHGYTKGDGLGAEIIGTFVLVYTVFSATDAKRSARDSHVPILAPLPIGFAVFLVHLATIPITGTGINPARSLGAAIIYNRDHAWDDHWIFWVGPFIGAALAALYHVVVIRAIPFKNK

SEQ ID NO: 27910 - protein, 485 aa, Wigglesworthia glossinidia endosymbiont of Glossina brevipalpis
MNIMNYFIIGSFLIISSILLSSFSSRLGIPILFIFLSIGMLAGIDGIGKIDFNDYSVAYTVSNLALAVILLDGGIKTKRKTFQLALFPALSLSTIGVIITSGLTGIVASWIFNLNIIEGILIGSIVGSTDASAVFSLLGNTNLKEHVNATLEIESGSNDPMSMFLTTTLISILQNKNNEFYFDLMFFFNLIYEFGIGIIIGITGGWILYKIINRIVLVSSLYPLLALSGGIMAFSISNLLHASGILSIYLYGFMLGNHPIRNRFEILKIFDGMTWLSQICMFLILGLLVTPSDLLDISIPAFILSFWIIFIARPLSVLFGLLPFHKRYNKLEFIFLSWVGLRGAVPIILAVFPIISGLENSRLYFNVSFFIVLISLLIQGTSINFIAKLTKVTTPSSFNPTSRSEISLSIESSWEKLVYKIKNNSKISGKFINNIKLPEFSYIVALFRKDIFVKINPLTKIFSGDVIVIFIKKQDISKLGKIFDK

SEQ ID NO: 27911 - protein, 268 aa, Zea mays
  misc_feature (28)..(29): Xaa can be any naturally occurring amino acid
  misc_feature (84)..(85): Xaa can be any naturally occurring amino acid
  misc_feature (113)..(113): Xaa can be any naturally occurring amino acid
FNVSSVLNIFQVENGKAQAANFPFCTIXXNVGVVAIPDPRLQVLSKLSKSQQTVPTSIELVDIAGLVKGASKGEGLGNQFLSNXXRKWDSILQVVRCFEDDDIFHVNGKVDPXSDIDVINLELIFSDLDQIENRLDKLNKSKTKDTQVKVKEQAEKSGLEKIQQALMEGKPARSVDLAEHEKEAIKHLYLLTMKPVIYGANVTESDLAEPDSNSHVKEVAKAASDLQSGMVTISAQVEAELAELPLDERAEYLKSLGGAESGLGNLVK

SEQ ID NO: 27912 - protein, 319 aa, Clostridium difficile 630
MKMIKLATFAGGCFWCMVKPFDKYDGVIKVVSGYTGGHVENPTYQEVCSGTTGHLEAIQITYDDDIISYDELLNIFWKQINPTDDGGQFGDRGTQYKTAIFYHDEEQKNIALESREHLENSKIFDSKIVTDIIPATKFYEAEENHQDYYKKRPLNYNMYYKGSGRYNFVKSHWDGNNINREELKKTLTPIQFEVTQNDMTEVPFENEYYDNNKEGIYVDIVSGEVLFSSKDKFDSGCGWPSFSKPVIDKSIIERSDFSQGMYRVEVRSAKGNSHLGHVFDDGPKELGGLRYCINSASLKFIPRENMEALGYGEYLKLFE

SEQ ID NO: 27913 - protein, 151 aa, Populus trichocarpa
MQRLRRRCSNDVVRLDLTTPPNSSSLSIDGAESTETRIQRLISEHPVIIFSRSSCCMCHVMKKLLATIGVHPTVIELDDHEISALPPAAEDGSPSPSSLAPAVFIGGTCVGGLESLVALHLSGHLVPKLVEVGVLAFSPGYDNNNNPIISS

SEQ ID NO: 27914 - protein, 2287 aa, Botryotinia fuckeliana
MTQNDFEPIAIVGISCRFPAGANSPEELWSLISQGKSAWSDVPEDRFNWKSFLHPSSDVVGTINSRGGHFIDQDIRTFDAGFFGIPPAEANAMDPQHRLQLETAYEALENAGISLEKVRGSSTSVYVAIFNRDYDRMMFKDTNDIAKYHLLGSGEAIASNRISYTFDLKGPSMTVDTGCSGSLVALHQACQGLRSGDTDMALVGGTSLILSPDTMVPMSRMNVLDPSGKSFVFDDRGVGYGRGEGVATIVLKRLKDALNAGDHVRAVIRNTGINQDGKTSGIALPSQVAQQALANHVFKQVGLDPCKINYVEAHGTGTIAGDLAETKSIANVFCTERKKTLYIGSIKSNIGHLESASGAAGLLKAILVLEKGLIPPNVNLSNHKKGLDLEQSNIVVPSKIEKLSVDEDGKSRIAINSFGYGGTNAHAILETAPLVSTSSDFVGRFSLTNSLLPLEALSEQISKLGSQGSMASAKLFSLSAKSKASLIENIKKLRIWASEFKATASNNQLENLSYTLNQRRSVFQWRSSIVASTFEELIQNSDKAISEVTKASANVSVAFVFTGQGAQWASMGLELFLSNPTFRKSMQTSDQILRDLGCSWSLIKELFGTDQALSCVDQSIIAHPATTALQIALVDLFRSLRLTPSAVLGHSSGEIGAAYAAGALSHAVAIAISYYRSLLSGIGKKTAATKGAMLAVGLGEAEVTPFIQSLRNGKVVIACSNSSMSTTISGDETAIMELQHALESRFIFTRKLKVDTAYHSHHMELVAGQYFNMLTGLTHKDPDPKVLFVSSVTAGKKTTGFGPAYWVENLVSKVRFSDALEYLCQSQALVTGTSSKYIILEIGPHSTLSAPIRQVTAQLSHQSTIQYLPSLIRHQDSTRCILDSVRRLYDCSYTINLTPLNDFSKSGIQPEVVADLPSYSWDHGTPYWHESRLSLEHRLRKSPYHDLLGVCIVGGTPYTPHWRHLVSIEKLPWLADHVIDGSIIFPGAGYLCMAIEAIRGLLREQGRHHDTILRYVLRNISFSKSLTIPSSSNHVEIQLGFDLGKNQNDRTLVDWIGFDVSSFQNNSWKQHCSGNIKVEFHMPADEVEELREATFVAASETEMLQECSDGGAEPYEASEFYAKIKALGNDYGPKFATIRKLMVGDFHSTATISTPTISECMPSNFMQPHVIHPATMDAIFQAALPLYLTHCINGPVMPVYIDQLTVNSNVSAAPGQEFCVATKLNPTGPRSAMITSLAFQRDLDNELNCVLKLSNGELKGLGDAHPNGNFEKALPRSFTHTIQWNVDVNFMTTRIFRQYLSPAMNEAEIAKRQAAIDKVAALYIHDFLHDAKDTNVQLPKHFSLLLQWMQKYSKTKQYYKLISNNSVKNVDMILSEARTGIEGDFLRHLGERLVSIMSGSSDALSLMLEEDRLGRYYANEWLSKASSHLVKYLDLLSFKRPNLVVLEIGAGTGGTTFPVLQQLGNGNNSIFKRYDYTDISSGFFEGARSKFQNWSNLLEYKTLNIEIDPLEQGFEEASYDVVIASNVLHATKNVTQTLENVRRLLKPGGKLAFVEITRFSPMHNMTFGLLPGWWAGIDDGRQDTPILSVTQWNDALLRSSFNGVEVSASDFDGPASLCDLLVSTYTPTSVEPELEIEILVGETLAKVNNPSHDIQSFAWDIYLRLREQGFKTSFSSWSKKRVDSSCLYLILDCSNNPVLAHPTQEMFQNITQLAARGTRIVWITVPKDTGKFSANAETSLINGFARVARTENEGLKFTTLDIQQAYSSQKKEILTIISDIIKSLEVTDRSTSQESEYTFRDDRVFIPRLIPNAYLNSIVTSTLDITRPEPVRFQQSQRALKLHVEVPGLLDSMIFQDDKSKETPLEDDKVEIEVKACGVNFKDVFIALGQMRSTDQMVGECSGIISSVGANLNHRFRVGDRVWSLVATPYANFARSLGCTVYKIPDSMSFLTAASIPVVFTTAYYSLVNVAKLKKGQTVLIHAASGGVGQAALMIAKSIGAEIFATVGSLSKAEMLMERYNIAKSHIFSSRSLNFSSGIRRLTNGGGVDVVLNSLAGEAMQESWHCVAPMGTFVEIGKNDIYRRGNLSLEPFERNITFASVDMTLVVKHQSEKLQPIFENVMKMFNDEELRPVYPLMDMPISHVEQAFRLIQARKHMGKIVLDADNSSPVTVSSPISTPVRLDSHGTYLVVGGLGGLGRVIIRFLVSHGAKHVLILSRRAHEEKSKPLMTEIESHGAHCKIITCDVSNNEDCIQAIANAQRTMPTIHGVIQAAMVLQVSSSNFDVFP

SEQ ID NO: 27915 - protein, 261 aa, Legionella pneumophila str. Lens
MQNIEFYQIDAFTDKVFHGNPAAVCILDDWLNDELLKTIAAQNNLAETAFIIKDDQDFHIRWFTPNGEINLSGHATLAAGFALLESNKGPSDSIIFHHSSGQISVEKRKEKFVLNFPRIGYKKTPSPDPIVSLLDQPAIEVFETDLDYLVLLEHESQIRNLQIDLLALAQLPKRGIIVTSTTTEADFYSRCFYPKHSIAEDPVTGSAHCILAPFWAEKLNKSSLYAIQGLHRKGELYCELQRNRVLISGHCRWYLRGHLVI

SEQ ID NO: 27916 - protein, 170 aa, Vibrio vulnificus YJ016
MKEIGAMCGLIERINKGGVMLTWQDIITFTHQGNPQPDTVVRKSDAQWREQLGEAQYYVMRQHGTERPFSNQMCELFEPGLYRCAGCQNLLFDSGSKFDSRTGWPSFAQPMKSNAISYHLDETLARPRIEVRCNQCESHLGHVFPDGPAPSGLRYCVNAVSIEKVNQEAS

SEQ ID NO: 27917 - protein, 762 aa, Glycine max; identical to SEQ ID NO: 1357

SEQ ID NO: 27918 - protein, 97 aa, Synechococcus elongatus
  misc_feature (97)..(97): Xaa can be any naturally occurring amino acid
ATYKVTLVRPDGSETTIDVPEDEYILDVAEEQGLDLPFSCRAGACSTCAGKLLEGEVDQSDQSFLDDDQIEKGFVLTCVAYPRSDCKILTNQEEELX

SEQ ID NO: 27919 - protein, 1955 aa, Ustilago maydis 521
MTRSNTPHSHSQHTQQRPYYVPYSAAQGQHTNASSTRSSLARQSNGLHGLPQNNMNTSSSSISTFSATDVHPTPSVSRLAAHLPSHASPSAYDRFNEVDWIINLSSRIGNALQSPSRILQHAATSSAASPSSPSSYALNSSRSRVRLPRPSKEFRELQHRIQLSHTSSSSTAPADVSLISSISDRADDPDTSATSWAQHAQQDFEHRRAELQNSRQQVLKHLQDTRTDIDANQNNMHTAEQRSVDPAVERSILTAKSLQELMRSGGLQSQAAEHDDGFDNLLCSAEALPVTNHGLGPSSLFEANRASDGSLDIESILRQRAQIAAARDSDPSRPSIPSSTMLNLSQAASNPNKKPTIEMLGDASPPHSDPQPNQASHGHAEQVNEQTTHLDSDQRSVPHPHPMDQIAIVDGVFKIIATQPQQLPQHHTQTQHVQVDDVHVQDNEPFKRTTNHQIDSASDLDASDGTRSVADGEEEEQEEANQEEVAEGEEEEEGDEEEEEEEEEEGDDDDEDDDEEEDDDGDGMDDGAERRNTSHAASLHYYDGFGGVNTRDLLFETPIGDADEPIVLSDSDDNSETDSTSSNHQVDSQGSQDDQVEEQDQDELVEQSDSQSDSDSNHQDESNQGDIAGSQQHSHEPQQLQNPLDLADDERQEAKTQSDVDVSDAQQEAALQSEHNDVLNNSVESRIVSGFDDGLLAEQLEAETQEPEMSRPAAVSFLNTASERANGQLPHDSEGEGVPDSEVEPEELDQDLRWSDFEPAQQQGEDSSRAQSPARLEPADLAFRARVEAHSMPGFVSAARIFADIQTSEADSTDQASPPACASDERLERIDPQLLEGFSNNELVTDLFSSAHTASNDDPQESSRSKVQTEADIFDAFTRQDASSDTHDTVDERQLQDQEAFPAAAEDIQDTESAIEEDHDAAIEVPPSKPGDAVSYFERGSAAGEADLHRPDTDQDSPAAAAPEETQNDGAVIKESHDADTEESLTKPGDVDSVNEQGAAASEGDDVLAGSELGKDAETKHHASLPSLVAEKMVGRQGNQHVDTVEQVNASHSDAKEAPASREQMGVSQFGEAEELLTAAPVSVGDKDGSDATIEKSQASLMCIESTDVLEADVQDNSGNEAAPDAAILQLENGPALVAAADASSNAEANTVEADSNTIGILNTDVIVDAPVSVNSEPLDASVALEASEPHVSVHVPEEAIHETEKEATLSGHLTDRDSSLERQVAPAAAATLSAIQEHSTAQGDAAQVYTEVKADVDAAALVPNPSEKVSSEQEKSKDTALAKEDADQLADDQGGNGTSPAAKVSHHQGSTEHNLSSDVANEQPTFSKPEQESKDIDLPVSVFENSLTPRRVPPSPASSDRRSTSSFTPSANRQGNRHLHGAAKRNFFAQVTEAASGLASNLAAPLRALPSLLPISERRAEETREDNEKAEHTARIENKMEGNGREEERQQKSRSNNSTELPKFTITTRSHCICRRLQLSKVEGAPIFIVPGCSINYEQAHKEGAEDLGLTDESLADDWLTVDPDLIPEDVHHTLSRIIGLEFLNEGICVEPDSTAAKLVFSGFDLGVDLLPPLDEEASHSQGMGSDDTVNKRDLDAKVENKTGESAKNVENSSDEAREENDSAHTRTDSSEGNNLEQEPETPTRATRRSNRHRRNSSAASASSHHRSPRHADPKSPNADYLPEEERRRLAKHRHPQAVVSGDVSIASLEKQATEQMAEDHSSKVGTIKEDDQAEVHAPPAPPAALPSQSKKKRGRPRKSAAKDAQDTPTAQHEPRANEVDLDLPSSPKLKKRRGHKSAASAAPDAGEAPINEDEDEHDAVAVESALDAIELTPKRSLRGGQTCEEKAELKEEGDAERNHRQNEDRDQLEPQQDSKRKAGRGRKKRKQPSEENSVASLREETEADKKIPKLDQADSVKEIHTRRRSRGGAASQSPSATKTSPRKSLKRKVLKLN

SEQ ID NO: 27920 - protein, 389 aa, Acinetobacter sp. ADP1
MNSSLSLLHPYPFEKLNVLFKDVTPADLPLIPLSIGEPKHPAPEFVKQAIIDNFNHLSTYPNSKGLPELRESIARWLTQRFQLNHISSEDHILPVTGTREGIFSFVQALINRDEAPYVVMPNPFYQIYEGATLLAGAKPYFINCTAENDYLGDFDAVPSEVWEKTALLFVCTPGNPTGAVLSKEKLKKLIQLSDQYNFVIASDECYSELWFDQAPVGLLEVCAEIGRDNYKNCIVFHSLSKRSNLPGMRSGFVAGDAELLKPYLKFRTYHGAAMPVQHQLASIAAWNDEAHVEENRQQYRAKFNLFQSELGQLIPLKKPDAGFYYWLHVDNDEAFAKMLMEKAHIKVLPGRYLSRETEQGNPGENHVRMALVADLAQCEQVVQRLKKVL

SEQ ID NO: 27921 - protein, 306 aa, Magnetospirillum magnetotacticum MS-1
MSTTDSADILHDRKAWLDRAKTLSEALPFMRQFNDETLVIKFGGHAMESDDLARLFARDVVLLKQVGINPVVVHGGGPQIDAMLKRLNIQTPRVDGLRYTDEATVEVVEMILAGKINKQIVSAINEAGGFAVGLSGKDGHLIRARKLRRTKKDPDSNIEKVLDLGFVGEPAEINPHILNQFKTSDTIPVIAPVGMGGAGETYNINADTAAGAIAGATNAKRLLMLTDVAGVLDKSGNLIPEMTAAQVHAYIADGTISGGMIPKVETCLDAVNQGVDGAVILDGRVPHAILLELFTPHGVGTLIKAG

SEQ ID NO: 27922 - protein, 225 aa, Glycine max
MGQDQNQRSLIYAFVSRGTVILAEYTEFSGNFNTIAFQCLQKLPASNNKFTYNCDGHTFNYLVDNGFTYCVVADESIGRQVPVAFLERVKDDFVAKYGGGKAATVAANSLNKEFGSKLKEHMQYCVEHPEEISKLAKVKAQVSEVKDVMMENIEKVLDRGEKIELLVDKTENLHHQAQDFRNSGTKIRRKMWLQNMKIKLIVLAILIALILIIVLSVCRGFNCGK

SEQ ID NO: 27923 - protein, 330 aa, Candida albicans SC5314
MSTTATSTNELALLDKSVVVSPLVLLSVVDHYNRVAKDSKKRVVGVILGDNSTDTIKVTNSYAIPFEEDEKNPGVWFLDHNFIDSMGEMFKKINAKEKLIGWYHSGPKLKPSDLKINEVFRRYTDNPLLLIVDVQPREVGIPTDAYFAVDDIKNDGSAAEKTFIHVPSLIEAEEAEEIGVEHLLRDIRDQAAGNLSLRVSETHQSLLGLHQKLGEIANYLDKVYQKKLPMNHTILGKLQNVFNLLPNLMQQSGSDLDGGSDSSHALATAFTVKTNDELMIIYISTLVRAIIAFHDLIENKLENKKLNENKAQASVAESSLNSEKKDSIED

SEQ ID NO: 27924 - protein, 139 aa, Acinetobacter sp. ADP1
MGKLNKTEREWQRELSPEEYRITRQKGTEPAFTGQYWNTKQSGTYVCRCCGTELFSSISKYDSGCGWPSFYKPINTTAIEEHDDFSHGMVRTEIVCHHCDAHLGHVFEDGPQPTGLRYCVNSASLQLKTDEKNDEETYP

SEQ ID NO: 27925 - protein, 476 aa, Acinetobacter sp. ADP1
MSQKKSVIFKNLLPVIKQYQQAGFTHEKIVALLKDQHDLDLVTTETFKSYLYRYAKVTPTPSESLKMTNTIQTPREIKKSSKLEHVCYDIRGPVLRAANEMEEQGHKIIKLNIGNPAPFGFEAPQEIINDVALNLPNAIGYTDSKGIFPARKAICQYYQQKGIRDMHVNDVYVGNGVSELIVMAMQGLLNDGDEMLVPMPDYPLWTAAVNLSGGTAIHYKCDEENSWYPDIVDMESKITPNTRGIVVINPNNPTGSVYPRHVLQQIVALAKKHDLILFADEIYDKIIYDGIEHVALASLAGDQLCISFNGLSKSYRVAGYRSGWMAITGDKSRAKDYIEGLDMLASMRLCANHQAQYAIQTALGGYQSINDLIRPSGRLYEQRNIAWEMLNEIHGVSCVKPEGAMYCFPKLDPNIYQVEDDEQLMLDFLRAEKVLLVQGTGFNWPTHDHFRLVFLPAENELREAITRLSRFLATRR

SEQ ID NO: 27926 - protein, 355 aa, Acinetobacter sp. ADP1
MIHKAVKSFGLGLTLLAASVSLYAKNNVVVVATGGTIAGAGASSTNSATYTAAKVPVDALINAVPQIKDLANVSGIQALQIASESITDKELLSLARQVNDLVKKPSVNGVVITHGTDTLEETAFFLNLVIHTDKPIVLVGSMRPSTALSADGPLNLYSAVALAASDEAKNKGVMVLMNDSIFAARDVTKGINIHTNAFVSQWGELGTLVEGKPYWFRSSVKRHTNASEFNIENIKGDQLPLVQIVYGSDSMIPDAYLAYAKAGAKAIINAGTGNGSVGNYIVPTLKKLHDEQGIQIIRSSRVPQGFVLRNAEQPDDQYGWVVAHDLNPQKARLLAALALTKTNDAKEIQRMFWQY

SEQ ID NO: 27927 - protein, 350 aa, Triticum monococcum
LSYICSAAAMASRAAAAVLVLAALICAAHSSAAAEGLSRSFHAASCPDLENIAGSLVAETFRRDVGVAPALIRILFHDCFPQGCDASVLLTGNNTELNAVPNQTLRPVALDLIERIRAAVHAACGPTVSCADITVLATRDALVNAGGPHFDVAFGRRDALAPASQDLVDTLPAPSFDVPTLISSFGNRSLDVADLVALSGAHTFGVAHCPSFSDRFTPNVDLNPLIDPLFARRLRAKCAKDVPQGTVNQTLDVRTPDEFDNKYYLDLIVRQGLFKSDQGLIDHPETRLLASRFALIQSAFFRQFAKSMVKMSNMDLLTGTQGEIRQNCAVPNRRVDVIETANDEGHTAAM

SEQ ID NO: 27928 - protein, 176 aa, Triticum aestivum
VRKRVRLLMGLGSQGYRPRRTVERKRKSARGCIVDSDLSVLDLVIIKKGEKDIAVITDTTNFRRLGPKRANRMRKLFNLAKTDDVRKYVIRRMVTKEGKKEADKSPKIQRLVTPQRIQRKRSQLADRRNRATRRKELQTEYAKILAKRQKERSEARHQLHQKRRTSSTRKSESEAK

SEQ ID NO: 27929 - protein, 430 aa, Nicotiana alata
MAVIISVKVLLIQLFVLVLGSFSKLSHGYYQAQPFLTLPLPFDLPPAKIPLLPIRGVPSISLVPPPPPPPSPRSPPPPSPSPPPPSPSPPPPTPSPPPPSTLIPFIPPFTGGLLPPLPGSMLPGLLPLIPNLPDVPPIGGGPPVNRPKPSAPSPPVKPPPPPPSPCKPSPPDQSAKQPPPAKQPPPPPPPPPVKAPSPSPAKQSPPPPRAPSPSPATQPPTKQPPPPPRAKKSPPPPPPPPVAYPPVMAPSPSPAAEPPIVAPFPSPTANPPHVPRRPAPPVVKPLPPLGKPPIVNGLVYCKSCNSYGVPTLLNASLLQGAVVKLICYGKKAMVQWATTDNKGEFRIMPKSLTTTDVGKCKVYLVKSPNPNCNVPTNFNGGKSGGLLKPLLPPKQPITPAVVPVQPPMSDLYGVGPFIFEASSKMPCAKN

SEQ ID NO: 27930 - protein, 391 aa, Triticum aestivum
  misc_feature (180)..(180): Xaa can be any naturally occurring amino acid
SWANRHPSLSLFLLLLGLSSSLASGQVLFQGFNWESWKHNGGWYNFLMGKVDDIAAAGVTHVWLPPASQSVSKQGYMPGRLYDLDASKYGNKAQLKSLIGALHGKGVKAIADIVINHRTAERKDGRGIYSIFEGGTPDARLDWGPHMICRDDRPYADGTGNPDTGADFGAAPDIDHLNPXVKKELVQGLTWLKDRLPASTGRRLRPSPKGLLRPNRGLDLKRWAAKANVSPGANNSGRTLNVAVEGELWRLRGTDGKAPGMIGWWPAKAVTFVDNHDTGSTQHMWPFPSDRVMQGYAYILTHPGTPCIFYDHFFDWGLKEEIDRLVSIRTRQGIHSESKLQIIEADADLYLAEIDSKVIVKLGPRYDVGHLIPGGFKVVAHGKDYAVWEKI

SEQ ID NO: 27931 - protein, 198 aa, Streptococcus mitis
GIEDILVVTGKSKRSIEDHFDSNFELEYNLKEKGKHDLLKLVDETTGIRLHFIRQSHPRGLGDAVLQAKAFVGNEPFVVMLGDDLMDITDDHAVPLTKQLMNDYETTHASTIAVMPVPHEDVSAYGVIAPQGEGINGLYSVETFVEKPAPEDAPSDLAIIGRYLLTPEIFDILENQAPGAGNEIQLTDAIDTLNKTQR

SEQ ID NO: 27932 - protein, 153 aa, Streptococcus mitis
EHFIRGQYRSGKIDGMKYISYRSEPNVNPESKTETFASGAFFVDSDRFRGVPFFFRTGKRLTEKGTHVNIVFKQMDSIFGEPLAPNILTIYIQPTEGFSLSLNGKQVGEEFNLAPNSLDYRTDATATGASPEPYEKLIYDVLNNNSTNFSHWD

SEQ ID NO: 27933 - protein, 643 aa, Staphylococcus epidermidis
MKNNNETRRFSIRKYTVGVVSIITGITIFVSGQHAQAAEMTQSSSDFNEQSQQTEQVEHKEDTTHLSYELNQEGDTASQSKTNQENQSDGNVQKKSNQIQQDSTQTSPLNDQKQTSMEQQSKDNHVTPNSRQDTYPKGQNQDDKGKQQFKDNQHSQTGHQPNTQNQNNDQDSSDKKQHPSDQTQDSSSKGTQPKQSQSIEDRDKTVKQPSSKVHKIGNTKTDKTVKTNQKKQTSLTSPRVVKSKQTKHINQLTAQAQYKNQYPVVFVHGFVGLVGEDAFSMYPNYWGGIKYNVKKELTKLGYRVHEANVGAFSSNYDRAVELYYYIKGGRVDYGAAHAAKYGHKRYGRTYEGIMPDWEPGKKIHLVGHSMGGQTIRLMEHFLRNGNQEEIDYQRQYGGTVSDLFKGGQDNMVSTITTLGTPHNGTPAADKLGSTKFIKDTINRIGKIGGTKALDLELGFSQWGFKQQPNESYAEYAKRIANSKVWETEDQAVNDLTTAGAEKLNQMTTLNPNIVYTSYTGAATHTGPLGNEVPNIRQFPLFDLTSRVIGGDDNKNVRVNDGIVPVSSSLHPSDEAFKKVGMMNLATDKGIWQVRPVQYDWDHLDLVGLDTTDYKRTGEELGQFYMSMINNMLKVEELDGITRK

SEQ ID NO: 27934 - protein, 158 aa, Streptococcus suis 89/1591
MRRILTAKLRNSSGVLNRFTGVLSRRQINIESISVGPTEVDGISRVTVIVDVVSHDEVEQIIKQLNRLIDVVRVRDLTDIPHLEREVILVKISAPPTKRAEILAIIQPFRANVVDVAPHSITIQMTGDGDKIDALLRVIQPYGIKNIARTGATGFSRD

SEQ ID NO: 27935 - protein, 84 aa, Arabidopsis thaliana
MASSMLSSGAVVTSPAQANMVAPFTGLKSSASFPVTRKANKDITSITSKGGRVYVLANGKRGVAGAPIKTGKNKFETLSYPPCP

SEQ ID NO: 27936 - protein, 416 aa, Streptococcus suis 89/1591
MITAKNVEQAYSVLKRVVVRTPLDYSRYLSEKYGATIYLKRENEQRVRSFKIRGAYYAISQLTDDEKSRGVVCASAGNHAQGVAYTCQEMQIPATIFMPITTPQQKIGQVKFFGGDYVEIRLVGDTFDESAKAAQDYTQESGKTFIDPFDDENVQAGQGTVAYEILEEAEEQTISFDQILVPIGGGGLVAGVSAYLKEHAPEIKIVGVEASGARSMKAAFDKGRPVKLDQIDKFADGIAVQKVGKSTYEVARKYVDRLIGVDEGWISGTILDLYSKLGIVAEPAGAATIAALEVVKDQIKGQTICCIISGGNNDINRMPEMEERALIYEGIKHYFVVNFPQRPGALREFVNDILGPNDDITRFEYIKRANKGTGPVLIGIALGDKTDYTQFISRLEEFDPQYINLHENDSLYKMLV

SEQ ID NO: 27937 - protein, 118 aa, Triticum aestivum
FTSLGSRATELSPAKMSTVTPAYLDQRLAAAKRSSREAAMAGAKAAAVATVAAAIPTLASVRMLPWARAHLNPTGQALIISTVAGMAYFIVADKTILSMARKHSFDDAPEHLKNTSFH

SEQ ID NO: 27938 - protein, 627 aa, Debaryomyces hansenii CBS767
MSAADANQVQESLEKLNLDSAPVASTEETEQTASGETEEAADSAQVSDTSASLYVGELNPSVNEALLFEIFSPIGQVASIRVCRDAVTKKSLGYAYVNFHKFEDGEKAIEDLNYSLIEGRPCRIMWSQRDPSLRRNGDGNIFIKNLHPAIDNKALHDTFTAFGKILSCKVATDDMGISKCFGFVHYETAEAAEAAIENVNGMLLNDREVYVGKHISKKDRESKFEEMKANFTNVYAKNIDLDFSEEEFKKLFEAYGKITSIYLEKDHEGKSKGFGFVNFENHESAVKAVDELNDKEINGQKIYVGRAQKKRERLEELKKQYENTRLEKLSKYQGVNLFIKNLDDTIDSEKLEEEFKPFGSITSARVMVDETGKSKGFGFVCFSSPEEATKAITEMNQRMIYGKPLYVALAQRKDVRRSQLEQQIQARNQMRMQNAAATGGIPGQFIPPMFYGQQPGFFPPNGRGNGPFPGPNPQMMMPRGQIPPPQGQWPRPGPNGQPVPVYGMPPVYGGDFNNGANGGRQQRGYYPNRNQNQKGRQQKDLAAIIANAPADQQKRILGEESYPKIVSTGKAQEPEAAGKITGMMLDLDNEEILALLEDDELFNTHFEDALTAFEEYKKSSEAATAEN

SEQ ID NO: 27939 - protein, 404 aa, Nanoarchaeum equitans Kin4-M
MNPKEEALKVLKEADEVANIDVYEYLKEPERVVETYFPARTKNGIEYFKGYRVQYNTALGPAKGGIRFSPTVTKEEVEALALWMVIKNALLGLPFGGGKGGVVVNPKEYEEWELENIARGFVRSIAEFIGEDKDIPAPDVYTNERIMAYMMDEYEKIVRHKAFGVITGKPIILGGNPVRNIATSLGGYYVLNEAVKLKKVENTVAIQGFGNAGQGIAKLLDGQYKIVAVSDSKGGIYCKDGIDIEKLIEVKKKTGSVINYEGCEKITNEQLLELDVGILIPAAIEGVITKQNADKIKAKIILELANGPTTREADKILYEKGVLVLPDVLANAGGVTVSYIEWVGNKRGMPFNEKETKELLKEKMVHAFLDVLEVSNKYNIDMRLASYIIALERVKQAMRYRGLI

SEQ ID NO: 27940 - protein, 477 aa, Oryza sativa Japonica Group
MPTITHYVLDPLLETGSATQSQKAASKPPPAPPLPQEKAAEKPIPVPVAPVRRAQTASATLYATPESTSLPDSPSSFPGTWSPYLINHKRRGPCLVKTLSQGDVGSDGSQQPTLSVTLPPLPKRSQSFEAQEPEFEFQQASNGVLEGDSGVVETLDWQNGMLQKGKGTVSGEYGHDQAEFEFQHGNPDATVRPVNVGRPANGGTPRKINNDAFFELQDSLSMASNSEAEDAGGHERWWKPSSPLGTSVGTPGAEFYDAFEEISSDGATRSSQCMDDDLREMRLSLLMEIERRKQAEEALENWQKEWKKLSDHLSLIALTLPPPSLAEDTDDSSMDPGAELCQQITVSQLVAAAIARGFARAEVETDMETKIAAKNFEIARLSDRVQYYEAANREMSQRNQEAIELERSKYSLWCVESPRCQRCRGNNEISERRDRSGSGARLGLQLPLAQQPLPGPTYLQRSPKPVKTLIPTAIRAR

SEQ ID NO: 27941 - protein, 183 aa, Oryza sativa
MADSEAPRGFGGRGRGGRGRGRRGDREDRGDRGGRGRGRGNRGGKDDDKEWVPVTKLGRLVKDGKIRSIEEVYLFSLPIKEYQVVDFFLPRMKDEVMKIMPVQKQTRAGQRTRFKAFVAIGDSNGHIGLGWKCAKEVATAIRGAIIAAKLSVIPVRRGFWGNKIGDVHTVPQKVSARSGSVNM

SEQ ID NO: 27942 - protein, 88 aa, Zea mays
VQGEIIPIQPKSRGAIMTKENKAYPRAPRDPRSLVAMQLMTDNRIRHIPVVKDKAMIGMVSIGDLVRAVVTEHREELNRLNAFIQGGY

SEQ ID NO: 27943 - protein, 269 aa, Acinetobacter sp. ADP1
MFKQLKEDIQAVFARDPAARNTLEVLTTYPGIHALIMHRMAHELWNKDFKGTARALSSFSRFATGIEIHPGAKIGRRFFIDHGMGVVIGETAEIGDDVTLYHGVTLGGTTWNTGKRHPTLEDGVVIGAGAKILGPFTIGKGAKIGSNAVVTKAVPAGVTAVGSAARFIYKNIEKNEDEIRRENYAQSIGFQPYATTRDQADPILEGMKVLLDRLQQNEVRMNTLCQRLSSLDPSFNKQNYDQQPFSQEELKIIEEVRRECEAQTHTDKA

SEQ ID NO: 27944 - protein, 441 aa, Physcomitrella patens subsp. patens
MSSDVELAVQVGIVRAQGRAGMIYEVELAATTPTVLRGSIPKVLRQPTWRMNRMEFSCMWTIFGCLAFVRSLLPVEIVEALTRWLRKLNSHLVPYVVFEIPEFEGSSINELYKNVQLHLTAKNLCRNARKTVLCRVKNSTNTTSTLAGGEGVMETFEGAKIWWTHAVHGFKTSDGSSQDHRSYTLKIHKRDRDRIIPAYLDEIRENAYNFMFKNRYCRSRGISNTTCFQNANAGFAMEPKLMPWIPTFKLHVRSNSELKQLLIQTTNKSVIVIEDIDCSVCFAHPRSRQPTSSSSELSFSESSEQGKLEDDGGRITLSGLLNFTDGLWSCCGNERILIFTTNHVDKLDAALLRPGRMDLHIHMSYCTYSAFKTLSLNYLTLENHHLFPKVEKLIRNGAKITPAQVSEILIQNRDNSDDAMENLVSFLEHRAWSSCKIHPNA

SEQ ID NO: 27945 - protein, 691 aa, Bacteroides fragilis NCTC 9343
MKRYFIISLLTLASTVAPLTAVFAQSSFIYEKGKSFKDVNASPMPQTIRLDRTAEPVIYENAVPENATTICYRIQLPSYVRGTFFSRDSRSGDYEWPNNTNRLLPWMFNHLTDLTRDDYPGIPSNARPSTLGDALLLQLTDGSYLFTKAVAGDNSLSWFQVNTDGSLNLYVSTLGTDRLEHKVPVALVQSAGNIYQVFRQAYETLISDRNVSALQKRTEKNYFEALNYLGWCTWEHYHFDIDETKILNDLDAIETSGVPVRYVLIDDGHLANKNRQLTSFTPDPQRFPNGWAPIMAHKNKDKIRWIGLWYALSGYWMGISPDNDFPTHVKNSLYSFNGSLLPGKSTPNIDTFYQYYVHSLKTHGFDFLKVDNQAFTLPLYMGSTEVVRQAKECNLALEKQTHAQQVGLMNCMAQNVLNTDHTLHSGVARVSIDYKKYNENMAKSHLFQSYTNTLLQGQTVWPDHDMFHSSDTICGSLMARSKAISGGPVYLSDSPKEFVKENIFPLIDKEGKIFRPEAPAIPTPESVLTNPLQDGKAYRVFAPTGDEAVSVICYNLNTSPKHRKVTAEIDPKDYLLRETLTGKPTPQQKRVILFDWNNQTATELTGKQTVELDGFTDRLFHLCPIHDGWAVIGIQEKYLSPAAVRILSSTPDKLVLNVLSPGTLKIWTENSGKQELRNIQVKETGKMTIRK

SEQ ID NO: 27946 - protein, 537 aa, Sulfitobacter sp. EE-36
MSQLETEHSVDLFVIGGGINGCGIARDAVGRGFTVELAEMNDLASATSSASTKLFHGGLRYLEYWEVRLVREALIERETLLKAMPHISWPMRFVLPYHKDMRFEGDTPTSKLLNVFMPWMKGRRPAWLIRLGLFMYDNLGGRQILKGTTAVDLTQAPEGAPLQDKFEKAYEYSDCWIEDSRLVVLNARDAQARGARINTRTKVVSAEQVDGVWQVTLEPKDGGPQRVVQAKMLVNAGGPWVENVIRNTVRINSSEGVRLVRGSHIVTPKLYDHDKCYFFQGEDGRIIFTIPYETDFTLIGTTDADHTDVSEKPVCTPEEQDYLVRFASKYLKKQITTDDIVWTYSGVRPLYNDGASSATAATRDYVLKVDTSAGAPVLNVFGGKITTYRRLAESALEKIQPYFANDAKPWTAGVALPGGDFPVDGVAALKQGLQDRYGFLTQRWADRLVKAYGREAFDVLGDAHTAADLGRDFGATLTEREAKWLIDKEFARTADDIIWRRSKLGLRLDADELNTLEAWMVETTATPADNTTAATGA

SEQ ID NO: 27947 - protein, 520 aa, Ustilago maydis
MTASVSSNQTSLSRRSSHNRHSRISSGSSSASSGSSRPRSSRGRSTSPINPTKQEAAVQMAAKRASVSSVGSTISSSYSTLTADSKVADTTAATSTVSASASSNKVPAGLRAMLFEEEYQEEAIEHMHHMELQTVAAVELMDVQPELKWFMRPYLVDFLIEIHQTFRLPSRNTFLTMNIVDRYVSKRIVYKRHYQLVRCAALLIAAKFEDAKDRVLSVKELSQMCCNAYDESAFAQMEGHVLSTIGWTLGHPTAEAWLRIESVRGGEDLKTVNLARFFLEVSLFHRDFISLKSSALTTGALILARFICGLPQSTQLSLNAEAAKAAHMLDAYVWENLQDLSLILIKKYSYAYFSSASTVACEWYRARVAAAKSSPPSGLLPAQALTRNAGAVAQEVDDDDSMCSQPTTPASSVQSTPSRSMDEDEDEDEEDDMPVTPLSLYSLHDPLVAAANAAGLPVPMPSSRASAQDKERRLSSSSASTEKPMPSSKSASTHLTVQQPMLGARKPLGNVVWNVNVQQF

SEQ ID NO: 27948 - protein, 118 aa, Deinococcus radiodurans R1
MSRVVLEGLEFHAHHGVFAAEGVLGARFVVDAELHSPFAGIADDLGQAVNYAAAYAAIREEVTEKTHQLIEVLADRIADRLLSDFSRLERVKVRVHKPFAPLPGIFRDVYAEIEKERT

SEQ ID NO: 27949 - protein, 263 aa, Wigglesworthia glossinidia endosymbiont of Glossina brevipalpis
MDIIMSIDIKSTNEIIKIRKSCKIASEVLTMIENYIEPGISTEKLNKICHEYIVKKKHAFPASLGYCGFPKSVCISINDVVCHGIPNKKIILKDGDILNIDVAVIKDEYYGDTSKMFFVKDVKKEAIDLCKSTQKSLYLAIKKIHPGMRLRKIGSIIQKYIESKNYSIVREYCGHGIGKCFHEEPQILHYDAYDKEIKLKPGMIFTIEPMVNIGSKNVYTGKDGWTVKTKDKSLSAQYEHTILITNYGCEVMTLREEELLLKQ

SEQ ID NO: 27950 - protein, 327 aa, Sulfitobacter sp. EE-36
MTAPTLRRYLTQNSFDPDLVFLLEDIASASRLIAGLVRRGAFEGNLGAAGEINVQGEAQKTLDIMANDVFERECANSPRVAALVSEEVEEVTWLKEPQKGDYLLYFDPLDGSSNLDVNLSVGSIFSVMQVQADGDRNVLHNGRNQICAGYAIYGPSTMFVVTKGDEVAGFSSDPDTGEFSLTHPKMTVPAETSEYAINTSRARYWYAPVSRYVDEAIAGKEGPRGRSFNMRWTASMVADVHRILTRGGVFLYPADSNNQKTGGKLRLMYEANPMAMVIEAAGGAASTGQGAIMDVAPTAPHQRVPVILGSRDEVAVLDSYHKDAADS

SEQ ID NO: 27951 - protein, 497 aa, Mycobacterium smegmatis str. MC2 155
MHTVETPDARRSDSPVEYRWYAGGTWRPADEDWFDDADPWSGEVYARVARCGRQEAAAAVQAAADAYPAWSQTTPREKARLFRAAAAVVARRRDDLAVTLARETGTTKVNADFQITLTIELIEQAAGWVYLPAGEVLRSDFADTSQTVVRRPLGVVASFTPWNGATILSWRAALSPIAAGNTVVVKPSELAPVSAGLQLAEIMEEAGFPAGVVNVVTHGPGEAGPIADEFFDNPLVRCINFIGSVPTGRMLAERAGATLKRSVMELGGYNPLIILEDVDLDYAVRVAAFSAFFHQGQICLNARKILVHRDIYDEFVARLVAKAESLTSGDPLHADTFIGPLITPAAVELVHARVNDAVAKGARLLTGGTYDGPVYAPTVLVDVPDDAVVSSEETFGPVVVVHPVDTAEEAIEIANRPLYGLSSAILSGDTHRATKLAESLRSGVVRVNLPTIDDEIQAPIGGVRDSGWGRSGPWALQDFTDLVAIAVQSGQRDLPIS

SEQ ID NO: 27952 - protein, 365 aa, Vitis vinifera
MADQENSVRITRAAKKRAAAAMAASDSLQLPPNKKRVVLGELPNLSNVAATPAAVPASGAQKQKFRPKKKEKVKAAVVAPDVGAKSDDPQMCGPYATDIYEYLHSMEMEPKRRPLHDYIEKVQKDVSHNMRGILVDWLVEVAEEYKLASDTLYLTISYIDRFLSSKALNRQRLQLLGVSSMLIAAKYEEISPPHVEDFCYITDNTYTKEEVVKMEADILKSLNFEMGNPTIKTFLRRFTRIAQENYKTPNLQLEFLVYYLAELSLLDYGCVKFLPSMVAASVIFLSRFTLRPKTHPWCSSLQHHSGYKPSELKECVLIIHDLQLSRRGGSLVAVREKYKQHKFKCVATLSSPSVIPVSYFEDIKE

SEQ ID NO: 27953 - protein, 136 aa, Triticum aestivum
  misc_feature (45)..(45): Xaa can be any naturally occurring amino acid
MHKPPMATSKAPPASTLVARSGIARSQALGFPPMRKRIERVRCSXSKDGKEAAPAATVRGGGGSLLTTAGAVTASAGPALALVDERMLAEGTGVKIAPPPPPVGWILLGVFGLIWSLYTVYTSGLEEDEESGGLSL

SEQ ID NO: 27954 - protein, 229 aa, Zea mays
KELTLLGLWASPFVLRARIALSLKGLTYAYSEENLDDKSELLLSSNPVLKKVPVLIHHGKPVCESQIIVQYVDEAFPAAAPNFLPSDPYDRAIARFWASYVDDKFYSAWIPVFRGRTAEEMAEAARQAVAALETLEQAFRECSKGKAFFGGDSVGLVDVVLGGLVGWLYATEAICGVKALDAGRTPLLAAWAERFCALEGVKGLIPDVDRLLEYTKARRAVFGLPPLRP

SEQ ID NO: 27955 - protein, 2323 aa, Botryotinia fuckeliana
  misc_feature (580)..(709): Xaa can be any naturally occurring amino acid
  misc_feature (1872)..(1972): Xaa can be any naturally occurring amino acid
MSFPEPVAIIGMGKLLYLFFERNEVANRRSGCRFPGDSDTPDEFWKMLAEERSGLSRPPLSRWNIDGFHANKARPGSLTPEGGYFINEDIWKFDPAFFGIVQEEAKAMDPQQRKLLECVYESFESGGITLSQLSGSNTGCYIGNFTSDYYLQGHRDHNNPKPYSLLGSGYTIISNRVSYLFDLCGPSLTIDTACSSSLYSLHIACRALQTKEIDAAVVGGTNLMLAVETQMSTDKVGVLSATSTCHTFDESADGYGRAEGVGAIFLKRLSDAIRDNDPIRGVIRGTATNANGKTSGITQPSAKGHETVMRTAYEFAGLDPRDTSYFETHGTGTQVGDPIEIKGVGNFFFNGTDRQKLLVGSVKTNVGHSEAASALASIIKVCLAMEKRTIPATIGIKKLNPKIDFKGGRIEVVQKMTPWPKGFSVCRASINSFGYGGANATAIVEAADSVLPGKLTYTRRGQDERDLEASSEESESVEMVGTKSASQVRAVSRSEFLLLFSAHDISTLKSNIERCRDVAEDYNILDLAYTLGCRRSNFFNCAYTVAREDDVEEDLMEHEITFGKRGNGGKHWFHLYRTRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKVLCWLLAPALKKYTLISTDGLRIACYNSPNSVTLSGDIEPATIVQKKLESDRVFVRELKTGGRAYHSHHMLNIGNDYESRLSEALSRFGASQTTNQAQVQNPVFFSSVTAQQMPSNFKPGPSYWRQNLESPVRFTEAVEAALAADLGISQFVEIGPHSALAGPLRQIRDNLGITPKDLDYAATLVRGQSSVTRLLDLAGTLTMRGFSVNVERVNAIEKREGGAIITKTGLPIVDLPRFSWNYSAGEIRNKNRPDEEHRLRKFKYHDLLGAILPGSSVEQRQWRNMLDSKNFPWLEEHKLGPQPVLPGTGYLAIATEAARQFFHDKLTVSGAFRYFFPNISITSALNIPPSGSQVEIVTTMKFATITASITSKTIAEFTISSIQAGNWTNHCVGTVTKKKAVTMAPRFDESKLQEPKAARTWYRGFQKVSLNYGPAFNGLSNIRTNPALEEAVADTELCPDGVSEHDSAYIVHPAAMDTCIQVALIGAHKGSLAGLKRSFVPTSMANVSLWSWADDDHITQLTPGKGKVLAHAEFFSLRAMNGWCQLFSPEGKPLFEIEELSCTQYSEALDDLGTIDRHPYLRTVWKPDVDKMVSNLTDNSLLDLIVHKRPGFNICEILNTESMISDNLHRVLESGSSLRRYKTYTVMALGDVDIEPIKVKYEAFPGVVVQKLVLDDVPETFFDLLIVPQFPSDEIDLAKLKGLLTPGGNMLLYSSEFKNGNTIKTDLQLAGLYTLLEDKESLLISPHQRTSSDLPAGEIVLVTRTSPTVFDSHIFSGLSKSGRLITSISLQDFKFHAHTKATYVFIVESESSIFHGSLTSQELATIQSVASGATNMLWVTHGNLLEGDDPNAGIVIGLGRCLQTEHPTLTFKTLDLDHRDPIQTISNITTILNAADSGDEDKEFMVKNGIFYVSRLSQDPLLDQQFVSGVESEPKMIPYEPEKRIRLGIERVGIFDTIHFKDDELEASLKPGEVEVDVKAVGLNMKDFATLQGTYNSEILGLEGAGIVRSIGTGVTNVAIGDRVSWAGFGNFRNIERYDSRFLQKLKPEETLDQMSSIMMPFLTAIYGLIYLAKLQPGESVLINSATGGVGLAAIQIAKMIGAEIFATVGTPEKKKFLMQEYGLQDDHVLSSKDASFAAEIMQTTGGRGVDVSLNSLVREQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPWSMFGLVTWLKKGARHLIFLGRSGEDRPEAASMIKDFRNDGITVDVVKGDVTRISDVQKAVDLAAGPLFGVVQGVMALDDRLFTSHDLNSWEYAVRPKVTGTWNLHNAVASHSLDFFVMLGSSSALSGFPTQSNYCAGNSFLEFFARYRQSKGLPATTISLTVVTEVGFVSQNERIEDGLARTGVHTINEAGVIDLIDTAMMKAPSSSWNLDPLANSFIVTGVEPLQLSANLDIDSIPFWRQPRIGPVFNAVLAKKSGNETGPGQNKRRLLLPDILEMIVEKFSQTFNVAVEDIDPGTEVVRFGMDSMIGTSLRTWCYKTLGADIAASDFMSLNLTADSLAKKIYDIRKG

SEQ ID NO: 27956 - protein, 446 aa, Chenopodium rubrum
MAARAVLQEQPRGGVQQKNGQGGERRNRTALGDIGNVVTARGGAIGAANGIAKPQAINRPLTRSFCAQLVANAQAAAEKKKKQGVKAVDVNVGGARKAGVGVAVAPAAAAQKKVQEKKKTEVVVAETKTPSGHGKVEQKPASKKKKTPTFTSFLTARSKEACGLSKKPQELIVNIDEGSVEDELAVVEYVEDIYSFYKIAEDESRVRDYMDSQPDINEKMRSILVDWLIEVHYKFELRQETLYLTINIIDRFLSMKIVPRKELQLVGIASMLIACKYEEIWAPEVNDFVQISDKAYVREQVLCMEKTILGNLEWYLTVPTPYMFLTRYVKASVTLDSEMENMSYFFSELGMMNYSTTIKYPPSLLAASSVYTARCTLNNSPSWTETLKHYTGYSENQLLECARLLVSFHMAAPEGRLRAVYKKFSKPDNGAVALRPPAKSLLASTS

SEQ ID NO: 27957 - protein, 367 aa, Magnetospirillum magnetotacticum MS-1
MGFNCGIVGLPNVGKSTLFNALTSTAAAQAANYPFCTIEPNVGRVAVPDPRLDRLVVIGKSQKEIPTQLEFVDIAGLVRGASKGEGLGNQFLANIREVDAIVHVLRCFEDGDITHVEGSVDPVRDAETIETELMLADLDSLERRIVPLEKKAKNGDKEAKAQVDVMAPLLAVLREGKPARTVTFDSEEERRIAKTLGLMTVKPVVYACNVDEASAATGNKFSEAVAKFAAAEGNSSVVISAAIESEVAQLASEDERKEFLETLGLEETGLARVIRAGYELLHLITFFTVGPKEARAWTLQKGCKAPQAAGVIHTDFERGFIRAETIAYDDFIACNGEAGAKEAGKMRLEGKEYVVNDGDIFHFLFNV

SEQ ID NO: 27958 - protein, 357 aa, Mycobacterium bovis AF2122/97
MSLSLGIVGLPNVGKSTLFNALTRNNVVAANYPFATIEPNEGVVSLPDPRLDKLAELFGSQRVVPAPVTFVDIAGLIKGASEGAGLGNKFLAHIRECDAICQVVRVFVDDDVTHVTGRVDPQSDIEVVETELILADLQTLERATGRLEKEARTNKARKPVYDAALRAQQVLDAGKTLFAAGVDAAALRELNLLTTKPFLYVFNADEAVLTDPARVGELRALVAPADAVFLDAAIESELTELDDESAAELLESIGQSERGLDALARAGFHTLKLQTFLTAGPKEARAWTIHQGDTAPKAAGVIHSDFEKGFIKAEIVSYDDLVAAGSMAAAKAAGKVRIEGKDYVMADGDVVEFRFNV

SEQ ID NO: 27959 - protein, 567 aa, Physcomitrella patens subsp. patens
MGNSSGRPRDSRKGSGGGSQGGSSQGSYPRNEGSYPRGSGHGGSTQPRGCNQGGSTQPRGSNQGGSTQPRGGSHGNAGGYRQAPKYTPPVPKPKPVAPGFLGKPLSDILNSYTLGKELGRGEFGVTYTCTHKDTNEVYACKTIAKRKLTHKDDIEDVKREVQIMHHLSGTLNIVTLKAVFEDKHNIHLVMELCAGGELFDRIVAKKCYSERAASDLCRVIVNVVHRCHSLGVFHRDLKPENFLFTSMAEDAPLKATDFGLSTFFKPGERFQDLVGTAYYIAPEVLRKDYGPEADVWSAGVILYILLCGVPPFWAETEKGIFDAIMRGTLDFTSDPWPRISDDAKVLVKGMLNPDVNARLTAQQVLDHPWMKEDGASNAPLDNAVLTRLKNFSAANKMKKLALKVIAQNLSEEEIAGLRQLFKSIDVDNSGTVTLLELKEGLIKQGSKFSESDIAKLMESADLDGNGKIDFNEFISATMHMNKLEKEDHLFAAFHHFDRDNSGYITVFELQQALEENGVGDYDTIQEIIDEVDTDNDGRIDYDEFVAMMRKGNPGAEEGEKHNHRHRY

SEQ ID NO: 27960 - protein, 121 aa, Triticum aestivum
NKFVQKSRLLPVRNSRDIVDPRVRKVQGRAIHYHIADDKGDVDEDTERRSFTFNGSNLEELTQKLQEETGIDDLIVCTRSPISGKLTPLLLQLPPNNAAMHIVLVRESSKVASARPGPYGT

SEQ ID NO: 27961 - protein, 568 aa, Xanthomonas oryzae pv. oryzae KACC10331
MSHSVEDIKSESRRLRGSLEQSLADAVTGALREDDQTLIKYHGSYQQDDRDIRDERRQQKLEPAYQFMIRTRTPGGVITPAQWLALDGIATRYANHSLRITTRQAFQFHGVIKRELKATMQAINATLIDTLAACGDVNRNVQVAANPLLSQAHATLYADAACVSEHLLPNTRAYYEIWLDEERVSGSGNEDEPIYGDRYLPRKFKIGFAAPPLNDVDVFANDLGFIAILRDGRLLGYNVSIGGGMGASHGDAQTWPRVANVIGFVTRDQLLDIATAVVTTQRDFGNRAVRKRARFKYTIDDHGLDTIVAEIARRAGFALQPAQPFAFEHNGDRYGWVEGEDGLWHLTLSLPAGRIADTDTATHLSGLRAIAQLNVGEFRMTPNQNLVIAGVPASERARVDALVAQYALDAGNRSASALARGAMACVALPTCGLAMAEAERYLPDFSAALQPLLQQHGLADTPIVLRLSGCPNGCSRPYLAEIALVGKAPGRYNLMLGGDRRGQRLNTLYRENITEPEILAALEPLLARYAAERDHANDEGFGDFLHRAGLIALPSYPTHRRLDLELLA

SEQ ID NO: 27962 - protein, 483 aa, Physcomitrella patens subsp. patens
MSAPMPRPRPTSYSANGVLGKPLVDIRQTYSLGRELGRGQFGVTYLCTHKTTGEILACKSIAKRKLTTKEDVEDVKREVQIMHHLSGTPNIVDLKGVYEDRHSVHLVMELCAGGELFDRIIAKGHYSERAAADLCRVIVNVVHRCHTLGVFHRDLKPENFLLSSEAEDAQLKATDFGLSTFFKPGEVFHDIVGSAYYVAPEVLRRNYGPEADVWSAGVIVYILLCGVPPFWAETEQGIFDAVLRGHIDFVSDPWPKISSGAKDLVRKMLNMNVKERLTAYQVLNHPWMEEGGDASDTPLDNAVLTRLKNFSTANKMKKLALKVIAKNLSEEEIVGLRELFKSMDTDNSGMVTFEELKDGLLRQGSKLRESDIRELMEAADVDGNGKIDFNEFISATMHMNKLEMEDHLFAAFSHFDTDGSGYITIDELQEAMEKNGMGDPQTIQEIINEVDTDRDGRIDYDEFVAMMRKGNPITEDGGKHRHR

SEQ ID NO: 27963 - protein, 187 aa, Acinetobacter sp. ADP1
MSLINTEVKPFKATAYHNGQFVEVTEADLKGKWSVVFFYPADFTFVCPTELEDLADNYAEFQKLGVEIYGVSTDTHFTHKAWHDTSEAIKKIQYPLVGDPTWTLSKNFEVLIEAAGLADRGTFVIDPEGKIQIVEINAGGIGRDAQELLRKVKAAQYVHSHPGEVCPAKWKEGEATLAPSIDLVGKI

SEQ ID NO: 27964 - protein, 81 aa, Triticum aestivum
  misc_feature (56)..(56): Xaa can be any naturally occurring amino acid
  misc_feature (58)..(58): Xaa can be any naturally occurring amino acid
  misc_feature (71)..(71): Xaa can be any naturally occurring amino acid
  misc_feature (74)..(74): Xaa can be any naturally occurring amino acid
  misc_feature (77)..(77): Xaa can be any naturally occurring amino acid
MAEESGRPLPKFGDWDVNDPASADGFTVIFNKARDEKKGGNGQDTESPSKDTRTEXVXESYAAKPSTKKWXCCXKSXPTQS

SEQ ID NO: 27965 - protein, 196 aa, Triticum aestivum
MSLSNKLSIRDLDLKNKRVLIRVDFNVPMKDGAITNNNRIVQALPTVKYALDNGASAVILMSHLGRPNGEAVAKYSLKPVAAEVEKLLGQPVEFLNDCVGPDVEKACQSATGGKVILLENLRFHIEEEGSAKVEGQKVKADAEAVKKFRASLTALADIYVNDAFGTAHRAHSSMVGVDLPQRAAGFLMQKELEYFA

SEQ ID NO: 27966 - protein, 339 aa, Vibrio sp. Ex25
MKVLVTGGMGYIGSHTCVQMIEAGIEPIIVDNLCNAKLEVLNRIEALTGKQPAFHQGDVRDEAFLDTVFAQHDIQAVIHFAGLKAVGESVAKPLEYYDNNVNGSLVLARSMRKAGVKSIVFSSSATVYGDPEIVPITEDSPTGATTNPYGRSKYMVEQCLSDLFHAENDWSITLLRYFNPVGAHPSGCMGEDPQGIPNNLMPFIAQVAVGRREKLAVFGSDYPTPDGTGVRDYIHVMDLADGHIAALKSVGETSGLHIYNLGTGKGSSVLEMVDAFAAACGKPVPYEFCPRRPGDIAECWASTEKAERELGWKATRTVAEMTADTWNWQSNNPSGYSPE

SEQ ID NO: 27967 - protein, 505 aa, Burkholderia vietnamiensis G4
MSAFTETAHDETGSVDPDRGDAVRAKVRVAPVVLAGGSGARLWPMSREQYPKQLIGVLGADSLLQATVQRMTGFTAGESEVSAPIVVCGDEHRFVTAEQLRASGLAASIVVEPARRDTAPALTLAAAVAHADGQDAIVVAMPADHAIADTPAFHRAIALAVEHARRGAIATLGVPPTRPDTGFGYIKLGEALDGGAHRIERFVEKPAAELAAQYVESRAYWWNSGIFVVRASVWLDTLRALQPDMHAACLTAYVQGKTDGPFFRPHEQAFLQSPADSIDYAVMERLASTAVGAEGVVVPLDAGWSDLGSWDAVWEALDKDADGNVGRGKVVFEGATSSFVHSEGRLVACVGVTNAVVVETADAVLVADRSHVQDVKGLVSRIRAQQAPEADAHRKVRRPWGYYDSIDHGARFQVKRIVVHPGGRLSLQLHHHRAEHWIVVSGTALVTRGDEQFMLGENQSTFIPLGVTHRLENPGKLPLELIEVQSGSYLGEDDIVRFDDTYGRA

SEQ ID NO: 27968 - protein, 180 aa, Bradyrhizobium japonicum USDA 110
MNQPASAYFIEDRHDPNETHTLSVLVQNEPGVLARVIGLFSGRGYNIESLTVSETEAQKHLSRITIVTTGTPMVIEQIKHQLDRMIPVYRVVDMTQTKRSIERELAMVKVRGQGEHRVEALRLADAFRARVIDATTESFVFEITGNTDKINQYIDLMRPLGLVEVSRTGVAAIGRGPEGM

SEQ ID NO: 27969 - protein, 325 aa, Ustilago maydis
MNYVQLEKLGEGTYATVYKGRSRLNNEIVALKEIHLDAEEGTPSTAIREISLMKELRHTNIVRLYDVIHTESKLMLVFEYMEQDLKKYMEIHGHRCALDPVTTRSFMFQLLKGTAFCHENRVLHRDLKPQNLLINKRGELKLADFGLARAFGIPVNTFSNEVVTLWYRAPDVLLGSRTYSTSIDVWSAGCIMAEMISGLPLFRGRDNNDQLNQILRILGTPDDNTMKRLVNDSPEIQMRAFPRVPRVPFQNMFPKAHPLAIDLLDKLLKFDPTQRISADEALRHPYFTTSAAIAGLTHPQSNSQLNVGNGGAPQQGAYQQGVPGQ

SEQ ID NO: 27970 - protein, 141 aa, Triticum aestivum
MAQGEETKVEGTREEERADAGAGAEEEEVEVKFRLFDGSDIGPIRCNAAATTVAALKDRVVADWPKDKTIVPKSANDVKLISGGKILENDKNIAQCRAPFGDLPSTVITMHVVVQPSSAKSKPDKKTNKLPKTTRCSCTIL

SEQ ID NO: 27971 - protein, 601 aa, Zea mays
MGIAVVALHTMPGAFTTHSPASILSLRPDFTRINSRTNSVPNARTLQGVLRIPRLRSVRRLCQRIDDRVTEGNGPWVKDAMNNASQVLGDISVLGQAVSGNGGLNGSAAKTPPQRRKSSSVEDEAWELLQESMVYYCGSPVGTIAANDPNDSDPVNYDQVFIRDFIPSGIAFLLKGEYEIVRNFILHTLQLQSWEKTMDCHSPGQGLMPASFKVRTIPLDGDEDATEEVLDPDFGEAAIGRVAPVDSGLWWIILLRAYGKCSGDLSVQERIDVQTGMKMILKLCLADGFDMFPTLLVTDGSCMIDRRMGIHGHPLEIQALFYSALLCAREMLTQEDGSADLIRALNNRLIALSFHIREYYWLDMQKLNEIYRYKTEEYSYDAVNKFNIYPDQISPWLVEWIPPKGGYFIGNLQPAHMDFRFFSLGNLWSIVSSLATTHQSHAILDLIESKWSDLVAEMPLKICYPALENQEWKIITGSDPKNTPWSYHNGGSWPTLLWQLTVACIKMNRPELAAKAIEVAERRIATDKWPEYYDTKRARFIGKQSRLYQTWSIAGFLVAKLLIEKPDAARILWNDEDAEILNASSTNRKRGKKVLKKTYIV

SEQ ID NO: 27972 - protein, 116 aa, Brassica napus
MAKDGPNWDGLLKWSLSHADGTQSTRQLSEEDRKWFMEAMQSQTVDVVKRMKEITLVMQTPQHVLVDHGVTSQDIEDLLDELQEHVESIDMANDLHAIGGLVPLLGFLKNSHANIR

SEQ ID NO: 27973 - protein, 488 aa, Deinococcus radiodurans R1
MSKITGFLEQPRVKEQYAPIDARLKHYHEFMLPLDSASARLQATRCMDCGIPFCNNGCPVNNIIPDFNNLVFEDDWKAALDVLHATNNFPEFTGRICPAPCEAACTLNISEDPVGIKSIELAIIERGWQEGWVRPTPAEVKTGKKVAVVGSGPAGLAAAQQLARAGHDVTVFEKNDRVGGLVRYGIPDFKLDKSHIDRRIEQMQAEGVTFRTGVLVGDWDENSKITNLSKERVTPAELREQFDAVVLAGGSETPRDLPAPGRELNGIHYAMEFLPQQNRVNAGDKFKGQIRADGKHVVVIGGGDTGSDCVGTSNRHGAAGVTQFEVMPQPPEQENKPLTWPYWPMKLRTSTSHEEGAVREFAIATKEFIGKGGKVTGVRTVRVEMKDGKLEEIPGSEETHKADLVLLAMGFTNPMQSVLDAFGVDKDPRGNVLAGTEEHGGYLTSVPGVFAAGDMRRGQSLVVWAIREGRQAARAVDQFLMGESVLPR

SEQ ID NO: 27974 - protein, 105 aa, Plantago major
MDKVMKIKSENGVVIFSKSSCCLSYAVQMLFQELRANAFIYEIDHSPDGKEVEKALMRLGSSGPIPAVFIGGKLVGSTNEVMSLHLSGSLIPLLKPTQANLSYKS

SEQ ID NO: 27975 - protein, 171 aa, Triticum aestivum
FRAAARAGRGINAEPGAGDITTLLLDPQAFRDTTDLFVEGYKDKDITVVAGVEARGFIFGPPIALAIGAKFVPIRKPKKLPGEVISEEYSLEYGTDKIEMYVGAVQPNDRVLIVDDLIATGGTLCAAAKLIERVGAKVVECACVIELPELKGRDKLGDMPVFILVQADESV

SEQ ID NO: 27976 - protein, 230 aa, Vigna radiata
ELKCFDGFKSGRSDPSGIIGSPFVCRVKIALKLKGVEYKYVEENFRNKSEQLLKYNPVHKKVPVFVHGDKPLPESLVIVEYIDETWNNNPILASDPYQRALARFWSKFIDDKIVGASWKSVFTVDEKEREKNIAETYESLQFLENEIKEKKFFGGEELGLVDIAAVYVAFWIPLIQEIAGLELLTSEKFPNLYRWSQEFLNHPIVKESLPPRDPVFAFFKGRYEGLFSSK

SEQ ID NO: 27977 - protein, 529 aa, Cryptococcus neoformans var. neoformans JEC21
MPVPDNTSPRYSLQPPCGLPAPFRLPLRQLEDNGANQVGDIGSVRRSTATDNDGSGDTLMSCFGTLTIPSLPLKDESAEVVGSAHDNHTGVQTKCYPGPKLSDRATQGPDAGPLIDRFSCLFQDQYDCRFNPKGIVSLGVAENFLMQQQCMELFSSALHSNITPLDLSYGDSLWGSRRINKALSAFFNEWFNPAEKVLPEQIITGVGCSAVLDQLFYTILDENEAVLLAAPYYTGFDRDLISRGRVKLIPVHLSPERAFGPESLELFEEVYDKITAQGITVRAVIVCNPQNPLGRTYPRETLLAYAKFCQNNDLHLVSDEIYALSVYNNKDFPEALPFTSMLSLNVQEELGINFDKSRLHVVYGMSKDFCANGLRVGSLVSQHNPFLLRSMANTSMLMKLSSPADVIWSSLLHDKIALKKFITTNRQLLGEAQAFIRKWFEDRGVPVADHNAGNFVWVNLGAALEFDDVTTEKQIFQKLLDGGVYIAPGSAYHYHIPGWYRVTFSVARDNLLVGLGRIEKLLGLRLVKS

SEQ ID NO: 27978 - protein, 1122 aa, Arabidopsis thaliana
MESLIEEEEESRFFDAHEEIASCSSPCKIESPSSISGEFRYDVWIKSPGNTEERREKFLKWMGLSSTVNESKSGNVYRLSSSVNESAVLMSLKSDDDEFSSSRCDSFSPSESVDRVVNESLCKEEGEVDSGMVLRNLGFVDDGDISSSLCSLSSSPVSDKIVKEHGEPKLLPDPMVAEEEREVSGIMKRVKEKWLSRLYKVRNKRSAGGDDNGGEVAVCGSRIERVKVKEYKKEAKELSALFKGQEIQAHEGAILAMKFSPDGRYLASAGEDGVLRVWSVVEDERCEEHDVPKIDPSCIYFEVSKLSELRPVAVEKDGITGSLMSPRKTTESACVIIPPKIFRVLDKPLHEFLGHSGDILDISWSKNNRLLSASVDNSVRLWQIGCEDCLGIFSHNNYVTSVQFNPVDDDHFISGSIDGKVRIWSASQCQVVDWADARGIVTAVCYQPDGQAVIIGTLTSDCRFYNVSGHCLQLDGHICLHNKKKSSNKRIIGFQFDSTDPSRVMVASADSQVRIISGRNVVHKYKGSRNAGNQISASFTADGKHIVSACDDSSVYVWNCVGHDPEQSSPGFFSHTKRLKIRSFEKFSADVSVAIPWCGFTPVLSGGSELSPSLFSLGREYVLDSPKGSATWPEEKLASSFSPVKAIRRSHYKFLRSSCRRTSESSHLWGLVIVTGGWDGRIKLFHNYGSEASIGVNYGTLANNLPPPQQVAEFLLHSTVINRIRLFDTDPQILQAFANTGIAVTVTVPNDQIPHLTNLSSAKQWISDHIQPHFPSTNIIRILVGNEVISTADHLLIRTLIPAMQSLHTALVSASLHRRIQISTPHSLGTLTNSTPPSSAKFRRGYDAQVLKPLLSFLRSTSSPFVVNPYPFFGYSIETLDFALFRPNPGLFDQHTKLLYTNMLDAQLDSVYSAMDKLGFSDVEIVIGEIGWPSEGDIDQIGVDVDTAAEFNKNLIARVDSGTGTPLMPNRTFETYIFALFNENLKSGPTSERNFGIFRSDLTPIYDIGILRPTFRSSDPVYNPRSPVRGSSSKRWCVTKAGAETVALQRNIDYVCGLGLDCRPINEGGLCYLPNTVKAHSKYAMNLYYQTMEKHEFDCDFDNTGEITTIDPSYGNCEYQAN

SEQ ID NO: 27979 - protein, 387 aa, Zea mays
MVSDQEIASCVESVLRGSAGGPGEVSLTAVLQQAEATLGVDLSHKAGFIRDQMDLFFGPRLQPQPLTTPQLAPPPPQAVVAPADAVPQPQPQHQVLPQAPPSAQQMQPQQLAPLQPQLMFQTIHQLPAISPVPVVSAPPAMAFYPPPPLAFRYTTGLAGAATGGTVSFQQPAPGAGGTASPTAAPQVAGDNKESSSKRKRGGPGGLNKVCAISPELQTIVGETAMSRTQIVKQLWAYIRQNNLQDPDDKRKIICNDELRVVFETDNTDMFKMNKLLAKHITPLDPKGQLHEVKRMKAPTMSPQPGRSIDQPSIVISDALAKFIGTDGTFPHDFALKYLWDYIKANQLEDVINESILCDSKLQELFGCESIPMSGLSEMLGHHFIKKT

SEQ ID NO: 27980 - protein, 544 aa, Legionella pneumophila str. Lens
MTKESEIKIPDIGGANQVDVIEILVKEGDQIEVDTPLITLESEKASMDIPSPISGTVTQILVKVGDKVSEGDLIVKAKSDTTANISSSQEQKAEPEKQNLQTRAEEQSVDTKATASTPGSKDIEITIPDIGGANDVDVIDILVKPGMEVEKDQALITLEGDKATMDIPSPYAGKVIEMKIKLGDKVSQGTPILTLKTPGKSETPDIEKSQIKNISEQSIKEIEKPYEEVKSEPISINSLEIAESKSILISAGPAVRRLAREFGVDLSLVQGSGRKSRITKEDLQNYIKVRLSEKTTSGGFSLPSNPAIDFSKFGSIETKPLNKIKKLTGTNVHRSWITIPHVTQFDEADITDLEAFRKSESESAKNQDYKLTLLAFVCSVVCKALHAYPQFNASLDASGENLIYKKYYNIGIAVDTPNGLVVPVIKNVDKLSVIDIAKEMSRLSTKAREKGLTPIDMSGGCFTISSLGGIGGTAFTPIVNSPEVAILGLSRSIIKPIYDNKEFKPRLMLPISLSYDHRVIDGAEAARFTRFLCDCLGDIRRVLL

SEQ ID NO: 27981 - protein, 474 aa, Legionella pneumophila str. Lens
MANKIKTDVVVLGSGPGGYTAAFRAADLDKKVVLVERFDSLGGVCLNVGCIPSKALLHIAKVVDEAHEMSEQGVAFGKPKFDNKKLVAWKNSVVAKLTGGLKALAKQRKVEVITGTGKFSGTHQILVETKEGTVEIEFDNAIIAVGSESIKLPFIPEDKRIFSSTGALELADIKGDLLVLGGGIIGLEMATVYSSLGVNVTVVEFMDQLIPNADADLVNILQKRMTKKGVKFLLKTKVTAVEAKKDGIYVSMEGEHATDKPLCFQQVLVAVGRKPNGGAINAEKAGIKVDERGFIPVDNQLRTNVPHIFAIGDVNGQPMLAHKAIPEGKVAAEVIAGKKHYFEPKCIPSVAYTDPELAWAGLTEKEAKEKGINYEKASFPWAASGRALSMGREEGMTKLLFCPETNRILGAGIVGVNAGDLIAETALAIEMCCDVEDIALTIHPHPTLSETIAQSAEAFEGTITDLYLPKKKKK

SEQ ID NO: 27982 - protein, 386 aa, Vibrio sp. Ex25
MSELIQNVKASFEQVLGYAPSHIIQAPGRVNLIGEHTDYNDGFVLPCAINYQTVVAAAKREDNIVRVVSVDYGNVVDEFDIIQAITFQQDKMWANYIRGVVKCLLARGYQFTGADISVSGNVPQGAGLSSSAALEVVIGQTFKVLFNLEISQAEIALNGQQAENEFVGCNCGIMDQMISAEGRENHAMLLDCRSLETEAVSMPEDMAVVIINSNKKRGLVDSEYNTRRQQCEEAARIFGVKALRDVTIEQFNEKVAELDEMVAKRARHVITENDRTVEAAQALRAHDMKRMGELMAESHASMRDDFEITVKEIDTLMEIVKEVIGDQGGVRMTGGGFGGCIVALVPPALVDDVKAAVEAKYQAATGLKESIYVCQAKNGAGLVEVL

SEQ ID NO: 27983 - protein, 466 aa, Mycobacterium bovis AF2122/97
MVDGGGGASDLLVIFGITGDLARKMTFRALYRLERHQLLDCPILGVASDDMSVGQLVKWARESIGRTEKIDDAVFDRLAGRLSYLHGDVTDSQLYDSLAELIGSACRPLYYLEMPPALFAPIVENLANVRLLERARVAVEKPFGHDLASALELNARLRAVLGEDQILRVDHFLGKQPVVELEYLRFANQALAELWDRNSISEIHITMAEDFGVEDRGKFYDAVGALRDVVQNHLLQVLALVTMEPPVGSSADDLNDKKAEVFRAMAPLDPDRCVRGQYLGYTEVAGVASDSATETYVALRTEIDNWRWAGVPIFVRAGKELPAKVTEVRLFLRRVPALAFLPNRRPAEPNQIVLRIDPDPGMRLQISAHTDDSWRDIHLDSSFAVDLGEPIRPYERLLYAGLVGDHQLFAREDSIEQTWRIVQPLLDNPGEIHRYDRGSWGPEAAQSLLRGHRGWQSPWLPRGTDA

SEQ ID NO: 27984 - protein, 237 aa, Zea mays
  misc_feature (198)..(198): Xaa can be any naturally occurring amino acid
MYRAASGLGALKQHGADTQLLNIAVRSASTSVAQRSSGGFLGWLTGARSNALPPPDFALPGVTIPPPLADHVEPGKTKITTLSNGVKIASETSPGSACSVGVYVHCGSVYETPETLGATQLLKKLAFTTTRNRSQLRVVREIGAIGGSAKASANRELMSYSYGALKTYMPEMVEVLVDCVRNPALLDWEVKEEIMNLXAELAEASSNPEAFLLDALHSSGYSGALANPLIASEASIS

SEQ ID NO: 27985 - protein, 122 aa, Oryza sativa
MAPANTLPAWSDLQAHRDSVGKSFVLKEAFASDPQRFDRFTRTFTSDGVSSEILFDFSKNFLTDETLDLLVKLAEQAGVEKKRDAMFAGEKINFTEGRAVYHTALRNVGGWDMKVDGVDVMN

SEQ ID NO: 27986 - protein, 175 aa, Candida albicans SC5314
MAAVYPRTCYKCGEVGHVADDCQQEERLCYNCHKPGHESNDCPDPKQNTAKQCYSCGDVGHIQTECPNQAQGAKCYNCGQFGHISKNCDSAPSSTNNAPSFKRPSGRASGTTCYKCGGPNHFARDCQANTVKCYACGKVGHISKDCHSSAGGSNFSAKTCYNCGKSGHISKECTA

SEQ ID NO: 27987 - protein, 392 aa, Carboxydothermus hydrogenoformans Z-2901
MFSERALQIGESPTLAIDKKAKELIKQGKKVINFGVGEPDFDTPEYIKEAAINALRQGKTKYTPVGGIPELRKKIAEYLTQRTGVNYEDQEVVVTCGAKHGLYNIFQVILNPGDEVIIPVPYWVSYVEQVKLAGGVPILVPTGENFKLAPDKLINYLNNRTKAIIINSPSNPTGVVYSFDELKSLGRLLKDREILIIADEIYERIYFSEKPISFVAANPELKEKTFIVNGFSKSHSMTGWRLGYVAASRQYAAKLIELQSHQTSNPTSFAQWGALAALTIEDDSVEKMVQEFKKRRDFVVSRLQELKLKVIEPAGAFYVFPRIDNCFGKKHSGKIINTSIDFAEIMLEYYLVAMVPGIAFGDDRFVRLSYALSLADLKEGLKRLETFLKNLE

SEQ ID NO: 27988 - protein, 195 aa, Oryza sativa
  misc_feature (25)..(25): Xaa can be any naturally occurring amino acid
WIPRAAGEDDEEEEQKMQQHLAPQXYKHLISIKAGKPKGTLLDALQSDPEKVRRLSLSEQQLAKLADHHGTEIVRFTQRNLLRIYPKGTRVTSSNYNPFLGWVHGAQMVAFNMQGYGRALWLMHGFYKANGGCGYVKKPDFLMQTDPEVFDPKKSLSPKKTLKVKVYMGDGWRMDFTQNHFDQYSPPDFYARVGI

SEQ ID NO: 27989 - protein, 258 aa, Xanthomonas campestris pv. campestris str. ATCC 33913
MSVNLKTKEEIELMRVAGRLAAEVLDVVAPHVKPGVTTAELDRICHDHIVNVQGTIPANVGYRGFPKSVCTSVNNVICHGIPSAAKVLKEGDIVNIDVTVIKDGWHGDTSRMYYVGTPSVMAKRLVETTYEAMWRGIRAVKPGATLGDVGHAIQKFAEAERFSVVRDYCGHGIGKVYHDEPQVMHYGRPGEGLVLKPGMTFTIEPMINEGTYHHKTLPDGWTVVTKDRKLSAQWEHMVAVTEDGVDVLTLSPNASAPA

SEQ ID NO: 27990 - protein, 93 aa, Glycine max
RYEDTKAKGKAAIDGVRNPLGKPGGALIHQLMILTLGALANATPYLGGVLLLIAPACLAAAKSLHTQLTALRREEELDKEMERARAERNTREG

SEQ ID NO: 27991 - protein, 545 aa, Solibacter usitatus Ellin6076
MISFSNINKQYGKQLVFVDASFQLNPGEKVGLVGPNGAGKTTLFRMIVGEEAPDDGDVSVPKKLTIGYFRQDVEEMKGRSVLDEAIAGSGRVGDLHHELEDLHRALEDPDRFDEMDRILDRFGHVQEEYEHLGGYALEAQAREVLHGLGLKDDQIDGDVGALSGGWKMRVALARVLLGRPEVMLMDEPTNHLDLESIIWLEQFLKNFQGALLMTSHDREFMNRIVTKIADIDAGEIITYSGNYDFFERERAIRESNQQAAFARQQAMLAKEQRFIDRFRTHAAKAAQVQSRIKALDKIDKIELPKKRHVVKFEFRVPPRSGDQVVVFTDLHKAYGPRVIYEGLNLTIRRGERWAVMGRNGAGKTTLLKMIAGVTEPDSGSVRLGASLTMGYFAQQSLDVLDPDLTIQEQLQKDFPQENIGSLRTLAGAFQFSGDDVDKKIRALSGGEKSRLAMARMLYNPPNFLVLDEPTNHLDLATKELLVEALKDFEGTMIFVSHDRMFLRGLSSRVLELGGESGTDRTPHIYPGSYLEYVQRIGHEAPGIYA

SEQ ID NO: 27992 - protein, 559 aa, Oryza sativa Japonica Group
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRMYVTMDRYENDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRYAGMLQYDGELKLPSHYLVSPPEIERTSGEYLVKNGVRTFACSETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 27993 - protein, 416 aa, Shewanella sp. MR-7
MSLVAIGINHKTATVDLREKVAFSPDKIHDAMKSLASRTRSGEAVIVSTCNRTELYCNNGDEADIIEWLEEYHGLDHQDVAPCLYNYHGQAAVKHLMRVASGLDSLILGEPQILGQVKQAFVKAKEAGTVALTIDRLFQNTFSVAKKVRTETEIGAAAVSVAFAAVSMAKHIFSSLSTTKVLLIGAGETIELVAKHLKDNGVASMVVANRTLERAQSMCEEFNATAITLAQIPDFLPKADIVISSTASPLPILGKGMVEKALKQRRHQPMLLVDIAVPRDIEPEVADLDDAFLYTVDDLHSIIEQNKASRKEAAEQAELITEEQSYLFMDWVRSLESVDSIREYRSQSMAIKDELVERALNKLAQGGDTEQVLIELANRLTNRLIHAPTQALTVASRQGDLNTLGQLRTALGLDKN

SEQ ID NO: 27994 - protein, 396 aa, Wigglesworthia glossinidia endosymbiont of Glossina brevipalpis
MNLHEYQAKKLFNKYEIPIPKGYCIKELDEIEKTISNLSTGPWVIKCQIHAGGRGKSGGIKITNSKKEIHEFAKKWLGNKLITYQTDKNGQKVNYLLIEKKTIIKKELYLSFVINRKKSSIMLISSDSGGVDIENIFKKKSNNIYKEILESCYLIQDFQSRKIAFKLGLQGNQINQFVKICNKLSLLFLENDLTTLEINPIVIDDKNNLICLDGKIIIDDNAIYRNYSLYEEHDNSQLDKREVYAANDNLNYIPLDGNIGCMVNGAGLAMGTMDLIKFHGGNPANFLDVGGNTTVEKVEKAFKIILLDSNVKVILVNIFGGIVRCDLISNGIINSVINLKIKIPIIVRLEGNNSINGIKALKKSNLNIIAANSLNDAVKKAIKNSIGKHNYVDFNR

SEQ ID NO: 27995 - protein, 245 aa, Glycine max
PTRPRTRGFVGTSTFSEYTVLHEGCVAKINPAAPLDKVAVVSCGFCTGFGATVNVAKPKPNNTVAVFGLGAVGLAACEGARVSGASRIIGVDLLTNRFEQAKQFGVTDFVNPKDHNKPVQEVIAEMTNGGVDRAIECTGSIQASISAFECTHDGWGTAVLVSVPKKDAEFKTHPMKFMEGRTLKGTFYGHYRPRTDIPGVVEKYLNKELELDKFITHSVPFSEINTAFDLMLKGEGIRCLICMEE

SEQ ID NO: 27996 - protein, 413 aa, Wigglesworthia glossinidia endosymbiont of Glossina brevipalpis
MNIIDILVPDLPESVTDAVVSNWRKKPGEYVKSGEILVDLETDKVVLEVPSPNSGKIIEIFQKNSSIVVSKQKIASLNINNYDQKKEENKIKEINFSQKEHNYECSENNKEKETKHADDINLSPSIRRSILKHNLNKNDINKNFDIKNNIENELNENNYLTKEKEKNENNIKDSSAYEKSSPRENRIKMTRLRKCIAERLLYSKNTTASLTTFNEVNMKSIHDLRKSYGDIFEKLHGIRLGYMSFFVLAVVKGLKKFPEIHAYIDGDDIVYNNYFDINIAISTERGLVTPILRNVDKMNMSEIEKRIKNLAFLGKNGKLKVEDLQCGSFTITNGGIFGSMMSTPIINPPQSAILGIHAIKDRVISINKKISINPMTYLALSYDHRLIDGKESASFLSNIKDMLENPIRMLLDI

SEQ ID NO: 27997 - protein, 484 aa, Brachymonas petroleovorans
MDAQRTLPDCSKLFLGGRWVEPAQGMYYDNENPAKRETICRVAQASAADVDAAVRGAQQALEPGSPWAQMTPAARARLLWRVAERIREQVEELAWLESLDTGKPYGEALHGDIPHAAGAFEYYAGWCSKLAGSVLPVSPRYLDYTRLEPVGVVGAIIPWNFPLQMAAMKVAPALAAGNAVLLKPAEQTPLTAFALARIFEELEFPPGVLSVLPGFGATGAALVAHPGIDKITFTGSTAVGKTIMRGAADTLKRVSLELGGKSPNIVFADADLKRAVRGATTGIYYNQGQMCTAGSRILVQDSLYDKFLEAFTAAIADLRPGDPLDPKTRMGALVSQEQFERVSHYVALGQEDGATLLAGGQGSAERGYFFPPTIFTDVKPEHRIAQEEIFGPVVSVMRFGSEEEALRLANGVSYGLAAGVWTADVGRAHRVAHGLRAGTVWVNTYNALWNEAPFGGYKQSGIGREGGREGIEPYTEVKNICLSL

SEQ ID NO: 27998 - protein, 490 aa, Mycobacterium bovis AF2122/97
MTRITRANGCPDGTLENAVVALDGGANYPREILGNKGHGIDMMRRHHLPVPPAFCITTEVGVRYLAAPESTIAAIWDDVLDRMSWLETETSCTFGRGPNPLLVSVRSGATQSMPGMMDTILDVGMTDAVERVLARPGAADFAHDTRRRFTSMYRRIVGSAGPITDDPYAQLRASIEAVFASWNSPRAVAYRDHHGLDDQGGTAVVVQAMVFGNLTANSGAGVLSSRNPITGANEPFGEWLPGGQGDDVVSGLVAVAPITALRDQQPAVYDQLMAAARSLERMAGDVQEIEFTVEDSQLWLLQTRGAERSAQAAVRLALQLHHEGLIDDTETLRRVTPTHIETLLRPSLQPETRLAAPLLAKGLPACPGVVSGTAYTEVDEALDAADRGEPVILVRDHTRPEDVMGMLAAQGIVTEVGGAASHAAVVSRELGRVAVVGCGPGVAAALAGKEITVDGYEGEVRQGVLALSAWSESDTPELRELADIAQRISS

SEQ ID NO: 27999 - protein, 259 aa, Triticum aestivum
MPVRVAKLPLPPPFLRRLLLSLSLSLSLAAALATHPPHPKTLEKQRRRRDMAEVEAALPVAATETPEVAAEGDAGAAEAKGPHKLQRQWTFWYDIQTKPKPGAAWGTSLKKGYTFDTVEEFWCLYDQIFRPSKLVGSADFHLFKAGVEPKWEDPECANGGKWTVISSRKANLDTMWLETCMALIGEQFDESQEICGVVASVRQRQDKLSLWTKTASNEAVQVDIGKKWKEVIDYNDKMVYSFHDDSRSQKPSRGGRYTV

SEQ ID NO: 28000 - protein, 167 aa, Triticum aestivum
  misc_feature (166)..(166): Xaa can be any naturally occurring amino acid
TIEQVCTKKQAGTGPEFPGYRRPTRPLLEGTLLKPNMVTPGSDAKKVAPEVIAEYTVRTLQRTVPAAVPAIVFLSGGQSEEEATLNLNAMNKLQTKKPWNLSFSFGRALQQSTLKAWSGKTENEEKARTAFLVRCKANSEATLGTYKGDATLGEGASESLHVKDYXY

SEQ ID NO: 28001 - protein, 519 aa, Vibrio sp. Ex25
MSIQKNASTTSSSTTLDLIVIGGGINGAGIAADAAGRGLSVGLYEASDFASATSSASSKLIHGGLRYLEHYEFRLVSEALAEREVILRKAPHVALPMRFRLPHRPFLRPAWMIRCGLFLYDNLGKRTTLPGSKTVNLAKSGLLKPEMKTGFEYSDCWVDDARLVLLNVLAARENHAEVRNYCRVEKAHREGGIWHVTIHDVMTDQRFERKAKALVNAAGPWVKQFFDDGLEQASPRNIRLIKGSHIVVPRIHNEPQAYILQNKDNRIVFMIPYLDKFSIIGTTDVEYKGDPREVAISDDEVDYLIDIVNQHFVHQLTREDVVWTYSGVRPLCDDESDSPQAITRDYTLELDAEYDHAPLLSVFGGKLTTYRKLGEAAMKKLAPFLPEMGSDWTANQTLPGGNFSCSREQLAKQIHAKYAWAPEALILRYVTQFGTQTWNLMEGTASEADLGHAFSSQAGGVYQREIDYLMNHEMAMTDEDILWRRTKLGLYMNDEEKLALSDYLKEKLQQKVVNLSQVG

SEQ ID NO: 28002 - protein, 171 aa, Mycoplasma genitalium G37
MKTYKIFHMRTRYLIGNWKTNKNLKDAVSFVEQFQQNKLNYNAKIGIAPVYVHLTEIKKIISDSLLLFAQDANFIESGSYTGTVSFTQLQDIGVNNSIIGHSERRKYYNETSAVINQKLFACLKASMQVVLCIGEALGQEISFLKTDLTNCLDTIDKSLIKNLVIAYEPLW

SEQ ID NO: 28003 - protein, 507 aa, Mycoplasma genitalium G37
MHKKVLLAILDGYGISNAIYGNAVQNANTPMLDELINSYPCVLLDASGEAVGLPMGQIGNSEVGHLNIGAGRVVYTGLSLINQHIKDRSFFANKAFLKTIEHVEKNHSKIHLIGLFSNGGVHSHNEHLLALIELFSKHAKVVLHLFGDGRDVAPCSLKQDLEKLMIFLKNYPNVVIGTIGGRYYGMDRDQRWDREMIAYKALLGVSKNKFNDPIGYIETQYQNQITDEFIYPAINANLNSDQFALNNNDGVIFFNFRPDRARQMSHLIFNSNYYNYQPELKRKENLFFVTMMNYEGIVPSEFAFPPQTIKNSLGEVIANNNLKQLRIAETEKYAHVTFFFDGGFEVNLSNETKTLIPSLKVATYDLAPEMSCKAITDALLEKLNNFDFTVLNFANPDMVGHTGNYQACIKALEALDVQIKRIVDFCKANQITMFLTADHGNAEVMIDNNNNPVTKHTINPVPFVCTDKNVNFNQTGILANIAPTILEYLNLSKPKEMTAKSLLKNNN

SEQ ID NO: 28004 - protein, 433 aa, Zea mays
MGNRHLCCLCLLLLLGLASGQVLFQAFNWESWKQSGGWYNLLMGKVDDIASAGVTHVWLPPPSHSVSTQGYMPGRLYDLDASKYGTAAELKSLIAAFHGKGVQVVADIVINHRCADYKDARGIYCIFEGGTPDGRLDWGPHMICRDDTIYSDGTANLDTGADFAAAPDIDHLNDRVQRELTDWLLWLKSSDLGFDAWRLDFAKGYSPEVAKVYVDATAPTFAVAEVWNSMAYDGDNKPEYDQDPHRQALVDWVDRVGGAASPATVFDFTTKGILNAAVEGELWRLIDPQGKAPGVIGWWPAKAVTFVDNHDTGSTQAMWPFPSDKVMQGYAYILTHPGNPCIFYDHFFDWGFKDEIAALVAVRKRNGITPTSELTILEHDGDSYVAEIDGKVIVKIGSRYDVGHLIPAGFEVAAHGNDYAVWEKAGAEQVTRA

SEQ ID NO: 28005 - protein, 166 aa, Mycoplasma genitalium G37
MVIIRTLDIGGDKKLNYFQFPHEDNPFLGYRAIRLTLDKQAVFKTQLRALLRASDYGNLGIMFPMVATLDELVQVKQLLTKVQQEFNETKKFKLGIMIEIPSAALAADCLGKHVDFFSIGSNDLIQYSFAADRMNKNVSYLYQPLNPALLRLIKLVVEGGKLNNVW

SEQ ID NO: 28006 - protein, 111 aa, Oryza sativa Indica Group
MRRRPLPNPKRDAITTTTTIRFSPFGSREAKRAKEPLDPPTAPRPPRRRSRSRMFFSRFDPWPVFFRREWKRCWPFLTGFAVTGAIITKMTAGFTEEDLKNSKFVQAHKKH

SEQ ID NO: 28007 - protein, 397 aa, Physcomitrella patens subsp. patens
MAPLPIVGLIVAAGLAWFLGTDPLEVSMGRGIVEFDPQHVPPPPMHQFKNFPRDTQNKLQKGEVKWQGQFLGPESLTFDSQGRGPYTGVSDGRIVRYNGPQAGWSTFAYTSRNWSEACTPLSLTTPNHALEHVCGRPLGLRFHKGTGELWIADAYLGIMKVGAQGGQAEVVLSEIDGVPMKFVNDLDFDNDGNLYFTDSSTHWQRRQFLLCLMEADDTGRFIKYNPTTKETEILIDKLRFSNGVAVSKDGMFVLVAEGRLGRLLRYWVKGGKAGTYEVFADLPGWPDNVRRNEAGDFWIAFHCPRRKLEMILSRYPLLRTLIIRLPISSKNVYWMLAGKPHGMLMRYGPDGDFKEILEDQEGKVAKMLSEAEEHDGKLYLGSVLLPQIVVYTLENKS

SEQ ID NO: 28008 - protein, 351 aa, Oryza sativa Indica Group
MGAPLAPVHVSAAEPLPHLSIKDTPIETSSAQYILQQYLAASGGQKLLASVRNAYTMGKVRMVATEFETAGRLVKNRNAARCAEPGRFVLWQMAPEMWYIELAVGGSKVHAGCNGKLVWRHTPWLGAHAAKGPVRPLRRALQGLDPLTTASMFAGARCIGERKVNGEDCFILKLCTEPETLKARSEGLAEIIRHVMFGYFSQRTGLLVHIEDSHLTRIQSTTGGDAVYWETTINSFIEDYRPVEGIMIAHSGRSAVTLFRFGEVAMSHTKTRMEEAWSIEEVAFNVPGLSMDCFIPPTDIKSGSISETVELSHGEKSKVGPPPGHRAKVAALEKAVDGKVAWSGTILEDHN

SEQ ID NO: 28009 - protein, 638 aa, Deinococcus radiodurans R1
MLSPADALLRLRAAGLPGIALLESLGPVLPYARFTFLSAAPTCVQHTLPELPAPDAFFPAWLGGLKYEAAREFGLAAHPASGPAQWWGFYPSGLVWDREAGTLSVVGEPHLDWAALLASDPAPLPSLTVGDFGADDVDYPAGVRAVQELIRAGEVYQVNLSRGVSAPAQGDPLAAYLRLREVNPSPFMAFLDMGNEVVVSCSPERLVDWAVSEGGGISARPIAGTRRRGDTPEEDAAFEAELRASPKEVAEHTMLVDLVRHDLGAVAAPGTVSVPDLMLVERYSHVMHLVSEVTATARAGLTLPDLLAATFPGGTITGAPKARVMDAIAALEPGPRGWYTGGAGLVSGRRVDVNILIRTAEFVLDTAAGSPATPPRWTVTVRAGGGTVIDADPAREARETVHKAQALLSVLAGVPGRPAQAGQPPVPGRPWTPPPVPKQAQTPLRVLVLDNRDSFTWNLAHDLLALGAMVDVRSQDEDAETLLASRPDAVLVGPGPGTPQTSGCTLALTRRCLERGVPLLGVCLGHQALGEVLGGRVERAEPVHGRPERVQHGGAGLFAGIENGAAFGRYHSLVVRGLPDELVTARSEGGEIMALAVPGKPAWGVQFHPESVLSPAGRVLLGNWLRAVAGSAALRGEG

SEQ ID NO: 28010 - protein, 224 aa, Salmonella enterica subsp. arizonae serovar 62:z4,z23:--
MTAALWQNSEIQANRRRHRRRQHNLETYMQLKRVAEAKLPTPLGDFLMVGFEELATGHDHAALVFGDISGKTPVLARVHSECLTGDALFSLRCDCGFQLEAALTHIAEEGRGILIYHRQEGRNIGLLNKIRAYALQDQGYDTVEANHQLGFAADERDFTLCADMFKLLGVDEVRLLTNNPKKVEILTEAGINIVERVPLIVGRNPNNEHYLDTKAAKMGHLLSK

SEQ ID NO: 28011 - protein, 357 aa, Dioscorea gracillima
LKQKIDRMYNGEKINCTENRSVLHIALRAARDKVIESDGKNVVPDVWHVLDKIKEFSEIIRSGSWVGATGKALTDVVAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGIPLPFETGEIDFGEPGTNGQHSFYQLIHQGRVIPCDFIGVMRSQQPIYLKGEVVSNHDEL

SEQ ID NO: 28012 - protein, 369 aa, Brachymonas petroleovorans
MAKTGRIALFESPHQPFTFREMPVPDPKPGAAVVRVTMANICGSDLHAWHGDFKLAGLGGKLPTVLGHEMTGQIVALGEGKHTDGNGQPLHEGDHVVYTYFTGCGHCPMCLRGHRVSCDELTMAMTEPALEWPYFVGGYADYYYVKPGATIYKVPQGLPDEVVAGANCALSQVISGWERAQLTFDETVLIQGAGGLGLYACAVAKAFGARLVIAIDAVQQRLDMARRFGADATINLTELPDEKARVNLVKKLTDGRGVDVVMELVGRADVVPEGLRMLGQFGRYVTIGNINAGQTYAADPSRLVMSNKSMLGVSLYEPPTLGKALRFLERHRDTLPFAEMLSTRFPLEQINEAFAKADAREVVRASIVP

SEQ ID NO: 28013 - protein, 63 aa, Brassica napus
  misc_feature (13)..(13): Xaa can be any naturally occurring amino acid
MIKPVKIRDCVKXLDSDNNDNRDLLHLNIDLSKKVNWLCTNQSDSENLVVCDTTRVVKVYSIS

SEQ ID NO: 28014 - protein, 75 aa, Glycine max
AQKVHSYFRKWVHHNLSAKVAASLKIIYGGFVNGGNSKKLAPHPHVNGFLVGGAPPKPEFVDIINAAPVKKNLNL

SEQ ID NO: 28015 - protein, 860 aa, Cryptococcus neoformans var. neoformans JEC21
MTTDQLHERDVFPRPSHHDIQSTWEKLFSDPLISLTRLKSRSLDKAGLGPAGPDGGVILRSVYWRFYHSLLPPPTSLDLFPQALEASRESYNALRRRYLIAPDGRWASDCSGFDESLSPTSPTHRTSPRIASPVHDSPLQPSDGWDPLSLSTSSPWKTWFAHTELRATIRQDVERTFPDMPYFQLERVQRCMTTALFIFAVLNPDVGYRQGMHELFACCFMAVDRDSLKVVNKADGQQKEAMIKTLDRRYVEHDAFELFLAIMKNAKAFYEWRAEEGPIVSIPLQPINPIDTFDCQRSRTATAPQAPIIVRCNNLHTSLLRRIDPQLYERLETEGVEAQIWAIRWIRLIFTRELPFNVAMRLWDGIFAEDPGLQLLDHICIAMLLLVRNELIDADYPSLLTNLLHYPAPSSAYPFEPFLILAQALFLRSDTSPAAGVEIVIQNQDLLDVKAAPKNQEMDVNGPRSHNSRFADGRGNGRTMSGTVKERLQKGGMGGLAQGLFERAQAAGLDKAFISTVNDFRKNLPDSTTAYSYLPNLPFSPSHSPGPRTSSPFSAIPNSASALPSRSFLSHSPSTTNSIPPSRPALQSRSSTDSHASQISVKTIKDAEREMAELRLAMLGMGKAMSEWLDVLNNPEQHLEKSERENAWKGLERVKETLIDAAGKEVDEIVKEWGWHEGLEASSSRSSTPAPSIMVPPLEAPVTEPEPSPATVVAASGPSNIEFEEATPTPLSVAVMPTTPRFLSASRHSVSPASQDNSSATSGGEKRSLTQTVRGDGPISGLPRVPHTAPINSESTKYRPEEAGRPASAGLGIISVDEEEHSKDQLPANVDPLAGLGTKVRNSRRQAGAGVDPLLGMDIQ

SEQ ID NO: 28016 - protein, 134 aa, Glycine max
RFYPLFPLNPNVALMNSFQTFKYFSNPKQNLRPQIHNQPISLKPLMIIIMRMSNTICFLYWSINNYLPLTTRNKKNNDKPKILTMQNFKFLESSKYIRYLATLLVAYGISINLFDVTFKSKLKSQFPKPNKYSS

SEQ ID NO: 28017 - protein, 544 aa, Cryptococcus neoformans var. neoformans JEC21
MATEEIHSLYDTILILDFGSQYSHLITRRCRELNVYCEMLPCTQKISDLSWKPKGVILSGSPYSVYAPDAPHVDPEVFTLGVPILGICYGLQEIARVHGGTVDAHTHREYGYAKIEVVKTGKKEQDALFEGIEMEADGGLQVWMSHGDQLTSLPPNFVTIASTPTSPYTAVAHESKPIYGVQFHPEVSHSPKGKEVIAAFVKNVCSVRDGWSMESFIPKEIARIRQICGEKGQVIGAVSGGVDSTVAAKLMHEAIGDRFHAIMVDNGVLRKDEAKKVHKMLTVDLGVNLTVVDASELFLARLKGVEDPERKRKIIGNTFIEVFEAEAAKLEAAAEKELAEKGGEAKGKIEWLLQGTLYPDVIESISFKGPSATIKTHHNVGGLLEDMKLKLIEPLRELFKDEVRALGRLLNIPEHLVGRHPFPGPGLAIRILGEVTREQIAILQHADDIYIEEVRAAGLYDQISQAFVALLPVKAVGVAGDARTYDQVVAVRAVSTEDFMTADWFVFPPQVLKRISSRITNEVKGVNRVVYDITSKPPGTVEWL

SEQ ID NO: 28018 - protein, 2431 aa, Cochliobolus heterostrophus
MNRPIAIIGIAFRGPGDARDPEAFYRMLIEGRSARTEIPKDRYNVDAFYHPDPERLGSIQQRYAHFLQQDFKAFDAPFFSITPKEAKAMDPTHRILLEAAYEGFENAGLTLDQVSGTQTSCYIGTFTADFPNLQARDNEGPSIYHATGMSSSLASNRLSWFYNLRGPSLTIDTACSSSLTAFHLACQSLRTGESEMSVVGGANLMFGPDMSILLGAAKILSPEGKSKMWDANADGFARGEGFGVTILKPLDTALRDGDTIRAVVLATATNEDGHTPGISLPNSEAQQDLIRRAYQMAGVDPAETGYVEAHGTGTMAGDPLEAKAILKTVGSVEGRKSSLYVGSVKTNIGHLEGAAGVAGVIKAALAVERGLIPQNLWFEKLNPEINLPENVEIPLKLTPWPSDGPRRASINSFGFGGANAHVILEDTASFLSRHGLKGRHATAPHPCVTEIGGGYSNSTSSRSSSSIADETSSSDSSDAASDLSSEILHDLQPTPKLFTISANDQEGVRRNVERLQRYLSAKTSATPAFLSDLAFTLSAKRSLLPWKSYVVSSKVSELQERLSSLAPVVRSSSSAIPRIAFVFTGQGAQWHAMGKGLSIHAAYFESMQRSEALLRSFGCPWSLNEELSQTETECKLRETDYSQPACTAIQIALVDLLRDFGVTPVAVVGHSSGEIAAAYAAGFIDQEAAIKIAWLRGQVSKTVPTNGGMLAVSASAESVQTYIDGLKNGRAVVGCFNSTKACTISGDASAISELKSILKDAQISCTRLPMDIAYHSCHMEAAREAYESALEGIVHGSTSTIPMFSSVSGALVTPEMMKPSYWVENLVSPVDFVTATKCLLNHPLESKSRKAFASVFVELGPHSALRNYLLDIFSSEKIAADLTYATVLRRNFEGATTALEAMGHLWSQGYPVDLNKINSLEPENANMLVDLPPYVWNHKPYWCESQLSRQYRLRQSPRTDLLGYRLPGTPEYTWRNFLRCNENPWIREHKVQGDILYPGAGMLVMAIEAAHQVAQETSVDEVHGFELRDVSIDTALRVPDTEMGIEVMTQLHNRRTGTRAAPSSALYEFTISSWNKEMSCWSAHARGLISITYKTFSTAMEHELALENGRCMTSMIEARKACQKPARSFLYDTVETIGMQYGPTFRNMIELYVGLNASYGVIKVPDTKAIMPKGYEFPHVIHPATLDSVLHLLFPSISGKEQSLSEAVVPRSFERIFISANTPKMPSTELHGCSTAKKLSYTTWTADIIMSESSMVEPTIIMEGVVLASVGSAENVSKRLETRASCFAQNWYVDADLLTPCQIKETIYKRTLKSKDDDLVLDLLEFVCLVYIHRILDWFESEEGKIHEPQDGFWKLYVDWMHEQVKQFPPLPADVEGEMQRARQRIGRSESGDITVQMVDRIGQNLSRIFTHEVEALQCMTEGDLLYAFYRGAFGTSFNTNVAEYVGLLADKRPGLRILEIGAGTGGTTYHVLERLRNPDGSSKATQYHFTDISPGFLAKAADRFDKDASIMQFGTLNIENNPTEQGFSPESFDLIVCANVLHATKSIQETLAHCKSLLKPGGHLVLSEVTIKRIFSGFIMGPLPGWWLGEADGRKGGPLLDAKEWNVALKSAGFSGVDVDVRGDRDTSKEPVSLIISTKPETSIVTLPPCLIISTGTQASQKLANHMREAFSLAGHEVDIAQWKGITKTSVAGKYCLCLAEWEIPVLANLTNEDWDRVREIVLSSEGALWVTGGGALDTTHPLKSLMVGLARAIRNENAGVRLVCLDLEAPSTIDFEKASRITLKVAEAHIRGDGTEGEFAARDETAFIPRVERTLEMDASLRKYEAKGDPEMVSFVGCGRPLKLTIKTPGLLDTFQWEEDEIYHTPMPNDWIEIEVKAVGLNFKDVLVALGNLAENKLGVDASGVITRVGSAVTDLKVGDKVMTASCDTFATYVRFPAKGAIPVPSDMSFEEAASMPLIFLTAYYALVTAGGITAGETILIHAAAGGVGQAAIMIAQAKGAEVFATVGADSKKQLLMEQYGIREDRIFSSRDTSFVKAVLRATNGRGVDLVLNSLAGEALRLSWTDCLAKFGRFLEIGKADLFANTGLDMKPLLDNKSYIGVNLLEFENNPTPRAVALWHDTAKLIQDKSIKPILPLQMFTMSEVEKAFRHMQAGKHMGKVVVRVDEADVVRAVPRIPRIRIHPVGTYIIAGLGGITREIARWLAEKGAQHLVFLSRSAASGPDNQAFTLQLRDMFNVNILAYDCDVANKAALQGVLDDLKAKGLPPIRGCATGAMVLQDTLFDKMTADNVRKTVGPKVHGTWNLHELLPRDMDFFVMLSSLAGVMGHRGQGNYGCGNNFQDEFAAFRRGQGLPAMTIDIGYLLSVGFVAEHDEYVDHVKAMGLKVMQTSDLHGLLPTAIEGPSKHPGQVMCGLPFNEHDDAWYWICDA

SEQ ID NO: 28019 - protein, 125 aa, Triticum aestivum
  misc_feature (73)..(73): Xaa can be any naturally occurring amino acid
  misc_feature (79)..(79): Xaa can be any naturally occurring amino acid
MAMRALYNEIRAMKVREVPAYLKPRLTWANVKKSTDQAVDRYIEKYIETSSADPLFHICFGGMASPYSVGLPXERRHLXNSENTAALIGFRFQETYLRLIQDFSFFFMGTWIDHGYFVSGRNNDV

SEQ ID NO: 28020 - protein, 157 aa, Pseudomonas aeruginosa UCBPP-PA14
MRIGHGYDVHRFGEGDFITLGGVRIPHKHGLVAHSDGDVLLHALSDALLGAAALGDIGKHFPDTDPRFKGADSRALLRHVVAIVAEKGWKVGNVDATIVAQAPKMAPHIETMRGSIAEDLGVAVDQVNVKATTTERLGFTGREEGIAVHAVALLMAR

SEQ ID NO: 28021 - protein, 459 aa, Aspergillus oryzae
MIESVVSVAFYISTAVTLFILLLPSQYAPKRSTAQDASTDPKTTVQILVLGDIGRSPRMQYHALSIAKGGGQVEIIGYHESEVHPDISSDPRISIVALPPHPAYLQTSNKLLFLVFGPLKVLFQVACLWWSLAYRTRPVKWLLVQNPPSIPTLAVASLTCFLRQTSLIIDWHNFGYSILALKLGNGHPLVKLSKWYEKTFGRYATAHLCVTTVMASVLKKEFLLEAPILPLHDRPANHFRPILDDNVRQEFLLSLPVAASVQSLINSGALRVLVSSTSWTADEDFSLLIDALCRYSQLAATTMPELPQVLAIITGKGPQKEMYIKQIADLEKAGKLQKVTVRTAWLTTTDYAKLLASASLGVSLHTSSSGVDLPMKVVDMFGAGLPVVGWNRFEAWPELVTEGVNGRGFGSSNELVEELVDLFGDTSKLDRLRVGAQKESTRRWDDEWNPVAGKLLGLI

SEQ ID NO: 28022 - protein, 370 aa, Pseudomonas aeruginosa UCBPP-PA14
MIKSRAAVAFAPNKPLEIVEVDVAPPQKGEVLVRIVATGVCHTDAYTLSGQDSEGVFPCILGHEGGGIVEAVGEGVTSLQVGDHVIPLYTAECGKCKFCLSGKTNLCQAVRATQGKGLMPDGTSRFSYKGEPVFHYMGCSTFSEYTVLPEISLAKIPKDAPLDKVCLLGCGVTTGIGAVLNTAKVEEGATVAIFGLGGIGLAAIIGAKMAKAARIIAVDINPGKFDIARELGATDFINPKDYDKPIQDVIVELTDGGVDYSFECVGNVQLMRAALECCHKGWGESVIIGVAGAGQEISTRPFQLVTGRVWRGSAFGGVRGRSELPSYVEKAQKGEIPLDTFITHTMGLEDINEAFELMHEGKSIRTVIHY

SEQ ID NO: 28023 - protein, 455 aa, Bifidobacterium longum NCC2705
MAVTHTAADATAATTMTNAVADIEQETPEIEKERQLAGVGAGAGTVANGKKKPHDHALASILGPAFVAAVAYVDPGNVAANITSGARYGYLLVWVLVLANAMSVLIQYQSAKLGIVTNKSLPELLGERMSDAGRFMFFMQAEVIAIATDLAEVIGGAIALNLLFGLPLFIGGLVIGAISTVMLWFQGGKTQTTFERIIIVMLLIITFGFIAGLFVDPPSPGEVVKGMIPRFQGTDSVLMAASILGATVMPHAIYLHSTLVNDHYAGGEKPSIKTQLKGSKIDVVWALLLAGTVNLAMLVLAANSLHGMSGTDSIDGAQRAITQVLGPVIGTIFSIGLLASSLSSTSVGTYAGSEIMHGLLHVNAPMWACRVVTLVPALIVLWFAKDPTQALVIGQVVLSIGIPFAVIPLMRYTHDKELMGKWADGTVKHVIFMIVVALIVALNVLLIVLTLMGRA

SEQ ID NO: 28024 - protein, 591 aa, Zea mays
HPQSAPACLHDLSCSCATLLECGAGARGHLMAAAAEIGGFTAAALRPLAHPAPAAAPRRAVAAQSLRTTATETLTADLAASTANGAVHAQMYSEASSEIPSQAAIANSRRKTKIVCTIGPSTNTREMIWKLAETGMNVARLNMSHGDHQSHQKVINLVKEYNAQNTDGNVIAIMLDTKGPEVRSGDVPEPIMLSEGQEFNFTIKRGVSTEDTVSVNYDDFINDVEAGDILLVDGGMMSLAVKSKTADTVKCEVVDGGELKSRRHLNVRGKSATLPSITEKDWEDIKFGVENGVDFYAVSFVKDAKVIHELKDYLKGVNADIHVIPKIESADSIPNLQSIIAASDGAMVARGDLGAELPIEDVPLLQAEIVQTCRNMEKPVIVATNMLESMIDHPTPTRAEVSDIAIAVREGADAIMLSGETAHGKYPLKAVKVMHTVALRTESSIYNPTTSPSVIASAQGLQNEEFSPSQLSKMFGSHATMMANTLRTPIIVFTQTGSMAVLLSHYRPSSTIFAFTNEERVKLRLALYQGVIPIHMEFSDDAEETFSRAISSLLKAQYVKKGDYVTLVQSGVTSIWREESTHNIQVRRAQV

SEQ ID NO: 28025 - protein, 289 aa, Bifidobacterium longum NCC2705
MTNGHINPANVPDIALKDGHSIPQVGLGVLRIDDEGVVPVVESALEAGYRHIDGAAGYNNEAGVGRALAASGYNKGAKRETLWVTTKLRDSQQGYDSALKAFDNSLKLLQLDYVDMYMIHWPTPFDWRSTDTWKAFVKLRDEGMARTLGVCNFMPADLKRLHEETGAWPAVNQIELHPTWQQREVVAFCKEHGIAVEAYSPMARGADLNAGDGTIEKIAAAHEVSPAQVILRWHIENGTIIIPKSVHADRQKENLNLFGFALTADEHAAIDALDGPTRAGHDPLTFTYA

SEQ ID NO: 28026 - protein, 519 aa, Orobanche ramosa
MTEQLGAAAKFRRSGGSPTKALINKPKKNMYALLISVMASMTSILLGYDTGVMSGATLYIKKDLKITDVQVEILVGLINIYSLIGSAVAGRTSDYLGRRITIVIASVIFFVGAAVMGLANNYAVLMVGRFVAGLGVGYALMIAPVYAAEVAPASSRGFLTSFPEVFINFGVLLGYLSNYAFAKFSLKLGWRLMLGVGALPAIFIGLAVIVMPESPRWLVMQGRLGDAKKVLDRTSDSPQEAQLRLADIMEAAGLPEDCHDDVVPVLKQDRGGGGVWKELIVHPTKPVLHITIAAVGCQFFQQASGIDAVVMYSPRIYEKAGITSDEKKLLATIAVGLCKTVFILVTTFMVDRIGRRVLLLTSCGGLVLSMLTLATGLTVIDHYGADRFPWVVVLCVLTTYSSVAFFSMGMGPIAWVYSSEIFPLKLRAQGCGLGVAINRATNGVILMSFISLYNAITIGGAFYLFSGIGIVTWIFFFTLLPETRGRTLEDMEVLFGTFFKWRTTMRELHKKEAEDALYA

SEQ ID NO: 28027 - protein, 569 aa, Oryza sativa Indica Group
MAGGGGGGGEADAAGERAAGAGLGSRSAAEERSLLHPSLFSAYSDEDLVERAFEPAQKIVVSISSDPDDPDADDEHLYYGGHAPPFSWRKLWLFTGPGFLMSIAFLDPGNLEGDLQAGATAGDTLLWLLFWATAMGLLVQLLAARLGVATGKHLAELCRDEYPDWARRALWLMAEVSMVSADIQEVIGSAIAIKILSNGFLPIWVGVVITALDCFFFLSLENYGVRKLEAVFAVLIATMAWSFAWMFIKTKPNGKDIIIGILVPRLSSRVISQAVGLVGCVITPHNVFLHSALVQSRKIDPHKEYQVREALRYYTIESTMALVVPFMINLFVTTVFAKGFYGTKEAGNIGLENAGHFLQEKFGEDFFPILYIWGIGLLAAGTSSTITGTYAGQFIMSGFLNWRLKKWIRALITRSFAIVPTITVAVYFNTSDSALDVLNEWLNVLQSIQIPFALIPLITLVSKEQVMGVFKIGPRTQIHMYVEHSEFCHLDADCNLGSRIRADNNQWLPLVGFLLFRSERPIVRLSSLRSSACLCLVPTVSHLPGYCRIFIAQTYQQFDMTKKRTYMTR

SEQ ID NO: 28028 - protein, 346 aa, Prochlorococcus marinus str. NATL1A
MFGLIGHSTSFEDAKRKALGLGYDHIAEGDLDVWCTAPPQLVENVKVVSAIGKTIEGAYIDSCFVPEMLSRFKTARRKVLNAMELAQKKGISITALGGFTSIIFENFNLLQNQQVRNTTLDWQRFTTGNTHTAWVICRQLEQNAPRIGIDLSKSKVAVVGATGDIGSAVCRWLSNRTGVSELLLVARQQKPLLELQSQLGGGRILSLDDALPEADIVIWVASMPKTLEIDPSKIKRPCLMIDGGYPKNLGEKFSGPGIHVLKGGIVQFFKDIGWSMMELAEMENPKREMFACFAEAMLLEFENCHTNFSWGRNNITLEKMDFIGKASERHGFSAVGLKSNIQTLTV

SEQ ID NO: 28029 - protein, 466 aa, Thermosynechococcus elongatus BP-1
MSLWRPTAILLASDLPLIPPTRLRAMTLPTFVDLNLDPFWMPFTANRQFKQSPRLLVSAAGMYYRSIDGREILDGTAGLWCVNAGHCRPEIISAIAQQAATLDFAPTFQMGHPGPFQVADRLRRITPDPLNHVFFANSGSEAVDTALKIALAYHRLRGEGTRQRLIGRERGYHGVGFGGISVGGIAPNRKFFGSLLAGVDHLPHTHNLEHNAFSKGQPTWGAHLADELERLVALHDASTIAAVIVEPLAGSTGVLIPPQGYLERLRAICDRYGILLIFDEVITGFGRLGAPFASQYFGVTPDLITVAKGLTNAAVPMGAVIVRDEIYETFMQGPAGQIEFFHGYTYSGHPLACAAALATLEIYEKEALFERAASLAPYWQEAIHSLRGLPHVIDIRNLGLVAGIELAPREGQGGPRGYDALCRAFEAGLLIRVTGDIIALSPPLIVERSHIDQMVDILSRVLQELP

SEQ ID NO: 28030 - protein, 520 aa, Trametes sp. I-62
MAKLQFSNFFVTLAVVTGALAAVGPKADLTITNAVVAPDGFSRDAVVVNGVFPGPLITGKKGDRFQLNVIDNLTNHTMLKSTSIHWHGFFQAGTNWADGPAFVNQCPISTGHAFLYDFHVPDQAGTFWYHSHLSTQYCDGLRGPIVVYDPLDPHAFRYDVDDESTVITLSDWYHTAARLGPRFPLGADATLINGLGRSSSTPTANVTVINVQHGKRYRFRLVSLSCDPNHTFSIDGHNLTVIEVDGVNSKPLTVDSIQIFAAQRYSFVLNANQTVGNYWIRANPNFGTTGFAGGINSAILRYQGAPIIEPTTVQTTSVIPLVETNLHPLVPTIVPGLPVSGGVDKAINLAFNFNGTNFFINNATFTPPTVPVLLQILSGASTAQDLLPPGSVYPLPAHSSIEITLPATTLAPGAPHPFHLHGHVFAVVRSAGSTAYNYVDPIFRDVVSTGTPAAGDNVTIRFHTDNPGPWFLHCHIDFHLEAGFAIVFAEDVADVKAANPVPKAWSDLCPTYDALAEGDL

SEQ ID NO: 28031 - protein, 357 aa, Dioscorea nipponica
LKQKIDRMYNGEKINSTENRSVLHIALRAARDKVIESDGKNVVPDVWHVLDKIKEFSDRIRSGSWVGATGKALTDVMAVGIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSIPFEKNIPVLLGLLSVWNVSFLGYPARAILPYSQALEKFGPHIQQVSMESNGKGVSIDGIPLPFEAGEIDFGEPGPNGQHSFYQLIHQGRVIPCDFIGVMRSQQPIYLKGEVVSNHDEL

SEQ ID NO: 28032 - protein, 477 aa, Helianthus tuberosus
HEWVLGVGKPKNLPPGPTRLPIIGNLHLLGALPHQSLAKLAKIHGPIMSLQLGQITTLVISSATAAEEVLKKQDLAFSTRNVPDAVRAYNHERHSISFLHVCTEWRTLRRIVSSNIFSNSSLEAKQHLRSKKVEELIAYCRKAALSNENVHIGRAAFRTSLNLLSNTIFSKDLTDPYEDSASGKEFREVITNIMVDSAKTNLVDVFPVLKRIDPQGIKRGMARHFSKVLGIFDQLIEERMRTGRFEQGDVLDVCLKMMQDNPNEFNHTNIKALFLDLFVAGTDTTSITIEWAMTELLRKPHIMSKAKEELEKVIGKGSIVKEDDVLRLPYLSCIVKEVLRLHPPSPLLLPRKVVTQVELSGYTIPAGTLVFVNAWAIGRDPTVWDDSLEFKPQRFLESRLDVRGHDFDLIPFGAGRRICPGIPLATRMVPIMLGSLLNNFDWKIDTKVPYDVLDMTEKNGTTISKAKPLCVVPIPLN

SEQ ID NO: 28033 - protein, 338 aa, Bradyrhizobium japonicum USDA 110
MLATLMYGPGDVRCEQVDDPRILKPTDAIIKLSATCICGSDLWPYRGLQPIDGRAHMGHEYCGVVVEVGREVTTVRPGQFVVGSFCISDNTCPHCRFGFHSSCVQREFMSGAQAPYARVPLADGTLVATAELPSPDLIPDLLATSDVLGTGWYAADAANVREGSTVVVVGDGAVGLMGVLSAKAMGAERIIAMSRHETRQRLAIEFGATDIVAERGEAGIARIKELTRGVGADSVLECVGMQESMTQAIECTRPGGSIGYVGVPHGVTFDGQAMFFAQRRMLGGPAPVRRFLPDLIDRVLAGKIKPGKVFDLKLPLADVAEGYRAMDERRAIKTMITV

SEQ ID NO: 28034 - protein, 520 aa, Trametes sp. I-62
MAKLQFSNLFVTLAVVTGALAAVGPKADLTITNAVVAPDGFSRDAVVVNGVFPGPLITGKKGDRFQLNVIDNLTNHTMLKSTSIHWHGFFQAGTNWADGPAFVNQCPISTGHAFLYDFHVPDQAGTFWYHSHLSTQYCDGLRGPIVVYDPLDPHAFRYDVDDESTVITLSDWYHTAARLGPRFPLGADATLINGLGRSSSTPTANVTVINVQHGKRYRFRLVSLSCDPNHTFSIDGHNLTVIEVDGVNSKPLTVDSIQIFAAQRYSFVLNANQTVGNYWIRANPNFGTTGFAGGINSAILRYQGAPIVEPTTVQTTSVIPLVETNLHPLVPTIVPGLPVSGGVDKAINLAFNFNGTNFFINNATFTPPTVPVLLQILSGASTAQDLLPPGSVYPLPAHSSIEITLPATTLAPGAPHPFHLHGHVFAVVRSAGSTAYNYVDPIFRDVVSTGTPAAGDNVTIRFHTDNPGPWFLHCHIDFHLEAGFAIVFAEDVADVKAANPVPKAWSDLCPTYDALAEGDL

SEQ ID NO: 28035 - protein, 357 aa, Dioscorea quinquelobata
LKQKIDRMYNGEKINCTENRSVLHIALRAARDKVIESDGKNVVPDVWHVLDKIKEFSERIRSGSWVGATGKALTDVVAVDIGGSFLGPLFVHTALQTDPEAAECAKGRQLRFLANVDPIDVARSIAGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLKGAASIDDHFHSTPFEKNIPVLLGLLSVWNVSFLGYPARAILPYSQALEKFAPHIQQVSMESNGKGVSIDGIPLPFETGEIDFGEPGTNGQHSFYQLIHQGRVIPCDFIGVMRSQQPIYLKGEVVSNHDEL

SEQ ID NO: 28036 - protein, 314 aa, Nostoc sp. PCC 7120
NGFGRIGRLVLRAGINNPNIEFVGINDLVPPDNLAYLLKYDSTHGRLRSQVETKDDGIVIDGHFIPCVSVRNPAELPWGKLGADYVVESTGLFTDSEGASKHLQAGARRVIISAPTKDPDRVRTLLVGVNHDLFDPSKDLIVSNASCTTNCLAPIAKVINDNFGLTEGLMTTVHAMTATQPTVDGPSKKDWRGGRGAAQNIIPSSTGAAKAVALVLPELKGKLTGMAFRVPTPDVSVVDLTFKTAKATSYKEICAAMKQASEGSLAGILGYTDEEVVSTDFQGDTHSSIFDAGAGIELNSNFFKVVAWYDNEWG

SEQ ID NO: 28037 - protein, 357 aa, Dioscorea septemloba
LKQKIDRMYNGEKINCTENRSVLHIALRAARDKVIESDGKNVVPDVWHVLDKIKEFSERIRSGSWVGATGKALTDVVAVGIGGSFLGPLFVHTALQTDPEAAECAKGRQLRFLANVDPIDVARSITGLNPETTLVVVVSKTFTTAETMLNARTLREWISGALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLGYPARAILPYSQALEKFAPHIQQVSMESNGKGVSIDGFPLPFETGEIDFGEPGTNGQHSFYQLIHQGRVIPCDFIGVMRSQQPIYLKGEVVSNHDEL

SEQ ID NO: 28038 - protein, 464 aa, Magnaporthe grisea 70-15
MAFRFVAHRIPANLALRSGSPIRFYSQAAAAFAAKANETQQASKLSNPDPAEDSASAALVREHAPFMVATYSRPSPVFVRAKGSYLWDMEERRYLDFTAGIAVTGLGHCDPQVSDILAEQGSTLMHTSNLYYNPWTLALSKALVEKTVASGGMHDAKSVFVCNSGSEANEAAIKFARKVGKVVDPSGNKTEIVSFANAFHGRTMGSLSATHNPKYQEPFAPMVPGFKCGTYNDIAAIPDLVTEKTCGVIVEPIQGEGGVQVATDDFMVALAKRCREVGALLIHDEIQCGMARTGSLWAHGRLPKEAHPDMVTTAKALGNGFPIGAIIVNGHVTEKIKVGDHGTTYGGNPLACRLAHHVLERLSNPKLHESVMGKGAVLARGLAQLRQKHSELISEIRGRGLILGLQLTQDPAPIVAAARERGLLIITAGHNTIRFVPSLLISESEIQQGLSILDEAIVASKQAS

SEQ ID NO: 28039 - protein, 357 aa, Dioscorea tenuipes
LKQKIDRMYNGEKINCTENRSVLHIALRAARDKVIKSDGKNVVPDVWHVLDKIKEFSERIRSGSWVGATGKALTDVVAVGIGGSFLGPLFVHTALQTDPEAAECAKGRQLRFLANVDPIDVARSIAGLNPETTLVVVVSKTFTTAETMLNARTLREWISAALGPQAVAKHMVAVSTNLTLVEKFGIDPANAFAFWDWVGGRYSVCSAVGVLPLSLQYGFSVVHKFLNGAASIDDHFHSTPFEKNIPVLLGLLSVWNVSFLRYPARAILPYSQALEKFAPHIQQVSMESNGKGVSIDGVPLPFETGEIDFGEPGTNGQHSFYQLIHQGRVIPCDFIGIMRSQQPIYLKGEVVSNHDEL

SEQ ID NO: 28040 - protein, 196 aa, Glycine max
LNFYLTFKVGGKCFTFTKCQYCISCNVVQGAVRVMAKDLVRTRHQVEKFYKLKSQLQGVSLRIQTLKSTQAMGEAMKGVTKAMGQMNRQMNLPSLQKIMQEFERQNEKMELTSEMMGDAIDDALEGEEDEEETEDLVNQVLDEIGIDINQELVNAPSSAVAAPAAKTKVPQVETTGNDDGGIDSDLQARLDNLRKM

SEQ ID NO: 28041 - protein, 304 aa, Triticum aestivum
  misc_feature (242)..(242): Xaa can be any naturally occurring amino acid
MEEVVPASANSQASTGDAAADQPINVYVWDLDETLILLKSLLDGSFAGHFEGLKDHEKGTEIGKRWENIILELCDEHFFYEEIENYNQPYLSSLHEYDDGKDLTKYDFEADCFSSPFDDVNKRKLAYRHRAIGDKYAKGLQKILDHRMFKVWSDLYSSTDKYTDGWLSSAHKLLEEALCKSTAEPAIKSSSINCIVTSGSLVPSIAKCLLYRLDDVVSSDNVYSSWESGKLQCFKWIKERHXAPNVRFCAVGDGPEERSAASIMKWPFVKIEIRPDAPHRFPGLSLSTIHSIMDAVYQSSSKDG

SEQ ID NO: 28042 - protein, 421 aa, Halomonas elongata
MQTQILERMESDVRTYSRSFPVVFTKARNARLTDEEGREYIDFLAGAGTLNYGHNNPHLKQALLDYIDSDGIVHGLDFWTAAKRDYLETLEEVILKPRGLDYKVHLPGPTGTNAVEAAIRLARVAKGRHNIVSFTNGFHGVTMGALATTGNRKFREATGGVPTQAASFMPFDGYLGSSTDTLDYFEKLLGDKSGGLDVPAAVIVETVQGEGGINVAGLEWLKRLESICRANDILLIIDDIQAGCGRTGKFFSFEHAGITPDIVTNSKSLSGYGLPFAHVLMRPELDKWKPGQYNGTFRGFNLAFATAAAAMRKYWSDDTFERDVQRKARIVEERFGKIAAWLSENGIEASERGRGLMRGIDVGSGDIADKITHQAFENGLIIETSGQDGEVVKCLCPLTIPDEDLVEGLDILETSTKQAFS

SEQ ID NO: 28043 - protein, 536 aa, Psychrobacter arcticus 273-4
MDTLFMTTVTATPAIKEDRILILDFGSQYSQLIARRVRDSGVFCEMFPYDIDTQRITDFGAKGIILSGGPESVHAENSPRINDAVFELGVPVLGICYGMQAMAERFGGKVHASDIHEFGAATINIDGKSTLTNGIEDAAAKLNVWMSHGDKVVDAPQGFDIVASTPSCPIAIMADDSRHYYGLQFHPEVTHTAQGQALLGRFVHEICDCAGSWTPDNIIDMRIEQLKKQIGDKQVLLGLSGGVDSSVVAALLHKAIGDQLTCVFVDTGLLRLHEGDQVMQIFAENMGVKVIRVDAEELFLTALAGESDPEAKRKIIGKTFIDVFANSAREISEQSDGKVIEFLAQGTIYPDVIESAKSHQGKAHVIKSHHNVGGLPDDLAFELVEPLRDLFKDEVRKLGITLGLPAKMINRHPFPGPGLGVRILGEVTKEFADILRSADAIFMEELEKSGWYEKTAQAFAVFQPIKSVGVVGDGRRYAWVIALRAVETVDFMTARFAHLPYDLIETVSNRIMNEIAEVSRVTYDVSSKPPATIEWE

SEQ ID NO: 28044 - protein, 2493 aa, Cochliobolus heterostrophus
MDQQPDPIAICGMALRLPGALKTPAQFWTFLTEKKDARAPIPFARFDAEAFYSASGKSGYFNSKNGYYLDDSAEVGALDTSLFRMSQQESERMDPQAKILLELARECFESAGETDWRGKDIGTYVGSFGNDWLEMAAKDRLDKNMYKVSGYSDFLLSNRLSYEYDLRGPSMTIRTACSASLMGLHEACLAIRNGDCSAALVGGSNLFWSPDTMADMSEQGVTSPNASCRSFDADADGYARAEAVNLIYIKPLSAAIKHGNPIRAIIRGSSLNADGKTPGPSMPSSSSQAALIRRAYQNAGIPESEIIRTAFVECHATGTATGDPIEATAVGNVFGNGGVYIGSVKPNVGHSEGASGITSIIKAVLALENRVIPPNIKFETPNPKIPFLEKDLKVPTDCLGWPKDKLERVSVNNFGIGGANAHFILDSAASYGVNSDIIADPEREESFLESLKWGKLFLITASTSESLEMQTRNLRDYALSNPTKAEHGSYTLACRREHFSHRAFSVIQELSVDSQAGVSIAGVSPLRLVMIFTGQGAQWPRMGIELLQSNTTFASSIKEMDQELRGLPTPPTWSIEEELAKGADSSNLNEAAISQPLCTAVQVALVDALANLAIKPHSVLGHSSGEIAAAYAANRISRRAAIVLAYYRGLVSQAATRSGAMAAIGLSWDEVTPFLQEGVVIACNNSPSNVTISGDEAVVRNVVQAIQTSNTEVFVRMLKVSTAYHSHHMLNAGNEYEEMVASFLEGEVPYNGASTNPGFFSTVTGLLLPDSERIDAQYFRRNLESPVLFLQALDSLLTGSKDSAHRNLCFLEVGPHSTLSGPLRQIFTQNSVAHPYASCLHREKNANATYLAALGTLWQHGLNFDLYRLTNPLGIAKVLPDMPTYPWYHGKSHIIQNRIAQAWRYPKFPHHELLGSLVLENNDDQPSFRNLLQLENAPWIRDHNIDGDVVFPGAAYVTMAGEACRRQCLPDQDHTFFGFSVKNMVIGAALILQENKPVEIVTSLRRWRITDHLESSGWEFMISSFSGTTWTTHCSGCVEAIYSSPPPPAVPETAFPRRTDAKKWYQAMWHLGARYGPCFQGLKNIECTPNKSSAKATICDKTPDGSESHYLIHPTTIDVFFQTMAAAACNGQGHATDRMSVPTFIKRMDIYESSGDLQVHTSAKVLAHGKFHGWGCAIGQDGALAISIDQIKLMPLDTALEIDLHAGASTTWSLEPSFTTMSSILKNATALAKQTPLMQEFALLHIRKALEQIQSIKPASDTMERYVNWMKRQSIPDTLRPMETVTSEVKTFSCPSTVDAIVKISENIIKLVLGEVSATELLMVDDMLLKIYQEAKVTDRGPYIKLLGHQKPNMRILEIGAGAGGTTHEFLSNLVNDSDGGKLWSSYTYTDISAGFFGAAKESFKEHTLEYKVLDITKDPVAQGFEGHDYDLIIATNVMHAVPNLQQALRNVHSLLRHDGTFYLEELCSDVQVTNFIMGLLPGWWVGEQDGRVDEPYVHPERWDGDLRAAGFTGVADCMLDAPRPHQGNAFMIAYPAIKDALPKPVTLLYDDASQQVVEDLKNELSQHGCFETVLQHWDSAESVVAKRNIICLLDINKPFFFDIEASRFDKFRHWMAQVAESKNGILWLTRSSQLSCEHPRWGQTPGAMRTIQKDMGIDLAICELDRLTSLSLKAVAQISERFSRRHTSSHKLELEYAIEDGNIYIPRLYPLNVDSELCKPDSSATTLPQTDNGELNLTLGTVGRLDTLQWTTCSYERPGENEVAIEIMATGLNFRDLLTAMDLIEAPRQVLGLEAAGMVRDVGSGVENLQPGDRVVVVGGTSLFRTAAVVPSTSCWKLPHSLSFEEAATMPCVFMTVIHGLLEFGQMHSGHTVLIHSACGGVGLAAIQLCHMAGATIYCTVSNEEKVQFLEDEFKIPRAHIFNSRNRSFVDDVMRATNGAGVDLVLNSLSGELLHASWECVAEFGKMIEIGKRDLLGNGRVSLHPFVLNRSFHGIDLAHLIERRPAECRRLLGRMMTLYEAGHIKPISPAKTFKVSEVEQCFRYMQQGRHIGKIILRVGDSADEATRSKDLITAHPKRNPTFNPQASYLLAGGLGGLGRIVANWMVENGARHLIFLSRNAGEKETDKAFFEELEYQGCKVMAVKGSVSVVKDVEKAIAAATAPVRGVMNICMQLQDMGFNQMTYEAWSTVNESKIKGTWNMHNVCMSREISLDFFLLFSSVSGLFGNFGQANYAAANTFLDTFVLYRHSLGLNASAIDIGMMYDHGYIAENPLLAERMQLLGAYGIRIPQLLDAITLVLSTPRSKPEKGTSRKCASLLGIGVRSGLPLSDPANRIMWKDDRRMAYYANLDSDSNAASGATSDVDKPTQAIRAFMKQVLAEPKILDQPDTSAFLARQIARKIALMLLRPLDDKEDSEVDILSPLQDAGLDSLVAIEMRRWWRTTFGFDITMLQMVGAENTMALGDRATEGLRIKYAEIEVQPVTSTPVVAVSA

SEQ ID NO: 28045 - protein, 283 aa, Aspergillus nidulans FGSC A4
MAAYAQQIVVCTGHRDWTSRIEDDGEEQGWGEFVRGLKRLMGRGGPFADPFNNVMVTNSSFTPSSTVSCSPDTASAFLFPSFKYFPSIPVNVSDSPKTTTNLSTFVKAFLLPTQLSPMTETLPEPRHSELLRKPELASEFPDAVDIEHSPVILICGHGGRDMRCGVMAPILEEQFRKILESRGIYTPAGPDNDKFDRPDRAHIGLISHIGGHKYAGNVIIYIPKSMKYGDSSVAHPLAGRGIWYGRIEPKHVEGVVEETILGGRVLSDHFRGGIDHDGTILRL

SEQ ID NO: 28046 - protein, 309 aa, Clostridium acetobutylicum ATCC 824
MGKIYKNLIETIGRTPLVELSNYKEKNKIEGNILGKVEYFNPSGSIKDRIAYSMIKNAEEQGLINKDTVIIEPTSGNTGVGLAFIAAAKGYKLILTMPETMSVERRKLLTAYGAEIVLTSGVEGMTGAIKKANELASENPNSFIPQQFKNPSNPAIHEVTTGIEIWEDTDGKVDAVVAGVGTGGTITGIAKTLREKNKDIKIIAVEPATSPVLSGGKAGPHKIQGIGAGFVPDVYEAELIDEIIQVKNEDAFASAKELAREEGILAGISSGAALFAAKEVASRPEFKGKNVVVILPDSGQRYLSMSVFD

SEQ ID NO: 28047 - protein, 178 aa, Chlamydia muridarum Nigg
MSEPSSCFVLPDPEWIYRVGIGQDSHRFLPSDNPKPCVLGGIIFENTPGFEANSDGDVVFHAICNAFSSVTHQVILGALADELLKAKGISDSAVYLKEAVASLKPTQKISHLAITIEGQRPKLLPKISAMREKIAEILRISLDSVNITATSGEGLTSMGQGHGVQCFCVLTVMEFCPR

SEQ ID NO: 28048 - protein, 380 aa, Clostridium acetobutylicum ATCC 824
MSKKEIIAMILAGGQGSRLGILTRRTAKPAVPFGGKYRIIDFTLSNCSNSGIDTVGVLTQYKPLALNSHIGIGSPWDLDRTSGGVSVLPPYMKETGGNWYKGTANAIYQNRHFIENYDPEYVVILSGDHIYKMNYLEMLDFHKKKNADATIAVFEVPLNEASRFGIMNTDEDDRINEFEEKPKKPKNNLASMGIYIFNWRFLKRFLEEDARDESSNNDFGKNIIPNMLNKKRKLYAYRFNGYWKDVGTIQSLWEANMDLLDDNNSLNIYDPKWKIYSVNPTMPPQYIACNSDVKRSLVVEGCIVLGKVYNSVLFPGVYIGRDTIITNSVIMPNVIVGNNVIIKKSIIGSNARVDDNVIVGTNDNISVVGAGSKVKESIIQ

SEQ ID NO: 28049 - protein, 372 aa, Clostridium acetobutylicum ATCC 824
MLNNYMSILSLNENDNDIKSLTKARPLASIPIAGRYRIIDFILSNLVNSGVKNIGILTQCKSRSLLDHLGSGKPWDLDRKLNGLFIFNFSGITSTLSDIEMLKSNMEYLYRSTQEKVILSSSAVICNIDFQRAAEFHEKSGKDITLIYKRTNNGKRKFLNCSVLNMDKNNNVISIGKNTGLDDVQNISLGMFIMNKKLLINILNNCIRTGFSLSLKQCIRKHMNNFTVNAYEFNGYAEYIDSVKSYYKVNMDMLNLDINREVFFKNGLIYTKVKDEAPTKYFNDSEVCNSLIANGSLIHGQIENSIIGRRVTISKGARIKNCVIMQNCTIKENVDLTNVIVDKNVIIDENTVLKGGKEFPLVIEKKSIYSEV

SEQ ID NO: 28050 - protein, 444 aa, Legionella pneumophila str. Lens
MVNTDQLIAKDLKHIWHPCSQMKDFETFPPIVVNKAQGSYLYTNKGPVIDAISSWWCKSLGHGHPAVIAAIKNQLDCFEHVIGANTTHTAAVELAEKLSEITGKQHVFFASDGSSAVEIAMKLAIHASQIKGHKNKNQFIALKNGYHGETIGTMSVSDLGLYKTPYASFGVQCHYIDDIPYVSGLKDPLWTNCDAYWNNVVQQLNKICDKVCAILLEPIIQGAGGMLCYSADFLSKISSWAKEKDIYLIADEIMTGIGRTGEWLACDHARIQPDLICLSKGLTSGSIPFSCVMIDSALFDLFYDDYHTGKSFLHSHTYSGNPLAIVAALATIKTIEQDNLLMHSQELGKIMFSYLQDIARDSRKLVNVRGVGAVVAADLIESSQARIGFKIYQEAIKQGALIRPIGNTLYWLPPLNTDKEIIGKLAEITLNSIEKAYNKAQGYE

SEQ ID NO: 28051 - protein, 155 aa, Corynebacterium diphtheriae NCTC 13129
MSKEGLPNVSSVAGAGLVVGIVSATWNEKICNQLHAEAIRTAKDCGAKVIETRVIGALELPIVVQKLAQTCDAVVANGCVIKGGTPHFDYVCDSVTEGLTRIALDSGVPVGNGVLTTLNEEQAIDRAGFDGSTENKGAEATIAAMHTALVLRDLP

SEQ ID NO: 28052 - protein, 412 aa, Corynebacterium diphtheriae NCTC 13129
MTLDSIERAIADIANGKPVVVVDSEDRENEGDLIFAADKATPELVAFMVRYSSGYICASLTSEECDRLQLPPMTSHNEDARGTAYAVTVDANTGTTGISATSRADTLRKLADSQFGPQDFTRPGHVVPLRAKAGGVLERAGHTEAAVDLARMAGLNPAGVLCEVVSEDDPTDMARAPELRRFADRHDLALISIEQLIEWRRRYELLVERAVSTQLPTEFGRFTAVGYRGIVDGVEHIALVAGDITSDEGKDVLLRVHSECLTGDVLGSRRCDCGPQLQASLRAISERGRGVVVYLRGHEGRGIGLLHKLQAYHLQDEGADTVDANKALGLPVDARNYSVAAHILRDLGVQSVCLLTNNPEKSLELERYGVKVTGREPVKVEVHEDNIRYLTTKRDRMNHDLPWIAEYKKEQS

SEQ ID NO: 28053 - protein, 369 aa, Mycoplasma genitalium G37
MCKSINTNSAIDIVEIDAASKNGINDIRELVENVFNHPFTFKKKVYILDEAHMLTTQSWGGLLKTLEESPPYVLFIFTTTEFNKIPLTILSRCQSFFFKKITSDLILERLNDIAKKEKIKIEKDALIKIADLSQGSLRDGLSLLDQISNFSDSEKISITDVEKTFNIVDRNAKFTFIKAVLSGDIKEAFNLLDDFESNGLNFTYFLRELFALTVNLYAYAKLKNINVLDSTEKTMIETLNFEKQHYAFLIKAIEENTNFGLSQLTLIDRLKAIVISYNEFFNQKPLTISSPSNEKSLHLETEYLEKKKIKKSNHKQDQKHFSLFEKSFIDKSEKTPKNDEVTNNKFLDTSKLNLANIALAINAFNDNKW

SEQ ID NO: 28054 - protein, 599 aa, Candida albicans SC5314
MTTKEKDEFNIGSLQNSPESSTNMSPDVITTPISKWQAFKDSFKPPEQKPLASSSSSTSSLSASSPHHNDVANNYDIEKSLRPDQQGELKRELKNRHVQMIALGGSVGTGLLIGSGGALHQGGPAALLIAWGITGTMVFCIIHSLGELCVAFPVNGAFSTYANMFVDSSWAFAVGWNYAIMWLIVLPLELVAAAMCITYWNDEINPASWVAIFYVLIVVINIFGVKYYGDAEMYLTIFKIIAIVGFIILGVVLVCGGGPTHEFIGNKYWKQDGAFANGFKGVATTFVTASYSMAGSEMVGLASAEVANPQKSLPKAIRQVFWRIFLFYFLSLTFIGLLVPSNSPQLLGASGTSASPFVIAIKNGGIYALPSIFNACILLSVLSVGNSAVYGCSRTIQSLGAQGLGPKIFAYVDRKGRPLGGLVISAIFGLLCFLSAYHDEATIFNWLLSVAGLATIFSWFNIGLCHVRFRLALRKQGRSLQELTFTALTGVWGSVYSMIFLCVVLVIQFWTALFPLGSKGKANAENFFQNYLGAVVILIFYVGHKLYTRNWKLCVKLEDIDLDSGRRSFDLDLIRAEIEEEKAANKAKPLYKRLWNYWC

SEQ ID NO: 28055 - protein, 520 aa, Trametes sp. I-62
MSRFHSLLTFIVASLASSALASIGPVADMTISNAEVSPDGFARQAVVVNGVTPGPLVKGNMGDRFQLNVIDNLTNHTMLKSTSIHWHGLFQHGTNWADGPAFVNQCPVSAGHSFLYDFQVPGQAGTFWYHSHLSTQYCDGLRGPLVVYDPHDPHKSRYDVDNDDTVITLADWYHVAAKRRSAFPLGADATLINGLGRSPTTPSADLAVINVTQGKRYRFRLVSLSCDPNHTFSIDGHNMTIIEVDSVNSQPLVVDSIQIFAAQRYSFVLNANQAVDNYWVRANPSFGNVGFSGGINSAILRYAGAPAIEPTTNQTTSVIPLNEVNLHPLAPTPVPGKAVAGGVDTPINMAFSFNGTNFFINGASFVPPTVPVLLQILSGAQSAQDLLPSGSVYVLPSNASIEISFPATAAAPGVPHPFHLHGHTFAVVRSAGSTEYNYDNPIFRDVVSTGTPAAGDNVTIRFQTNNPGPWFLHCHIDFHLEAGFAVVMAEDTPDVKAVNPVPQSWSDLCPIYDALDASDL

SEQ ID NO: 28056 - protein, 179 aa, Prochlorococcus marinus str. MIT 9313
MPSSLSQRQNLMKFLGWMLCLLIAIPAQALDTSSGVGLQDRALFQERLDYTLTNQNGKDFHAQDLSNSSFAGAVARAADFSNSNLHGAILTQGTFTQSNFSGADLSDALMDRVDFVDTDLRNCVLKGVIASGSSFAGAQIDGADFSDALLDLDDQRRLCLDADGINQITGIATFESLNC

SEQ ID NO: 28057 - protein, 224 aa, Corynebacterium diphtheriae NCTC 13129
MTQTRQCPIIAPSILAADFRKLEEEIQSVNHADWIHVDVMDGHFVPNLSFGADITCAARLSTSQPLDVHLMIENPENWVDSYIKAGAFTVIFHVEATDNPVDLARHIREQGARAGFSLKPSTPIDPYLDMLEEFDEVLIMSVEPGFGGQKFMPEQLEKVRQLRRIIDERNLDVTIEIDGGISESTIRQAAEAGCDAFVAGSAVFGSDDRNAAIDALRERARSRA

SEQ ID NO: 28058 - protein, 314 aa, Nostoc sp. PCC 7120
NGFGRIGRNFARCWLGRENTNIELVAVNDTSDPRTNAHLLKYDSMLGKLKNVDITADDNSITVNGKTIKCVSDRNPENLPWKEWEIDLIIEATGVFVSKEGATKHINAGAKKVLITAPGKNEDGTFVMGVNHHDYDHNLHNIISNASCTTNCLAPIAKVLNDKFGIIKGSMTTTHSYTGDQRLLDASHRDLRRARAAAINIVPTSTGAAKAVALVIPELKGKLNGVALRVPTPNVSMVDFVVQVENRTITEEVNQALKDASEGPLKGILDYSELQLVSSDYQGTDASSIVDANLTLVMGNDLVKVMAWYDNECG

SEQ ID NO: 28059 - protein, 524 aa, Trametes sp. I-62
MSGFRLLPSFASLAVIVSLALNTFAAVGPVTDLTISNANVSPDGFQRAAVVANGGVPGPLINGQKGDHFQINVVNQLTNHTMLKSTSIHWHGFFQKGTNWADGPAFVNQCPIATGHSFLYDFQVPDQAGTFWYHSHLSTQYCDGLRGPFVVYDPNDPHASLYDVDNEDTVITLADWYHVAAKLGPAFPPRADATLINGLGRSTDTPTADLAVIKVTSGKRYRFRLASLSCDPAFTFSIDNHDMTIIEADAVNTQPLEVDSLQIFAGQRYSFVLEANQAVDNYWVRANPFFGTTGFAGGINSAILRYDGAAEVEPTTTQSTSTKPLAETDLVPLASMPVPGSPVSGGVDKGINFAFTFNGTNFFVNGATFTPPSTPVLLQIMSGAQDASALLPSGDVYSLPSNATIELTFPATTGAPGAPHPFHLHGHTFAVVRSAGSTKYNYDNPIWRDVVSTGTPAAGDNVTIRFRTDNPGPWFLHCHIDFHLEAGFAVVMAEDIPDTKLANPVPQAWSDLCPIYDALDPSDQ

SEQ ID NO: 28060 - protein, 418 aa, Prochlorococcus marinus str. MIT 9313
MVDALDSKSSAFGHVGSSPTAPTAVMGTYKRFPVTLLRGKGCWVWDDHGHQYLDAVAGIATCALGHSDRALRRSLGQQLKQLQHVSNLYRIPEQEALAHWLVENSCADSVFFCNSGAEANEAAIKLARKHGHRRRGIDRPIILTANSSFHGRTLAAISATGQPNFHKGFEPMVEGFEFFPFNNLQAFEQQLNRLEAQGPSVAAVLIEPLQGEGGVNPGEAGFFRRLRELCSQHQILLIFDEVQVGMGRCGNWWGYQQLGIEPDAFTLAKGLGGGHAIGALLVKQHADLFEPGDHASTFGGNPFACKAALTVAKEIERRGLIAKVQQRGAQLREGLTDLVQRFPRQLKGVRGWGLLQGLVLQDESTFTAPNVAQAALEEKLLVIAAGPKVVRMVPPLIIKPSEIRQLLQRLEATLAHFR

SEQ ID NO: 28061 - protein, 373 aa, Oryza sativa Indica Group
MAGKENAAAAQPRLTRAAAKRAAAVTAVAVAAKRKRVALSELPTLSNNNAVVLKPQPAPRGGKRTASHAAEPKKPAPAPAPAVVVVVDDDEEGEGDPQLCAPYASDINSYLRSMEVQPKRRPAADYIETVQVDVTANMRAILVDWLVEVAEEYKLVSDTLYLTVSYIDRFLSAKAINRQKLQLLGVSAMLIASKYEEISPPNVEDFCYITDNTYMKQEVVKMERDILNVLKFEMGNPTTKTFLRMFIRSSQEDDKYPSLPLEFMCSYLAELSLLEYGCVRLLPSVVAASVVFVARLTLDPDTNPWSKKLQEVTGYRASELKDCITCIHDLQLNRKGSSLMAIRDKYKQHRFKGVSTLLPPVEIPASYFEDLNE

SEQ ID NO: 28062 - protein, 575 aa, Gossypium herbaceum
  misc_feature (301)..(301): Xaa can be any naturally occurring amino acid
  misc_feature (476)..(477): Xaa can be any naturally occurring amino acid
  misc_feature (482)..(482): Xaa can be any naturally occurring amino acid
YLGSAGALDVDGKELPRLVYVSREKRPGYQHHKKAGAENALVRVSAVLTNAPFILNLDCDHYINNSKAMREAMCFLMDPQFGKKLCYVQFPQRFDGIDRHDRYANRNVVFFDINMLGLDGLQGPVYVGTGCVFNRQALYGYDPPVSEKRPKMTCDCWPSWCCCCCGGSRKKSKKKGEKKGLLGGLLYGKKKKKMMGKNYVKKGSAPVFDLEEIEEGLEGYEELEKSSLMSQKNFEKRFGQSPVFIASTLMENGGLPEGTNSTSLIKEAIHVISCGYEEKTEWGKEIGWIYGSVTEDILTGXKMHCRGWKSVYCVPKRPAFKGSAPINLSDRLHQVLRWALGSVEIFLSRHCPLWYGYGGKLKWLERLAYINTIVYPFTSIPLLAYCTIPAVCLLTGKFIIPTLSNLTSVWFLALFLSIIATGVLELRWSGVSIQDWWRNEQFWVIGGVSAHLFAVFQGLLKVLAGVDTNFTVTAKXXEDIEXGELYLFKWTTLLIPPTTLIILNMVGVVAGVSDAINNGYGSWGPLFGKLFFAFWVILHLYPFLKGLMGRQNRTPTIVVLWSILLASIFSLVWVR

SEQ ID NO: 28063 - protein, 452 aa, Nocardioides sp. JS614
MTAVSDEKPSKLSAVHQQRLLRTELPGPASRRLMARKSAAVAQGVGTTMPVFAANADGGVVVDVDGNQFIDLGSGIAVTSVGASASRVVAAVQEQVAAFTHTCFMVTPYAGYVSVAEALNRLTPGGHEKRTALFNSGAEAVENAVKIARSHTGRQAVVVFDHAYHGRTNLTMAMTAKNMPYKHGFGPFAGEVYRAPLSYPYRDGGVGGATAAARAIDVIEKQVGTANLAAVVIEPIQGEGGFIEPAAGFLPALVAWCRANAAVFVADEVQTGFARTGDWFACDREGVVPDLIVTAKGIAGGLPLSAVTGRAEMMDAAHVGGLGGTYGGNPIACAAALASIETIEAEGLVARAREIEGLLLGRLRAIEARDSRIGNVRGRGAMIAVELVRAGTDEPDPELAKAVAAAAHRQGVIVLTCGTYGNVLRFLPPLSISDDLLNDAFDVLAATFEVTK

SEQ ID NO: 28064 - protein, 459 aa, Nocardioides sp. JS614
MTTFGVEDPASLEIIAQVPDQGPDEARVAVDRAAAAFADWSRTSPRHRSDVLRRAFDLMMRDSEELTGLITSENGKSLVDAAAEVGYAAEFFRWFSEEAVRPSGEYGEAPTGGVRTIVTHRPVGVAALVTPWNFPAAMVTRKIAPALAAGCTVVLKPAAETPLTALAVGRILSEAGVPDGAVEIVTTTDAPGVVTAWLSDDRVRKVSFTGSTGVGRALLHQAADRVLNASMELGGNAPVVVTDDADLGAAVAGTMIAKFRNSGQACTAANRIFVHNDVAFDFVARLGAAVEKLSVGPAIDGAAIGPLITQAALQRVTEAVDFAVREGARISHQAQLPEAPGYFFPPTVLAGLAPDATILREEIFGPVAPVVVWHDEDELLELVNDTEYGLAAYVFAGDIGRAVRLGERIDAGMVGINRGLVSDPSAPFGGVKQSGLGREGAREGLREFQETQYLSVDWS

SEQ ID NO: 28065 - protein, 575 aa, Gossypium raimondii
  misc_feature (131)..(131): Xaa can be any naturally occurring amino acid
  misc_feature (277)..(277): Xaa can be any naturally occurring amino acid
  misc_feature (327)..(327): Xaa can be any naturally occurring amino acid
YLGSAGALDVDGKELPRLVYVSREKRPGYQHHKRAGAENALVRVSAVLTNAPFILNLDCDHYINNSKAMREAMCFLMDPQFGKKLCYVQFPQRFDGIDRHDRYANRNVVFFDINMLGLDGLQGPVYVGTGXVFNRQALYGYDPPVSEKRQKMTCDCWPSWCCCCCRGSRKKSKKKGEKKGLLGGLLYGKKKKKMMGKNYVKKGSAPVFDLEEIEEGLEGFEELEKSSLMSQKNFEKRFGQSPVFIASTLMENGGLPEGTNSTSLIKEAIHVISCGYXEKTEWGKEIGWIYGSVTEDILTGFKMHCRGWKSVYCVPKRPAFKGSAPIXLSDRLHQVLRWALGSVEIFLSRHCPLWYGYGGKLKWLERLAYINTIVYPFTSIPLLAYCTIPAVCLLTGKFIIPTLSNLTSVWFLALFLSIIATGVLELRWSGVSIQDWWRNEQFWVIGGVSAHLFAVFQGLLKVLAGVDTNFTVTAKAAEDTEFGELYLFKWTTLLIPPTTLIILNMVGVVAGVSDAINNGYGSWGPLFGKLFFAFWVILHLYPFLKGLMGRQNRTPTIVVLWSVLLASIFSLVWVR

SEQ ID NO: 28066 - protein, 357 aa, Picea sitchensis
MLVCLPLSLDIDNTTNAIPMESSPSSLSIVAEAPGMLRIYEDGTVDRLIDSSTVPPSSQLGDESREGVASEDVVIDPQTGVFVRIFLPRLEGKQKVPVLVYFHGGAFCIGSAVSPIYHNYVNEVASEAKVICLSVEYRKAPEHRLPAAYYDGFGVLEWLNRQAEAEEGAPVDPWLASHADFSNVFLAGDSAGGNIVHQVGILASGRNWDGLCLQGAILVHPAFGGKELIGWEVEPEGESQNFSKFSDAIWGISLPPGADKDHPFSNPVGPRSPALSTLEYGRILVFVAEKDLLRDRAVLYYEALKKAGKDADLVMAEGEDHVFHLFNPKSENVSPMLKRISDFMHPSPSIPTQNLSV

SEQ ID NO: 28067 - protein, 498 aa, Leptospira interrogans serovar Copenhageni str. Fiocruz L1-130
MIKISGLNKAFTTKVLFDDLNLSINRGEKVGLVGRNGHGKSTLFQVILGNVEADSGTISIPKGYKIGHLQQHLHFTKPTVLEECSLGLPEGEEYETWKVEKILSGLGFSEQDMEKNPNEFSGGYQIRMNLAKLLVSSPDMLMLDEPNNYLDIVTIRWLEEFLREWEGEIILVTHDRGFMDAVVTHTIAIHRTKAIKVQGDTDKLYNQINQSEEIYEKTRLNEAKKRKQEEIFIAKFKAKASFASRAQSRVKKLEKQGEMKELEKIQDLELYFNSAPFNANQMLSAENLSFSYDDKEPFLIENFSISVGSRERICIIGKNGKGKSTLLKILAGELETSQGTIKKHPVLKEGYFGQTNKLNLNENSTVVEEIMISDPSCNEWKARTIAGGLMFSEDQALKKIKVLSGGEKSRVLLGKILVTPCHLLYLDEPTNHLDMQSCDSLIEAIDEFDGSVIMVTHDELHLRAVATKLIVFDNDSIQIFNGSYDDFLNDVGWSNEHY

SEQ ID NO: 28068 - protein, 489 aa, Prochlorococcus marinus str. MIT 9313
MSEASFDFDVIVIGAGYGGFDAAKHAADDGLKVAIVESGEMGGTCVNRGCVPSKALLAASGRVRELADAEHLSGFGIHAAPVRFERQKIADHANQLVATIRSNLTKTLQRAGVTILRGHGRLEGSQRIGLREKSGVDRLLTARDVILATGSDPFVPPGIETDGRTVFTSDEAVNLEWLPRWIAIIGSGYIGLEFADVYTALGCEVTMIEALDRVMPTFDPDITKMAARHLIEGRDIDARAGVLASKVIPGCPVRIELAEMKSRELVDSLEVDAVLVATGRVPSSKGLNLESVGVETNRGFVPIDDSMRVLVNGKPLPHLWAVGDVTGKLMLAHTAAAQGTLAVDNIQGHSRTIDYRSIPAATFTHPEISSVGLSEADAKDLAAKDGFELGSVRSYFKANSKALAELESDGLMKLLFRKDNGEVLGAHIYGLHAADLIQEVANAVARRQSVAQLATEVHTHPTLSEVVEVAYKQAAKQLAKAVVASASAS

SEQ ID NO: 28069 - protein, 575 aa, Gossypium barbadense
  misc_feature (292)..(292): Xaa can be any naturally occurring amino acid
  misc_feature (329)..(329): Xaa can be any naturally occurring amino acid
YLGSAGALDVDGKELPRLVYVSREKRPGYQHHKKAGAENALVRVSAVLTNAPFILNLDCDHYINNSKAMREAMCFLMDPQFGKKLCYVQFPQRFDGIDRHDRYANRNVVFFDINMLGLDGLQGPVYVGTGCVFNRQALYGYDPPVSEKRPKMTCDCWPSWCCCCCRGSRKKSKKKGEKKGLLGGLLYGKKKKKMMGKNYVKKGSAPVFDLEEIEEGLEGYEELEKSSLMSQKNFEKRFGQSPVFIASTLMENGGLPEGTNSTSLIKEAIHVISCGYEEKTEWGKEIGWIYGXVTEDILTGFKMHCRGWKSVYCVPKRPAFKGSAPINLXDRLHQVLRWALGSVEIFLSRHCPLWYGYGGKLKWLERLAYINTIVYPFTSIPLLAYCTIPAVCLLTGKFIIPTLSNLTSVWFLALFLSIIATGVLELRWSGVSIQDWWRNEQFWVIGGVSAHLFAVFQGLLKVLAGVDTNFTVTAKAAEDTEFGELYLFKWTTLLIPPTTLIILNMVGVVAGVSDAINNGYGSWGPLFGKLFFAFWVILHLYPFLKGLMGRQNRTPTIVVLWSILLASIFSLVWVR

SEQ ID NO: 28070 - protein, 571 aa, Solanum lycopersicum
KMPSPVDVSQNGNARHAEAAPSLFEIEEDLARLLERPRQVNIERKRSFDERSFSEMSMTHSPPRQVYKNSENSSRVFDNMVGVYSPGRWSGIHTPRSTFGYEPHPIIGEAWEALRRSIVNFRDQPVGTIAAIDNSAEELNYDQVFVRDFVPSALAFLMNGEPDIVKNFLLKTLRLQSREKKIDQFKLGDGVMPASFKVSHDPVRNYETITADFGESAIGRVAPVDSGFWWIILLHAYTKSTGDTSLAEMPECQRGIRLILGLCLSEGFDTFPTLLCADGCSMIDRRMGVYGYPIEIQALFFMALRCALFLLKHDEENQECCDAIIKRLHALSFHMRSYYWLDIKQLNDIYRYKTEEYSHTAVNKFNVMPDSLPEWVFDFMPTRGGYFIGNVSPAHMDFRWFCLGNCISILSSLATPEQASAIMDLVGSRWQELVGEMPLKICYPAMEGHEWRIVTGCDPKNTSRSYHNGGTWPVLLWLLTAAAIKTGRPQIARRAIELAESRLLKDSWPEYYDGKLGRFIGKQARKFQTWSIAGYLVARMMLEDPSHLGMISLEEDKQMKPTMKRSASWTC

SEQ ID NO: 28071 - protein, 476 aa, Saccharomyces castellii
  misc_feature (457)..(457): Xaa can be any naturally occurring amino acid
MLQSRLARLTHLRTEPSANDIRKTSIIGTIGPQSNNVPTIVALRKAGLNIIRMNFSHGSHEFHQSVIDNARESESQYHGRPLGIALDTKGPEIRTGSFVRDNGVPVKTGHEMIFSTDPQYKECGDDQIMYVDYANITKVMEVGKFIYVDDGAISFEVLQVKDAETLKVRALNDGTLNSHKGVNLPGTDVDLPALSEKDKQDLQFGVKNNIHMIFASFIRTPDDIRTIRQFLGEDGKQIKIIAKIENEQGVNNFDQILQLADGVMIARGDLGIEIPAPEVLAVQKKLIAKCNLAGKPVICATQMLESMTYNPRPTRAEVSDVGNAILDGADCVMLSGETAKGAYPIDAVNMMADTALIAEEATAYLPNYDDIRNCTPKPTPTTETVAASAVAAVFEQDAKAIIVLSTSGDTARLCSKYRPNCPIILITRNDNTARFSHLYRAVFPFVYNKPALDDWVXDVQNRIDFGIEMAKQMGIL

SEQ ID NO: 28072 - protein, 575 aa, Gossypium barbadense
YLGSAGALDVDGKELPRLVYVSREKRPGYQHHKKAGAENALVRVSAVLTNAPFILNLDCDHYINNSKAMREAMCFLMDPQFGKKLCYVQFPQRFDGIDRHDRYANRNVVFFDINMLGLDGLQGPVYVGTGCVFNRQALYGYDPPVSEKRPKMTCDCWPSWCCCCCRGSRKKSKKKGEKKGLLGGLLYGKKKKKMMGKNYVKKGSAPVFDLEEIEEGLEGYEELEKSSLMSQKNFEKRFGQSPVFIASTLMENGGLPEGTNSTSLIKEAIHVISCGYEEKTEWGKEIGWIYGSVTEDILTGFKMHCRGWKSVYCVPKRPAFKGSAPINLSDRLHQVLRWALGSVEIFLSRHCPLWYGYGGKLKWLERLAYINTIVYPFTSIPLLAYCTIPAVCLLTGKFIIPTLSNLTSVWFLALFLSIIATGVLELRWSGVSIQDWWRNEQLWVIGGVSAHLFAVFQGLLKVLAGVDTNFTVTAKAAEDTEFGELYLLKWTTLLIPPTTLIILNMVGVVAGVSDAINNGYGSWGPLFGKLFFAFWVILHLYPFLKGLMGRQNRTPTIVVLWSILLASIFSLVWVR

SEQ ID NO: 28073 - protein, 111 aa, Zea mays
FMFFLLVATANAIIVSFLMSLAAAGGFLPFFFACLVAVYIGAVSVAFFVIFGTVFSPVVGILVAPGGVGFFWFFWFPPRKSMVLRKHSFGMTSWAIQSFSASRQVKQNPVA

SEQ ID NO: 28074 - protein, 483 aa, Thryallis longifolia
GPGISALEKKNLGRIAQIIGPVLDVAFPPGKMPNIYNALVVKGRDTLGQQINVTCEVQQLLGNNRVRAVAMSATDGLMRGMEVIDTGAPLSVPVGGATLGRIFNVLGEPVDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKAANLE

SEQ ID NO: 28075 - protein, 196 aa, Zea mays
  misc_feature (45)..(45): Xaa can be any naturally occurring amino acid
  misc_feature (165)..(165): Xaa can be any naturally occurring amino acid
  misc_feature (177)..(177): Xaa can be any naturally occurring amino acid
PILSGSYNPGAGTATKRSGHSLGDADLKGKNVFALRRPLRLLVDXTDHKITDDTAIHAFDRTIKGLLENASKGILASHLRRAQGITPYYRLNPVVSRLTELLAAEVAIANDRIAEEVEKLAAVFSEGGVLLLDNGRFYKEEEKNEPECAKKLPSVDDLYVNDAFXGTLHRVHASTVXVTKRLKPAVDDSLMHQELD

SEQ ID NO: 28076 - protein, 438 aa, Triticum aestivum
MASRLASRLLLRRPAAVLSLLQSSRHARHFSTQLLEGVPRLPKPTCERYFLRNASPYQIWSRSFASENGDLVEAVVPFMGESVTDGTLANFLKKPGDRVEADEAIAQIETDKVTIDVSSPEAGVIEKFIASEGDTVTPGTKIAVISKSAAPSEAHVAPSEETSQKETPPPPPAEKPKVEAKSPKVESVKPQASKLASPSEPQLPPKERERRVSMPRLRKRIANRLKDSQNTFALLTTFNEVDMTNLMKLRTDYKDEFVKKHGVKLGLMSCFVKAAVSALQNQPIVNAVIDGDDIIYRDYIDVSVAVGTSKGLVVPVIRDTEGMNFADIEKGINSLAKKATEGALSIDEMAGGTFTISNGGVYGSLISTPIINPPQSAILGMHSIVQRPVVVDGSILARPMMYLALTYDHRLIDGREAVLFLRRIKDVVEDPRRLLLDI

SEQ ID NO: 28077 - protein, 1258 aa, Shewanella sp. MR-7
MKNKIALAVSAALLSMGASAGNISHNVANVTVSKPSNVLDQIQVQHSKPTATVVGMTQAVFTPEADLAPGKYRYFVRLVDSPVALYEGGVEGFKATSPEKNQTRKLDVKSAEVKSYRQYLNNQQDSFIAKAKSIVGELNVQQRTSLAYNGLVVEMSQNDAIKLAKVAGVVHIQRETLRYVQTDSGPNIIKAPTIWSGDATGVATKGEGMIVGIIDTGVNTDHPSFADKGGDGYDHTNPWGENNYSGDCKADFPELCNDKLIGVHSWPAVTKLYLDYDVTVPANGEDHNGHGSHTASTTAGNVLVNQNVPDVDGKDSGVVFEQVSGVAPHANIVSYQVCLPGEKDKINFAGCLPSLTVLAVEHAIENGIDVLNYSIGGGSSNPWQDADALAFLAARKAGIHVATSAGNDGPDAGTVGSPGDAPWITTVAAYTHDRDFSDKTLGGFTGGNTPVPETLTGKAITGAYSGKIVYAGDFTNANGPGEDPAQCLKPFPANTFAADTIVVCDRGEIARVDKGRNVKAGGAAAMVLANVTGGADSVVADAHVLPAININAAQGDKLRAWLASGEGHTATISGSEVIHDDKLARIAAEFTSRGPNKSVPNVIAPSIAAPGVNIFAAYADSQSAGFKENPDPSDFGFLSGTSMASPHIAGALTLLAKIHPTWTPAEIQSALMLTANQNTLKEDGKTPSDFFDMGAGFANLEAAAKTGLVMDESYANYLKADPMVGGKPEAINLPTMANAACVDKCTWTRVVKATVAGSWKASAVGMIDGFALTVSPAEFTLAAGETKALTITADVSAADEGWNFANIKLVADNLPEVKLPVAVKAEGNNLPDSINLEAGRAQGSMTYSGYVVKGQTGMSINVYDKATDLIEPSTLKVPDGDLDYIAVTFPEDLPNVQFKISSETAPDVDLRILNSSFVKIGSSAGPNSDEVVSFTDFPAGKYYVVVDGYTASAPGAVDDVLVEISSVMFDADSLSDSVMTKVSESDGEISITFDWNTKQNTAGILAALASDGSVIKQIPFKLTRKDDVTVSTDLSNTMVAGEASHISFDIEPNLTSEDKVYSLEALLSQGHEITNISHDGVLTDTSITWSVTQPAGSSEIMSVGFDLIPRKSGEFFGINLSNTLGDDTVEVQRQFGVIQVAPVADISAPAKVKEGATVAISGKGSSDANNDALTYKWVQTAGAVATFNATTSDISFTAPSVPPEGETLSFELTVSDSHGNMDTKTVSVMVENQPEDGGSLGWLSLLMLPAVWLRRKIK

SEQ ID NO: 28078 - protein, 330 aa, Cryptococcus neoformans var. neoformans JEC21
MTANAKSIHNNADEKGYFNRQVSSFRDAIQPGGQFPPEKGRYHLYVALGCPWAHRSLIVRRLKGLEDFIDISIVHPHLHEGGWHFVTPEAAANPAPVSQHSDDSFPGATQDHLFGFSHLSKIYYKANPDYNARFTVPVVWDKIAGTIVNNESSEVIRFFNTGFNELLPEGKAKNLDLYPEELRGEIDELNEWVYHDINNGVYKSGFATTQEAYEKAVIPLGKALERINERLSDGREFLVGGRLTEADVRLYTTIVRYDPVYYSHFKCNTGLIRHDYPHINRWLKNLYWNYPAFKDTTNFDHIKDLYWYSQVNLNPTRIVPIGPKHNVEPL

SEQ ID NO: 28079 - protein, 285 aa, Zea mays
MATAFDSPTSSPAAAPFHDDPFLSFADSPAPAAADVHVSGGADDSSFPASPDPYAFRHDSAAAHPFGMPDSNGNGMHHDAEGDGLFTDSGPVLPDPAQMGADEGFLLREWRRQNALLLEEKEKHEKELRSQIILEAEEFKKGFVEKRKLNLETSKDHNREREKLFLSNQEKFHKGADKQYWKAISELIPQEIAHIEKRTGKKDKDKKPGIIVVQGPKPGKATDMARMRQILSKLKHTPPPHMKPPPPPAVAPAGKDGAPAAAGKDGAKAGATPAAKEAPANGPWP

SEQ ID NO: 28080 - protein, 330 aa, Legionella pneumophila str. Lens
MVNSIFSKLSIAPMIDWTNSPFRTLMRLLAPNALLYTEMQTTGAVQNNPDRALYFNSVEHPIAIQLGGADKSALVKCAIIAEQKGFNEINLNLGCPSDKVQAGRFGACLMKEPEHVADCIRAIKQVVGIPVTAKTRIGIDNQDSYEFFRSFSLHLVEAGCDKLIIHARKAWLNGLNPKQNRTIPPVNYDYVYELKKEIPHIFITINGNILTVEEINSHLKHVDGVMLGRLACDNPYQIAEIHQALYPEFIKIKRSQLLINYLDYWFDQSRANLSLSILVKPLFNLAFGLPGAKHWKKKLMNIIQEKNTSGFSELIQYLLNLEAINQVEFV

SEQ ID NO: 28081 - protein, 270 aa, Triticum aestivum
  misc_feature (242)..(242): Xaa can be any naturally occurring amino acid
  misc_feature (257)..(257): Xaa can be any naturally occurring amino acid
MHPTRWELSHMVDLQAAALVISSGRPGRWATFSFAMASGTDEKAKMESLTSPAAFVEGGIQDACDDACSICLEAFCGSDPSALTGCKHEFHLQCILEWCQRSSQCPMCWQPVSMKDPTSQELLEAVQWERNIRTNQTQNTTIFHHPALGDFEVQHLPVVGNDAELEERILQHLAAAAALGRSHQHGRREGQRNRSGSHGRPQFLVFSAHPNTPAGSVSLSSTQGGGADDLRILVPRVGDLPXHANPIEEAGTQSPGXLTYHAYQDAVVHL

SEQ ID NO: 28082 - protein, 287 aa, Clostridium acetobutylicum ATCC 824
MSIRKAVIPAAGLGTRFLPATKAQPKEMLPIVDKPTIQYIVEEAALSGIEEILIIIGRNKKSIEDHFDKSAELEEELKNNHKEELLRMVRQVSNMVNIYYVRQKEPMGLGHAISLAKSFAGNEAFAVMLGDDIVDSKVPCLKQLMDCYDRYNTSILGVQEVRKKDVCKYGIVDGINIENKICKVKNLVEKPSIEMAPSNIAILGRYIITPTIFPILENTKPGKGGEVQLTDALEELLKREAIYSYCFDGKRYDIGDKLGFIEANIDFALKNDKLNSELKEYLLNINK

SEQ ID NO: 28083 - protein, 398 aa, Lactobacillus plantarum
MGEHMDFLGILCLLILATTLAGHFAHRAGIPAVIGEILVGVILGPALLNWVHLTTLVQTFSDIGVVVLMFIGGLESNLALLCKYLRPAIIVAIIGVIFPVVIMGLASRFFQFSWFESLFIGVIFSATSVSISVEVLKEFKVLDTKEGATILGAAVADDIIGVILLSIMIAMMGGQSGVAQTNLGIVLLEQVGFFIGIFIVIKWVAPYLMRLSDHLLMAASPTIMAIIICLALAWLAELVGLSGAIGAFFAGVAIAQTDYQHVVDVSIEPVGYTTFIPLFFVSVGLNMTFKGVWQLLPFIVVMTVLGVLTKLWGCGLGAKLNGFSRHSNYLVGAGMISRGEMALITAQIGFSAHLLSNDYYSDIILVIIVVTMIAPFVLKNAIHRAGQVTATHSIIKEH

SEQ ID NO: 28084 - protein, 575 aa, Gossypioides kirkii
  misc_feature (144)..(144): Xaa can be any naturally occurring amino acid
YLGSAGALDVDGKELPRLVYVSREKRPGYQHHKKAGAENALVRVSAVLTNAPFILNLDCDHYINNSKAMREAMCFLMDPQFGKKLCYVQFPQRFDGIDRHDRYANRNVVFFDINMLGLDGIQGPVYVGTGCVFNRQALYGYDPXVSEKRPKMTCDCWPSWCCCCCGGSRKKSKKKGEKKGLLGGLLYGKKKKKMMGKNYVKKGSAPVFDLEEIEEGLEGYEELEKSSLMSQKNFEKRFGQSPVFIASTLMENGGLPEGTNTTSLIKEAIHVISCGYEEKTEWGKEIGWIYGSVTEDILTGFKMHCRGWKSVYCVPKRPAFKGSAPINLSDRLHQVLRWALGSVEIFLSRHCPLWYGYGGKLKWLERLAYINTIVYPFTSIPLLAYCTIPAVCLLTGKFIIPTLSNLTSVWFLALFLSIIATGVLELRWSGVSIQDWWRNEQFWVIGGVSAHLFAVFQGLLKVLAGVDTNFTVTAKAAEDTEFGELYLFKWTTLLIPPTTLIILNMVGVVAGVSDAINNGYGSWGPLFGKLFFAFWVILHLYPFLKGLMGRQNRTPTIVVLWSILLASIFSLVWVR

SEQ ID NO: 28085 - protein, 217 aa, Escherichia coli CFT073
MNQTLLSSFGTPFERVENALAALREGRGVMVLDDEDRENEGDMIFPAETMTVEQMALTIRHGSGIVCLCITDDRRKQLDLPMMVENNTSAYGTGFTVTIEAAEGVTTGVSAADRITTVRAAIADGAKPSDLNRPGHVFPLRAQAGGVLTRGGHTEATIDLMTLAGFKPAGVLCELTNDDGTMARAPECIEFANKHNMALVTIEDLVAYRQAHERKAS

SEQ ID NO: 28086 - protein, 411 aa, Triticum aestivum
MGSYSPTSRFKDLDTIPLDPHYALKETFQADPDPRKVILGSGLYRDDDSKPWVLPVVKKAEVLIKQTQDSGRYEYLPISGYPAFVSSARQVLFGPQSLNESRLVSIQTISGTGANFLGARFLAETLKPSAVWLSDPSWVNHANIWGLVNVNVKRYPYWNAKTKSLDFNNMIEKLQTDAIAGDVILLHACAHNPTGVDPNKEQWRKIADVCERKQLFPLFDCAYQGFATGNLDDDAWAIRHFIDRGTMELAVCQSFSKNMGLYGERVGALHMFCATSTDAEKVRGHLCRLQRGQISQPPTNGARIAATILSDSKLFQDWVTDLGEMSSRIKEMRKSLYDNLMILDTPGKWDHIVSQIGMFSYTGLTPEQVAFIQQDSHVYILKSGRISVAGLNSKNVEYVAKALDMAVRGLP

SEQ ID NO: 28087 - protein, 379 aa, Corynebacterium diphtheriae NCTC 13129
MTSQDRSEAVLVLADGRIFKGESFGAEGATLGEAVFTTAMSGYQETMTDPSYHRQIVVATAPQIGNTGWNDEDGESHGDKIWVAGLVIRDLSTAVSNWRAKRSLEDEMREQNIVGISGVDTRAIVRHLRNFGSVAAGIFSGEAAKQPHDELIEIVKSQPSMAGADLASEVSTQEAYVVEPDGEALYTVVAYDMGIKTNTPRNFSRRGIRTVVVPANTPAEDIAQYNPDGVFVSNGPGDPATADVMVGIVQEILAQKIPFFGICFGNQILGRALGMNTYKMKFGHRGINVPVLNHLTGKIDITAQNHGFALEGTALEQFDTPFGPAHVTHTCLNDDTVEGVALVNGLAYSVQYHPEAAAGPHDANPLFDQFVELIQANKK

SEQ ID NO: 28088 - protein, 351 aa, Yarrowia lipolytica CLIB122
MSAPVIPKTQKGVIFETSGGPLMYKDIPVPVPADDEILVNVKFSGVCHTDLHAWKGDWPLDTKLPLVGGHEGAGVVVAKGKNVDTFEIGDYAGIKWINKACYTCEFCQVAAEPNCPNATMSGYTHDGSFQQYATANAVQAAHIPKNCDLAEIAPILCAGITVYKALKTAAILAGQWVAVTGAGGGLGTLAVQYAKAMGYRVLAIDTGADKEKMCKDLGAEVFIDFAKTKDLVKDVQEATKGGPHAVINVSVSEFAVNQSIEYVRTLGTVVLVGLPAGAVCKSPIFQQVARSIQIKGSYVGNRADSQEAIEFFSRGLVKSPIIIIGLSELEKVYKLMEEGKIAGRYVLDTSK

SEQ ID NO: 28089 - protein, 175 aa, Haemophilus ducreyi 35000HP
MGLENVPAGKALPDDIYVVIEIPANSDPIKYEVDKESGSLFVDRFMSTAMFYPANYGYVNHTLSSDGDPVDVLVPTPYPLQPGSVIRCRPVGVLKMTDEAGGDAKVVAVPHTKLTKEYDHIKDVNDLPALLKAQIQHFFESYKALEVGKWVKVEGWGDVNEARQEILDSFERAKK

SEQ ID NO: 28090 - protein, 553 aa, Saccharomyces castellii
MFPRSDKDVDQLVGNLNQLGLNKPNARFVSVTPTRANKENRSSLSPSPSPNKTKRFTADETELKNSPKKLPHDFYKKALSNDTKRIVNVCQMYFLDYYCDMFDYVISRRQRTKSVLNYLERNQNSLSTEELNNEWTAYLQQEHDVLRKRRLKPKNKDFEMITQVGQGGYGQVYLARKRDTKEVCALKILNKKLLFKLNETNHVLTERDILTTTRSDWLVKLLYAFQDTESLYLAMEFVPGGDFRTLLINTRFLRNTHARFYISEMFCAVNALHELGYTHRDLKPENFLIDSEGHIKLTDFGLAAGTISTERIQSMKIRLEEVKNLEFPAFTEKSIEDRRKMYTHLRQTEVNYANSMVGSPDYMALEVLEGKKYDFTVDYWSLGCMLFESLVGYTPFSGSSTNETYENLRHWKKTLRRPVLDNGRPAFSDRTWDIITRLIADPINRLRSFEHIKRMPYFAEVNFNTLRQSAPPFTPQLDSETDAGYFDDFTNEADMAKYADVFKRQNKLSSMVDDSAVDSKLVGFTFRHRNGQKGLSGILYNGSEHSDPFATFY

SEQ ID NO: 28091 - protein, 573 aa, Saccharomyces castellii
MSERKMENLTGTMHQLNFNLPNQPNRGSTSQFASLDNFSTPTKYKNDKLNGSPIPPGARRYEIDDSDSKMDIDGSSYNDIDITNSPKKLPQGFQTMASNNKTQRLVSVCKMYFLDYYCDMFDYVISRRQRTKKVLEYLEQKKNENVDLNSLNNEWNGYIQREHQVLRKRRLKPKHKDFEMITQVGQGGYGQVYLPGKKDTNEVCALKILNKKLLFKLNETNHVLTERDILTTTRSQWLVKLLYAFQDTQNLYLAMEFVPGGDFRTLLINTRFLKSTHARFYISEMFLAVNALHDLGYTHRDLKPENFLIDAKGHIKLTDFGLAAGTISNDRIQSMKVRLEEVKNLEFPEFSDKSIEDRRQMYQKYRETEVNYANSMVGSPDYMALEVLEGKKYDFTVDYWSLSCMLFESLVGYTPFSGSSTNETYENLRHWKKTLRRPMLDNGRPAFSDRTWDFITRLIADPINRLRSFEHVKRMTYFESVDFNTLRDLSPPFIPQLDNETDAGYFDDFTNEADMAKYADVFKRQNKLSTMVNDADIDSKLVGFTFRHRYGKNGSSGVLYNGLEQSDPFSTFY

SEQ ID NO: 28092 - protein, 519 aa, Oryza sativa
  misc_feature (433)..(433): Xaa can be any naturally occurring amino acid
MLPRSRTLPPRIHDGVVVVERDVRRYQQLPQQVEMEMTTTKRQQDHQVETMTTKKIDEEDEEVDDDGRAKRRGTVWTAASHIITAVIGSGVLSLAWAIAQLGWVVGPTVMLLFAAVSYFTSNLLADCYRTGDPATGRRNYTYMEAVKANLGGAKVKVCGCIQYLNLLGVAIGYTIAASISMMAIQRSNCFHARGEQDPCHASSNVYMIMFGIVQVFFSQIPDFDQVWWLSILAAVMSFTYSAVGLALGAAQVAQNRTFAGSAMGVAVGFVTKTGDVVTPAQKVWRNLQALGDIAFAYSYSIILIEIQDTLRSPPAEARTMRKATGISVVVTSVFYLLCGCMGYAAFGDDAPGNLLTGFGFYKPYWLLDVANMAIVVHLVGAYQVYCQPLFAFVERRAERRWPNGLPGGDYDLGWIKVSVFRLAWRTCFVAVTXTVVAMLLPFFNDVVGILGALGFWPLTVYFPVEMYIAHRRIRRWTTTWVGLQALSLACLLVSLAAAVGSIAGVLLDLKSYRPFRSTY

SEQ ID NO: 28093 - protein, 431 aa, Pyrobaculum aerophilum str. IM2
MANELSRQWLRRRLGVFDIYALVHSDIQSTYYFLVGFIALAAGQWGFVGALYGVLLMAAIALTYGEMGSRFPETGGSYLYVKYAFGSKIAFLSAWILAFDQIIMVAYGTIDASKILAKLFPALGAWEVIVAIALSTALFLLTTLGIRESANLAKFVAILDMVIIPSLILLSLFYYPATPPFFNWSNVEGVSLLFAFSLLSRGFTGIDAIGQLAGEAREPLVQVPRATLLVVAMGTFYGIGLMAAVMSALTPEEIGDPAVAPLYLAEKIHPLFLYLVAFDIFTVMMVAALAGYISFSRMTYILADEKLLPAFFHRLHKKFRTPYISLAITYVVSLLLISAGGVETILAIYAIGSLINYIMIAIALAKASRSGTLHSAFKTPLIAGIPLSAWIALALLPVGLGLTLIEKYPYLWMWILWIAAGALFYYIKRHA

SEQ ID NO: 28094 - protein, 557 aa, Bradyrhizobium japonicum USDA 110
MPHDSHAKHAWPLFRSLASYSLPGDLMAGLTLAAIAIPEQMATARLGGFAPQIGFFAFMAGSLGFALLGGNRFLSCGADSTITPIFAGGLAALAAVGSPQYQGYAVALALMVGMMMLAGGAFRLGGIANLLSVPVMVGFLAGISVHIIVSQLPGVLGLKSPSGPTLDRIGVLAGELSRSNPFTLCIGLGVLATVFVSEKISAKIPGALIGLVAATLATIGLGLEGEGVSVVGSVPGTLPRLTLPELAPEHWVHLVSLAFVITVVVMVQTAATTRSFPSDPDKPADVDRDFLGAGAGSVLSGLFGAFPVNASPPRTGIVAETGGQSQLAGLAAAAIVLALLAFGTGLLQHVPDAALGGILLFVALRIIRVKQIVTIYRQSFSEFLLIAATAALIIVLPIQQGAFLGIMLSLLHGIWSTTRARLVEFERVPGTTIWWPAHPHIAGERIEGVAVIGLQAPLSFLNAPGFRSDVTKVLGAATPQLLVLEASGMVEIDFTAAQILLDVFKACSEQGVTVALARLESVRAQNAFERFRLFDALPREHVFHSVDEAVRKLAKVQ

SEQ ID NO: 28095 - protein, 407 aa, Oryza sativa Japonica Group
MMETLPAPRPTQIPRSTAIRPPCATPFSRAHWQTTCAAILATTTTTNAKAYGAPRVNGDSIKPALSDHAAPPLDLDLLPVSNLPRPLTITDLSPAPMHGSQLRVAYQGVPGAYSEAAAAKAYPSCDAIPCDQFEVAFQAVELWIADRAVLPVENSLGGSIHRNYDLLLRHRLHIVGEVQLPVHHCLLALPGVRRDLLTRVISHPQALAQCELTLNAMGLNVAREAFDDTAAAAEHVAAAGLRDTAAIASSRAAELYGLQVLADGIQDDAGNVTRFVMLAREPIIPRTDRPFKTSIVFAHDREGTSVLFKVLSAFAFRDISLTKIESRPHRHRPIRLVDDANVGTAKHFEYMFYIDFQASMAEVRAQNALSEIQEFTSFLRVLGSYPMDMTPWEYSSSGQTAGDTSSS

SEQ ID NO: 28096 - protein, 843 aa, Thermosynechococcus elongatus BP-1
MRVVVMAGGSGTRLRPLTCDLPKPMVPVVNRPIAEHILNLLRRHNLDDVVMTLHYLPDVVRDYFGDGNEFGVHLSYVVEEEQPLGTAGSVKNIVNLLTDPFLVVSGDSITDVDLTDALRFHQQHGAPVTLILARVPQPKEFGIVFTDSDGRVRRFLEKPSAAEVFTDTVNTGIYILNPTVMDYLNSGIERDFSRDLFPLLLQADVPMYGYITDAYWCDVGSLQTYQQVQQDALYGRVHLEIQGHEVQPQIWVGHNTPLPPTVQLQAPLVLGNNCRLGAGVTLGPGTVLGDNVMIGNGSRLRSVVAWNGCFIGDDSELEHCILARHVHVDRHVTLQEGVIIGSRCVVREEASLSQGVRIWPGKRIEAGAIVNQSLIWGTTGQRYLFGQRGVAGVANVDITPEFAVRLAAAYASILEPGTSVLVSRDQRNVSRMVSHALMSGLMSVGIHVLNLEAIALPIARFAAQTLSVSGGIHVRAHPDRADQLLIEFFDHKGINLSRAKERQIETAYFREEIRRALLTDVGVMTHPNNCVAAYAQGFEKWLNTQLFYGSPAKIVIDYAYAVSGVVLPQILSKFGCDAVVLNATLHPTPLNILERQRLLRELGQVVTALSASLGVQVSANGERLTLVDNAGQVFSDQELTALMTYLTLLTHPGGTVVVPVTTSSAVEAIARQQGGHIIRSRTNPTDLMEACQHQSGVVLGGSAETGFIFPQLHPGFDAMFTIATLIELLALIGKPLTVIRQELPRVHYYHRPIRCPWLAKGSLMRHLVETHPRNHLSLIDGVKIGEPNTDHWVLILPDASEPLVHLYVNSPDALWSQQMLQRYSRRIEAFARLEPLSDATIKM

SEQ ID NO: 28097 - protein, 307 aa, Actinobacillus pleuropneumoniae serovar 1 str. 4074
MGKIWVTGDAVVDLIPDGENHYLKCAGGAPANVAVGVSRLGVEAGFIGRVGLDPLGKFMQQTLNAEKVSTEHMILDPKQRTSTVIVGLDDGERSFTFMVNPSADQFLEAGDLPTFQKGDFLHCCSIALINDPSRSTTIEAIRRIKAAGGFFSFDPNLRESLWASLEEMKQVVNSVVAMADVLKFSEEELTLLTDTATLEQATKAITAQYPEKLIIITLGKDGAIYHLNGHSQTVAGKALKPVDTTGAGDAFVSGLLAGLSQVENWKDESVLVDVIRKANASGALATTAKGAMSALPNKAELEAFLAQ

SEQ ID NO: 28098 - protein, 235 aa, Brassica napus
MESAALSRIGLAGLAVMGQNLALNIAEKGFPISVYNRTTSKVDETLDRAAVEGNLPVSGQYSPRDFVLSLQRPRSLIILVKAGAPVDQTIAAFSEYMEPGDCIIDGGNEWYQNTERRISEAEQKGLLYLGMGVSGGEEGARNGPSLMPGGSFQAYDNIKDILGKVAAQVEDGPCVTYIGEGGSGNFVKMVHNGIEYGDMQLISEAYDVLKNVGGLSNEQLAEIFTEWNRGELESF

SEQ ID NO: 28099 - protein, 486 aa, Dapania racemosa
GPGVSALEKKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPIDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGDEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLETEN

SEQ ID NO: 28100 - protein, 161 aa, Deinococcus radiodurans R1
MTGLPFRIGYGEDAHRLAPGLPLVLGGVAIPHAELGAVAHSDGDAVLHAVADALLSGLALGDIGQYFPDTAAEWKGMDSRRILAKALELVEERGYRPVNVALVVTLDRPKLGPLRADIAASVAELLGLPAGEVGVSFKTSEGLALEHVQTRVTVLLGRVDD

SEQ ID NO: 28101 - protein, 415 aa, Shewanella sp. MR-7
MTHSASTDTTLPDSHSQIRSQFPTLSQMLGDYPLCYLDTAATSQKPQSVLDAMAQYYLNDNANVHRAAHQLSARATSSYEKVRGELQGFINANRREEIIFTHGTTESINLVAYGLTPQIAAGDLILIDTAAHHANIVPWQELAKRTGAIIKPIPLDRDGRLDLHAYQALLALKPKVVALCHVSNALGTVNPVVELVQQAKAQGAITLVDGAQAVAHLSLDMAAIDCDFYVFSGHKMYGPTGIGVLYGRFDKLETLTPLLTGGEMIKRVSFDGTEFGSLPNRLEAGTPPISEVIGLGAAIRFLQQHLTPEVQAHEAELLQYLQHQLRALGDVHLYAAHSDNLGAVAFNLGDEHHQDVGILLDQQGVAVRCGHHCAMPLMQSLNLKGCCRASIGIYTNKADIDRFIAALASVKELLL

SEQ ID NO: 28102 - protein, 549 aa, Shewanella sp. MR-7
MSFSSLGLSLPIQKAVTEQGYDTPSPIQAQAIPAVLTGKDVMAAAQTGTGKTAGFTLPLLELLSKGNKAKAGQIRALVLTPTRELAAQVSESVETYGKYLPLRSAVVFGGVPINPQIQKLRHGVDVLVATPGRLLDLVQQNVVKFNQLEILVLDEADRMLDMGFIRDIKKILALLPAKRQNLMFSATFSDEIRELAKGLVNQPVEISVTPRNAAANTVKQWICPVDKNQKSALLIQLIKQEDWQQVLVFSRTKHGANRLAKSLIQAEISAAAIHGNKSQGARTKALADFKSGEVRVLVATDIAARGLDIDQLPQVVNFDLPNVPEDYVHRIGRTGRAGASGQAVSLVSSEEFKLLRDIERLINRVLERQEIEGFGPAHALPESTLIAHGKDNKVKAVASQRKHRSAGKPTPRTGTGRDGRKTPDSIDGSAQQKNSNPNQGQRNNQGQHKRPQSSKNAEHKNTHSSTEAGRTPKPQDKRPQHGKGPANSEHKAKGQPHSAAQQPSPQARSEKQHSDSRRQGRTQPTANSASGEHKKPSHRPDNRPNRVKS

SEQ ID NO: 28103 - protein, 145 aa, Populus tremula x Populus alba
VLTDPAKGMKGAVQKAEEIVRRTPNAYMLQQFDNPANPKIHYETTGPEIWEDTRGKVDIFVAGIGTGGTISGVGQFLKEKNPKIKVIGIEPSESNILSGGKPGPHKIQGIGAGFVPRNLDRDVVDEVIEISSDEAVETAKQVALQ

SEQ ID NO: 28104 - protein, 401 aa, Alteromonadales bacterium TW-7
MTVNRELFDHVMVPNYAPSSVIPVRGEGSRVWDQQGKEFIDFAGGIAVNCLGHCHPALVGALKEQGEKIWHLSNVMTNEPALRLAKKMVDATFGEKVYFANSGAEANEAALKLARRFALDKFGPEKSQIIAFNKGFHGRTFFTVTVGGQAAYSDGFGPKPGDIVHCDYNDLAAFEALISDQTCAVMMEPLQGEGGIVSPTDEFAQQVRDLCTKHNALLIFDEVQTGVGRTGDLYAYQGLNVVPDILTSAKALGGGFPIGAMLTTTDIAQHLKVGTHGSTYGGNPLACAVAEAAFDTVNTPDVLAGVKEKAALFNELLAAVNEKYNVFSEIRGKGLLIGAVVNEQYKGRAKEFLVAGTEQGLMSLVAGADVVRFTPSLVIPEADIREGMARFEKAVASVVNA

SEQ ID NO: 28105 - protein, 986 aa, Coccidioides immitis RS
MALVLPGARKLQGLTCSSAQCQKATEGFPSYVSVNLKLGGKASKVFENPFLVNWNRIEQIRMRLPPSLNGDSPGPPTPAKSEDSSKNDIESNQEAESHRDATAQKITKAEQCTEDAKSTLRRDRSPYGSAVRRSMRNRRLAERSTRRAVIPTWFRERNIVLSEQTAEVLQHPPHTVGIGRSNHDAEDAVQRVATGGDGNNGGSNSNPGDSPPEYRYMISEEVWNEIRTVIQAGIAVPSPRYADDPSVRKVHLVLQYPGDSGILFLDAVVKKVASSFNTHVITLNAQDIAELYAEQEQEEDSRSSPMVSLGYEVYHPTKKVSQREADEEMEEAEDEIEDENESTDRRRSATIPISRISDPTMLGSSILQGLFGGRGSVGVAKVVMSQGRDGGLSDTDTDPQSLRVVNKLLSIPKAKSATPAAEESSEKGESEQQNLGTKYEDLVIQIQDYKDLLNTTAGSVFLSSLHKAVQARRRKGQKVVVVGTVSASETDNSSGKSLSKLIPRDYDRYSTTIFVTPAMDSKSAENIFAEDEKRRTLEINIRHLQSMLKTRLNGSTPPESSIFSNRAWALESSTIRTCGLDAEYWPFDLVHRIATLALGSVKATEELGLGHIEQAIQVFEKSDQVKCAWMGDYRGKLKPVKQTREKPRFNKSKLKCNSHEEKLLNGVVDAESIRTSFKDVHVPQETIEALKTLTSLSLVRPDAFTYGVLATDKIPGLLLYGPPGTGKTLLAKAVARESGATVLEVSGSEVYDMYVGEGEKNVKAIFTLAKKLSPCVVFIDEADAIFCSRTGASNRTSHRELINQFLREWDGMSETSAFIMVATNRPFDLDDAVLRRLPRRLLVDLPTEKDRHEILKIHLKDEAVDKSVDLVDLARRTPFYSGSDLKNMSVAAALACVREEYDAAIRHKGDEPYKYPERRILKSHHFDRAMEEISASISEDMSSLTAIRKFDEKYGDRKGRRKKSAGWGFTPPGAPEPTLETGRVRH

SEQ ID NO: 28106 - protein, 350 aa, Cryptococcus neoformans var. neoformans JEC21
MSTDKKDITSWASKDGSFKRQVSSFRDFIEPGGKFAPEKGTCGWDKGRNSWVLMQPVAGRYHLYVSLACPWAHRTLIVRKLKGLEDFLDVSTVHPHMLEGGWHFVPKDKASAKPAPASAHDNDTFPNATSDPLFGFSHLRDLYFKAQPDYSARFTVPVVWDKKENTIVNNESSEIIRFFNTAFNGELPADKAKLDLYPEDLKKEIDELNEWVYNDINNGVYKSGFASTQEAYEAAVKSLAKALQKVEDRLSDGREFLMGDRLTEADVRLYTTIIRYDPVYYVHFKCNFGLIRHDYPNLHKWLQRLYWNHPAFKDTTDFDHIKEHYYYSHAQINPNRIVPFGPNVNIEPLK

SEQ ID NO: 28107 - protein, 69 aa, Triticum aestivum
  misc_feature (42)..(42): Xaa can be any naturally occurring amino acid
  misc_feature (51)..(51): Xaa can be any naturally occurring amino acid
MKFFSAFDPWPVFFRREWGRTWPFLARFAVTGASSTKMTAGXTKKDSKIQXIQAHKKIIRPPPAAKSKE

SEQ ID NO: 28108 - protein, 337 aa, Alteromonadales bacterium TW-7
MKVLVTGGMGYIGSHTCIALHEAGITPVIYDNLSNASPRVLDQLEKITGTRFEFILGDIQDEQQFKLALKHTQAEAVFHFAALKAVGESTEQPLRYYQNNVSGTLSMLQNMQDEGVNHIIFSSSATVYGEPDYLPIDEKHPIRATNPYGWTKVMVEQAMQDVCNANSNFMGIALRYFNPVGAHPSGLLGESPNGIPNNLMPFIAQTAVGKREVVNIFGDDYDTEDGTGVRDYIHVLDLAKGHVAAFMQHKSDTAFHAYNLGTGQGCSVLDMINAFSASAGKAIPYRSAPRRAGDIACNYADATKAQNTLNWHAELTLSDMTNDTWRWQTNYPSGLES

SEQ ID NO: 28109 - protein, 566 aa, Bifidobacterium longum NCC2705
MAINPPVDATQTPEWAALQKHYDELQVEGVSLKKWFAEDAERVEKLSFDAGDLHFDLSKNLIKPETLQLFANLAKAVKLDERTKAMYTGVHINNTEDRAVLHTALRRPVEDEGKYIVDGQDTVKDVRETLDKIYAFADDVRSGKWTGVTGRKIETVVNIGIGGSDLGPVMVYEALKPYADAGISARYISNIDPNDLAEKTKGLDPETTLFIIVSKTFTTLETLTNAREARTWLLEELTANGAIAEGDEAQKAEAIKKHFVAVSTNLEKVEEFGIDPNNAFGFWNWVGGRYSVDSAVGTSLAVVFGPARFEEFLHGFHEIDEYFANTPFEKNVVVLLGMLNVWYRNFFKVASHAVLPYDQYLHRFPAYLQQLTMESNGKSVRWDGTPVTSETGEIFWGEPGTNGQHAFYQLIHQGTQLIPADFIAFVNTPNPTKDGDQDVHELFLGNYFAQTKALAFGKTADEVRAEGTPEEIVPARVFSGNRPTTSIFGVALTPFALGELIALYEHITFVEGTVWGLDSYDQWGVELGKQLAKQITPAISQDDDALAAQDASTQSLIKFYRANREF

SEQ ID NO: 28110 - protein, 188 aa, Zea mays
MPKYLLPAHVCHWCGTWKGDKICSSCKKARYCSEKHQALHWGTGHKNDCLQIISSSAASNSVLPTVGKVPANTSWPEFEIKIDYEGIFDSDSGDENNSKLLVMQRHGKPDAMMQSWMDQFEADFDNKCWTSFQERVSRAPNQVLRYCREPNAKPLWALSFGCPSNADIPSCSYCKDPLCYEFQVGQSS

SEQ ID NO: 28111 - protein, 249 aa, Zea mays
MVKLAFGSVGDSFSATSIKAYVAEFIATLLFVFAGVGSAIAYGQLTNGGALDPAGLVAIAIAHALALFVGVSVAANISGGHLNPAVTFGLVVGGHITILTGLFYWVAQLLGATVACLLLGFVTHGKAIPTHAVAGISELEGVVFEVVITFALVYTVYATAADPKKGSLGTIAPIAIGFIVGANILAAGPFSGGSMNPARSFGPAVAAGDFAGNWVYWVSPLVGGGLAGLVYGDVFIGGSYQQVADQDYA

SEQ ID NO: 28112 - protein, 454 aa, Oceanobacter sp. RED65
MKSRSVLDRFLKQHPDVETIELLVADTSGVLRGKRVEKSLLTKVFEQGFYLPGSIMSLDATGATVEEAGLGAKVGDKDRLCKPIPETLSIVPWHDARDRAQVLCTMHEDDGSAFFADPRQVLKRAVDKFETLGYTPGIALELEFYLIDPERDINGQIQPPLIPGTNRRMTSCQVYSIDELDDYDFFIRDVIEAAAQQGIPADTVIAEYAPGQFEVNLNYGNDILAAADNAILLKRVIHSVAKKHGMMASFMAKPYIQESGNGLHIHLSLMDEQGNNIFADDDPTQNPFMRHAVAGLLDMADATQAFLFPNINSYRRLDPGAYAPTSKTWGNDNRTVAIRIPSGGKDATRLEHRISGADANPYLAVTSILAGVVEGITNELTPPEAVVGDAYEQDHEHISDNARDALRNMEGDARIQEWFGKDFVQVYSICKWQEIRLFEHQITAKEYDLLLPYL

SEQ ID NO: 28113 - protein, 586 aa, Candida albicans SC5314
MSDRYRPRGPRNPQRGGYQSRSSYIPQRRDNRNRDSYIPSGPKRSAERDNYRPDNDRYQQQENRPASSIPHRESPSSLSGATASHPSPKGPRDSYASGMKRPLPSGPASFRKRRDFNSNSNRIPIPKGPRQGFNEMDGGNGNGNGNVDNYRRARQPEKQKLSLEQIYCIKTTNRPNIYQRVSQVGEGTYGKVYKAQHKLTGEYVAMKKLRLESEKEGFPITAIREIKLLQSFDHANIVGLLEMMVEYNQIYMVFDYLDHDLTGLLTHPDLQLQECHRKFIFKQLMEGLNYLHKKRIIHRDIKGSNILLDNIGRLKIADFGLARTMKIVGANEKPDYTNRVITIWYRPPELLLGATDYGREVDVWGVGCLLIELYCKMAAFRGMDEVSQLCRIFNIMGTPTLQNWPEIDQLPWFEMLKPKINVKSKFAQKYSESMSVPAFKLAEQLLQLNPKLRPTAEEALNHEYFQQDPQPKPLYFLKDIQGEWHEFETKKRRRAERKRIKEEEDAQLAASKKAAAAPAVASAPAEASAVNSIKEEVDSVDAITYSEKLVNGDDNKNRSSEIDSKIVDSVEEHNKMEEKSLDTKTT

SEQ ID NO: 28114 - protein, 86 aa, Chlamydia muridarum Nigg
MSQNKNSAFMQPVNVSSDLAAIVGTGPMPRTEIIKKIWDYIKQNKLQDPTNKRNINPDDKLAKVFGSKDPVDMFQMTKIVSKHIVK

SEQ ID NO: 28115 - protein, 483 aa, Oceanobacter sp. RED65
MPSQLLKTQSYVNGQWKDAQSGQEYQVVNPATGELIAKVADCAAADAEVAVELAHEAFLSWRKTTAKERSQIMRKWFDLIMTNQDELAEIMTMECGKPLAESKGEVAYGGSFIEWFGEEAKRVYGDMIPAPAGDRKVLVNKQPVGVCSAITPWNFPLAMITRKCAPAIAAGCTIVIKPAEATPLTALALCELAEQAGLPKGVLNVVTASSGKEVGEVLSTHPLVKKISFTGSTPVGKILLKQSADTVKKLSMELGGNAPFIVFDDADIDAAIKGAMASKYRNTGQTCVCANRFIVQSGIHDEFVKALAKASDELKLGNGLDEGITQGPLINKAAIDKVSGLVDDAKKKGADVVTGGEPFSSKGGYFYKPTVLTGIKDGMDIATEEIFGPVCPVFKFDKEEEAIAIANDTPFGLAAYFYSQNLSQIWRVADELEYGMVGINEGIISTEVAPFGGVKESGMGREGSKYGIDEYIEMKYLCMGGLA

SEQ ID NO: 28116 - protein, 417 aa, Bacillus sp. Tosh
MMKCCRVMFVLLGLWLVFGLSVPGGRAEAATSRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNAPYTSEIYDFKLDQWGLRREPGESFDHYFERLKRSPVWTSTDTARYDLSVPGAETLNRWVKASPNTYYLSFSTERTYRGALTGNYYPELGMNAFSAIVCAPFLGSYRNAALGIDSHWLENDGIVNTISMSGPKRGSSDRIVPYDGALKKGVWNDMGTYNVDHLEIIGVDPNPSFDIRAFYLRLAEQLASLRP

SEQ ID NO: 28117 - protein, 276 aa, Xanthomonas campestris pv. campestris str. ATCC 33913
MKAQWRERFAGIDRLYGVGTVERLAECRVAVVGMGGVGSWVVEALARTGVGHLRLIDADDLCVSNTNRQLPALAGQYGRNKARAMAERCVAINPEIEADAVESFLTAGNIESLLGEGFDLVIDACDSFRVKVETIAWCRRRKLPLLTVGAAGGRTDPTLVRVRDVSRTEHDAMLALIRKKLRSDFNFPKSAKRYFGVPAVYSLENVKYPQADGSVCGIRPQLGADAALKLDCGAGLGAATHITGTFAFVAVGKALEMLLKPKSAAALPAAADAAAA

SEQ ID NO: 28118 - protein, 416 aa, Geobacillus thermoleovorans
MKGCRVMFVLLGLWLVFGLSVPGGRAEAATSRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNAPYTSEIYDFKLDQWGLRREPGESFDHYFERLKRSPVWTSTDTARYDLSVPGAETLNRWVKASPNTYYLSFSTERTYRGALTGNYYPELGMNAFSAIVCAPFLGSYRNAALGIDSHWLENDGIVNTISMNGPKRGSSDRIVPYDGALKKGVWNDMGTYNVDHLEIIGVDPNPSFDIRAFYLRLAEQLASFGP

SEQ ID NO: 28119 - protein, 247 aa, Picea sitchensis
MEVENINVDEFLPAKNPIKLKNVKRRAVSESGDVMEVEEHNGIQGKAKHKRPRAKRAKKNQEPNESKVNMRKVAVPAHRYTPLKEAWLKIFTPIVEHLFLQVRFNTKTRNVEIRVGPETKDIANLQKAADFVKAFIYGFDIEDALALLRLDDLFVESFEIKDVKTLQGDHLGRAIGRLAGKAGRTKFTIENVTKTRIVLADSKIHILGSYQNIALARRAICNLIMGSPPSKVYGNLRNVANRVAQRM

SEQ ID NO: 28120 - protein, 601 aa, Thiobacillus denitrificans ATCC 25259
MPMNRFLLWLLLSLVASPLRAAPDGVVAVSHPAAAAAGARMLATGGNAVDAAAAVQFALNVVEPQSSGIGGGGFMLIHLAKTGETVIVDSRERAPAASRADMFAPGGAPMAFPLASTSGLAVGVPGTVRGVDTALRRWGTMALADTLAPAIELAAGGFRVNRFLAADIADDGGRTAIHPETAAIFRPGGVPLAEGDWLVQPDLARTLRLIATGGPKVFYEGPLARAIVEAQQRTRGELGEPGRGRMAIADLRDYTAAIRRPLTGQYRGWTVASMPPPSSGGLTLLQTLGLLERFPLGDTTQGYGFGSAKTVHLMIEAMRLAFADRAVWIGDDDARALPQAALLHPQYQAARAALIDPARRIEQASAGDPTRWAPAATKAPQRIRSRAESPQTTHFSIVDRWGNVVSYTSTIEYTWGAGITVPGYGFLLNNELTDFNFVPSADSATGNPGANDVAPGRRPRSSMAPTLLLKNGRPVAAYGSPGGATIINSVLNMTLNLVDHGMTPGQAIAAPRVSVTSAAGKVACEGGEDFMQPRLSIAVQDRLRALGHVGLGEAGTDGCQGRIGSVQAVVVDLTSGAQYGAADPRREGTVIRVGPGAPLAP

SEQ ID NO: 28121 - protein, 474 aa, Burkholderia vietnamiensis G4
MRTSEQSYIAGQWLDPADARAIDVIDPATARPYARLAIGSAADVDRAVGAAKQAFDAYSRWSVDARVALLQRVLDIYQRRYDEVARTISQEMGAPLAFARAAQAAVGTAHLEQTIRALRAFRFSTQVDSLLVSYEPIGVCALITPWNWPINQIVCKVAPALAAGCTMVLKPSEIAPFSAILFAEILDEAGVPPGVFNLVHGYGHEVGDALSRHPDVDMVSFTGSTRAGVEVAKAAADTVKRVHQELGSKSPNLILPDADIDAAVTLGARSCFSNSGQSCNAPTRMFVHVDQLAAAEAAARREAARTVVGDPRSPETEIGPVVSRTQFDRIQQLIQRGIDEGATLVAGGLGRPDGLGDGFYVKPTVFSNVTPDMTIAREEIFGPVLSILTYRTEDEAVALANDSVYGLAAYVQTKDLERARRIAARLRVGNVHINYPAWNPAAPFGGYKRSGNGREYAEFGLVEYLETKGTTGYA

SEQ ID NO: 28122 - protein, 209 aa, Oryza sativa Japonica Group
MAPPLQVATTASSSTREGKAPALNERILSSMSKRSVAAHPWHDLEIGKILVIEIPRGSKVKYELDKKTGLVDRVLYSSVVYPHNYGFIPRTLCDDSDPLDVLVIMQEPVIPGCFLRAKAIGVMPMIDQGEADDKIIAVCADDPEYKHYNDIKDLPPHRLAEIRRFFEDYKKNENKEVAVNDFMPATSAYETIRHSMDLYATYILEGLRR

SEQ ID NO: 28123 - protein, 118 aa, Sordaria macrospora
HNDVIMCMEYMDVGSLDRISRVFGPVRVDVLGKIAEATLGGLTYLYSKHHIMHRDIKPSNILVNSKGHIKLCDFGVSGELVNSVADTFVGTSTYMAPERIQGDKYTVKSDVWSFGLTV

SEQ ID NO: 28124 - protein, 410 aa, Prochlorococcus marinus str. MIT 9313
MAPFRLDVVTLVPQAFTPLGELGVIGRAFASGIAVLHTHNPRDYTTDRYHKVDDQPYGGGAGMVLKPEPVFAAVEAIPVQARRRVLLLTPQGKPLCQKDLHRWVEDHDQLVLICGHYEGFDERIRGLADEEVSVGDFVLTGGELPAMTVINGVVRLLPGTVGTAESLQDESHSDVLLEHPHYTRPANFRGMVVPDVLRSGDHGAIALWRQQQRQLRTQMRRPDLYVRWSDQQQSSTLTMESHGSTSMQFRIGNGYDIHRLVPGRPLILGGVTLDHPDGLGLDGHSDADVLVHALMDALLGALALGDIGKYFPPDDPRWKGADSLMLLEQVVALVRDRGWQILNVDAVVVAERPKLKPHINAMRSNLAQRLGVELDAVGVKATTNEGLGPEGREEGMSSQAVALLQQIGLT

SEQ ID NO: 28125 - protein, 453 aa, Prochlorococcus marinus str. NATL1A
MKSSFDLIVIGAGSGGLAAAKKAASYGASVAIVEGDLVGGTCVIRGCVPKKLLVCGSSLLESFLSATSYGFDFDNLKIKSEVLLANVRKEVHRLNELHENFLNKANVELFKGWGEFRNSNCVEVKDRKNGETLNELYGERILIAVGGRPKRPSIEGASLGWTSDDMFLLKSFPKKITIVGAGYIACEFACILHGLGVEVTQLVRGDRILRGFDFELSSSLTEAMKNKGVNISFGEKISSLKGTPGSLIIKTNAGKEFDSNGLLFATGREPFLDGLKLEQAGIEILENKIKVDSEGKTNISNIFAIGDVTDRINLTPVAIDEGRKFADRNYGESDHKVNYNFVPYAVFSQPEIASVGMTEEKAIQSIGKDNIKVYRSIFRPLSKSLPKTGSKCILKLIVDKNNNKVLGCHMIGDNASEIIQMASISLMLGAKKTDFDNTMALHPTIAEEFVTMR

SEQ ID NO: 28126 - protein, 456 aa, Chondrus crispus
MVTGFVPCAAPLRATTRQTAAVSVVSRSASTFVAPSRRVTAPAAPVPTVRMTTAAATTKKSIKDLSPADIAGKRVLVRCDLNVPLDGKTITDDTRIRASVPTIKFLMEAGAKVLLSSHLGRPKDGPEDKFSLSPVAARLTQLLGKDVTMAPDCIGDGVTKIVSGMANGDVTLLENVRFYKEETKNDPDFAKKLAANADFFVNDAFGTAHRAHGSTAGVTAHLKPSVAGLLLEKELAYLAGTVSDPARPFAAIVGGSKVSSKIGVIDSLLQKVDKLIIGGGMVFTFLKAKGLNVGSSLVEDDKLELARELVKTAEAKGVSIILPTDVVLADKFAADANTQVTSVDSIPDGWMGLDQGEDSTKLIQNELKECKTVIWNGPMGVFEMEKFAKGTFAIADTLADLTESGCITIIGGGDSVAAVEKAGLAEKMSHISTGGGASLELLEGKVLPGVAALDDN

SEQ ID NO: 28127 - protein, 465 aa, Burkholderia vietnamiensis G4
MNGIDVGLEADLQALGKRHLLMHFTHADAYRDQALTVFDRGEGCWLVDRNGKRYFDGLAGLYCVQLGYSHGAEIGDAMREQMGRLPFATNWGYGHEPAIRLAHKLATLAPDGLNRVFFTSSGSESNESAIKLVRQYHQARGEPQRRKFIARRVAYHGTSFGALALNGMTNFRKHFEPLMAGVRHVSNTKRYGRPDGETEAQFTRHLLDEIESLIVQEGPDTVAAIVVEPLQNAGGSLTPPAGYAQGLRALCDRHGVLLVADEVICGFGRLGEWFGSTRYGLQPDLITFAKGIASGYVPLGGVIASDAVVDTVLAGPQQMFLHGATYGGHPVACTAALANLAIMERERVLENVGGNQAVFRRTLDGLLELPCVGDVRGDGYHYSLELVTDKAARRWAAGIGAQAFVSTLLAPAIFEAGLLCRAGVDHEGTPIVQFSPPLVMSRDEIVWFVAKIRDILADTYARAMR

SEQ ID NO: 28128 - protein, 418 aa, Chondrus crispus
MSFSKLCIDALDLAGKRVFIRVDFNVPFDKETGKTITNTQRIDAALPTIKYALEKGAKSVVLASHLGRPSGRVNPKFSLKPVADVVSEKIGKTVTFLEDAVGSATEEACKDPETGSVFLLENLRFHIEEEGKGVDADGNKIKADAAKVTEFRKSLSTLADVYVNDAFGTAHRAHSSMVGVDLPQKASGFLMKKELEYFGKALQEPQRPFLSILGGSKVSDKIQLIENLLDKVDEMIIGGGMAFTFKKAVEGMAIGQSLFDEAGAKIAQEIVDKAKAKNVKLHFPVDFTIADKFAPVANTRVATDSEGIPDEWMGLDAGPKSQEAMREVVLRAKTVVWNGPVGVFEFEAFAKGTKAVVDAVVEATSSGAVTIIGGGDTATAVKEMGAADSVSHVSTGGGASLELLEGKTLPGVAALTDA

SEQ ID NO: 28129 - protein, 193 aa, Deinococcus radiodurans R1
MRLMSDTYNAEGFTQTPYLSTERQTKFTQAPELGDAIEPGKQYRAVLETSKGRIVVELYPDEAPMTVNSFAYLLRHHYYDGIKFHRVIDGFMAQTGDPTGTGMGGPGYKFEDEFAGNHHRHSGKGVLSMANAGPGTNGSQFFITFTATPHLDNRHTVFGKVVEGLDVLDRITRIQPGMGGTPDVIETAYLVEK

SEQ ID NO: 28130 - protein, 270 aa, Oryza sativa Japonica Group
CVHISPYRKEASAMGASPSRPLEQSPSSSEGENHRVKYASYTTQGFRPHMEDALAVELDLDATTSFFGVYDGHGGAEVAMYCAKRFHTMLLEDVDYINNLPNAITSVCFRLDDDLQRSNEWRESLNPCANRNCLTNICANLHHFTEDYVPPSYEGSTACVVIIRGNQIIVGNVGDSRCVLSKNGQAISLSFDHKPHHEAERERIQRAGGHVFLQRILGMLATSRAIGDFAYKQNRNMPPSQQMVTCVPDIRVENITDDTEFLVIASDGVW

SEQ ID NO: 28131 - protein, 264 aa, Oryza sativa Japonica Group
MAAAAARSIPDRWTLAGATALVTGGSKGIGHAIVEELAGFGARVHTCARNAAELEASRRRWEERGLRVTATVCDVSARGDRERLVAAAAGEFGGRLDILVNNVGRTMFRAAAACSGEDFALLVATNLESCFHLSQLAHPLLLAAGGGGGCVVNISSVAGTVGIPALAVYSMTKGGMNQLTRSLAAEWAGDGIRVNCVAPGGVKTDICQDETIDPELIKSEMDRLPMRRLAEPEEVAATVAFLCMPAASYITGQVVGVDGGRTIT

SEQ ID NO: 28132 - protein, 125 aa, Triticum aestivum
MAALGSKLAQLQAKACEATRFVARKGCAYHKTLMEKNKQFVVQPPTVEKCQELSKQLFYTRIASLPGRCEAFWKEADQVKQLWRNRKDLNVEHAGIMALFGLELYGWFCVGEIAGRGFTFTGYSV

SEQ ID NO: 28133 - protein, 420 aa, Arabidopsis thaliana
MALSSLLRSAATSAAAPRVELYPSSSYNHSQVTSSLGFSHSLTSSRFSGAAVSTGKYNAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 28134 - protein, 382 aa, Alteromonadales bacterium TW-7
MKLNEFQHHFLSLYGAPAQGIAAAPGRVNLIGEFTDYNDGFVFPCSLEFRTQVMFKERDDNTITVQSLNYPGEQDSFNVDEPISEGQSQWGNYIRAVAFVLKRAGHTLRGADLLIDSNLPQGSGLSSSAALEVAVGGMFNHIAQLGLSEEKIALLGQEAENDFMHCQCGIMDQLISAKGENGHALLIDCENLATKSVKVPDDLNIVIVNSNYPRKLVDSEYNQRRIDCEQAAEKMGVKTLRQATMAKLDAVKAQLSNNEYKRAHHVISENDRVIAATTALQANDMEQLRELMAASHQSLKHDFEVTVPATDGLVEICKEAMGERGAVRMTGGGFGGAIVCLCRDAEVPLIKAAVEKHYFERFNLYADIYVCSAGSGLQITSF

SEQ ID NO: 28135 - protein, 216 aa, Chlamydophila caviae GPIC
MSEKPSLSIMHPWHGPILTQDNYESLCCYIEITPQDSVKFELDKATGLLKVDRPQKFSNFCPCLYGLLPRTYCGELSGKYSGEQSLKENIQGDDDPLDICVLTEKNITHGNILLQARPIGGLRIIDSGEADDKIIAVLEDDLVFSEIQDISDCPCTVLDMIQHYFLTYKASPEHLIHGKPAKIEIVGIYGKKEAQKVIELAHQDYLNKFCREKTTI

SEQ ID NO: 28136 - protein, 193 aa, Zea mays
AGPDFVSARTGMRGMWEGGGRRQTRSAVSALWALRGPHGLKCHAPATTRVNTGPARPGPAQEPPSLDSSNKFPFPLLPIPTHPRRRANPSERESPEPRDQPAMALRALYNEIRSMKVRDVPAYLKPRLTWDNVKKSADQAVDRYIEKYIDTSSPDPLYHVCIGGMIFSYFVNLPWERAHLAHLEEMERTGGKH

SEQ ID NO: 28137 - protein, 659 aa, Streptococcus pneumoniae
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMRQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQNPLPSVIAENSSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRSPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 28138 - protein, 332 aa, Glycine max
  misc_feature (46)..(46): Xaa can be any naturally occurring amino acid
DPRGSAGEGATIDGPSEEAKFSNDFDVVYIGSSCSLLVIDRGNQAXREIQLHFDDCAYQYENGLTLGIAMLVGAGFFGYMLALLQHRLGTTVASQDLEGAAMSGISPSPYQKPLKSVRPPLIPSEDESDKQEESFIRSIGKLLTNAGASVVEIMGALFPGFRKKPQSYEFQSQPLFQQPQKQVNAWPVQESFVIPDEDEPPSIDPRSPTPRKTYAFMSQDAEKMPQLWQSHAFYSGWGGDLQQQQQLKLQQQQQQQQQQQLKHHRHLYHSSVPHTYYEQSHEEINEIVFGAVQEQEGKKETVVIKPVDYGQSLYDHHYIRPRNSSMGHINKY

SEQ ID NO: 28139 - protein, 474 aa, Burkholderia xenovorans LB400
MNHYDVVVIGCGAGGYNTAIRASQLGLSVACVERASNIGGTGMRTGCIPSRLLLHTSEIYDLANKGKNAALGIGCAPTLDLTQMMAYKASTVEKMSNSIHKLLRKQGVTLIHGDALLAAAGQVIVRKTGGVQQTLSGTALVIATGSVPIPLPFAAFDHMRILDSADALSLGKVPRHLAIIGAGAVGVELGSIWQRLGSRITLIERCDRICHWLDRDVTATLERSLRQRGIDIRVSSDVVGLDKHSDSVSVQLRAAASGKITHIDADRVLVAIGRRPSTAGMNLASVGMQTGYKSTLSQQGPATPVTSMTNGSGIWVIGDAGPGPMLMSKAEEEAIACAERIAGLPGFVSYPSIPYVLHTSPEVAMIGRTEDELRGTGAAYRVGYYPLAANPRAAICGTSEGFVKLLVDADTNLIAGAHLIGPGAADLISQVAIAMEASMICEDFARICHPYPVWSEALRQAAMAAGGWMMHVAI

SEQ ID NO: 28140 - protein, 495 aa, Alteromonadales bacterium TW-7
MELADNEYDLLVVGGGVNGTGIAADAAGRGLKVLLCEQSDLACATSSNSSKLIHGGLRYLEHYEFRLVKEALAEREVLLKNAPHIMWPLTFRLPHQSHLRPAWMIRIGLFMYDNLAKRETLAGSRGIKFGENSVLEPSIVKGFEYSDGWVDDSRLVILNALSAQEKGATIATQTKCVNAKREQNKWQVTLEQQNTKSKYTVSAKGIVNAAGPWVAKLFDEALIEKSPQNIRLVKGSHIVVPRIHDEKEAYILQNKDQRIVFVIPFEDDYSLVGTTDVEHNGAAQDVKISDEEIDYLIDITNSYFKNHIKREDIVHTFSGVRPLLDDESINAQAVTRDYKLELSSESKHTPLLSVFGGKITTYRKLAEAAVDKLEDFYPQMGKAWTKHSALPGGDFDNVEALTQELKSLYNWLPEVTLKRFVRTYGTRTKIILGNATQLSDLGHDFGHGLFAAEVDYLLNQEWAGNAYNILWRRSKLGLRFSDEQITVLNNYIETL

SEQ ID NO: 28141 - protein, 87 aa, Oryza sativa
MASRLAQLRSKAAQASELVSKHGCAYYKEVMEKNKQHVVQPPTVEKCQELSKQLFYTRLASLPGRYEAFWKEFDGVKQARLLAEDSP

SEQ ID NO: 28142 - protein, 291 aa, Chlamydia muridarum Nigg
MKRNDPCWCGSQKKWKHCHYPTKPERPSDNLRQLYASRYDIIIKTPDQIEKIRKACQVTARILDALCKAAKEGVTTNELDQLSCNLHKQYNAIPAPLNYGQPPFPKTICTSLNEVICHGIPNDTPLQNGDIMNIDVSCIVDGFYGDCSRMVMIGEVPEIKKKVCEASLEALNAAIAILEPNLPLYEIGEVIENCAARYGFSVVDQFVGHGVGVRFHENPYVAHHRNSCKIPLAPGMTFTIEPMINVGKKEGFIDPTNHWEARTCDHQPSAQWEHTVLITDSGYEILTLLDN

SEQ ID NO: 28143 - protein, 259 aa, Alteromonadales bacterium TW-7
MLQGNLILNTQAQYHSLSGKVIFITGGASGIGRAMVESFVKQQAKVAFIDIDDEAAQALISDLPDANLWYRQVDVTDSNDLQKSLVDACAALGSVNVLVNNVANDRRQASEDVTVKDWDQCLQINLNPAFFASQVAMSFMQQEGAGSIINFSSINAIMGQPQMAGYVTAKAGLIGMTKALARDYGEFGIRVNAILPGWVATERQLASWFTEEEQVKWMEAMALKKLVTPDDVANLALFLAADESSMITGQGIKIDGGRL

SEQ ID NO: 28144 - protein, 647 aa, Oryza sativa Japonica Group
MATIGWIRGYRTSLLLTGKWDKPDPFDGRGLLWHLKMYQEDKYSCIDHSTSYLHVQSVRDFPIEKLNAEVVLVRLDSELICNPLGSCSLSLERTVSTIKYLQKAGAKVLLVTSWTPVLQSVYPVLKSTETFADYMSSLLQVKVVPVNGVPGLTSFKPEGWMQNDIILFENLLNFKGENANCNDFSQKLASGAAIFVNDSFSLSHKMLASTVGITRFCHASLAGFHFEEELMQLRKITDTTRRPFIAIIGGSNFLGKAPALNLLASLCDGLFFVGKLSLQIMNGFGIPVPSCFVEKNSTKEVLQLIQTAHNRNIPIYYPTDTWCLNNKNNNHEKLEILDSAELLPGWTPADIGPSTLEKISSLMPLYKKVLWIGPTCFDLTEEFSGGAAQLGRILDKASHDSCDVILVGSAACKAVKGISGSSSKYTTFKNASVVLEFLKGKILPGVAALDKSYPYQIPWNAIFSDSSQPLVVDIGSGNGLFLFQMARDWEGSNFLGLEMNKKLVVRCLRDVASVDKRNLYFVSTNATSTFRSIVSSYPGQLALVTIQCPNPDFNREQNRWRMVRRMLVEAIADLLQPNGKVYLQSDVESVLLRMKEQFMTHGKGQLVVDDDGGGDHQMDNPFGAASDWERHVLARGAPMYRTMLRKV

SEQ ID NO: 28145 - protein, 502 aa, Candida albicans SC5314
MGSCASKSADQGNGTSKQQQSAQSTQGKRQQQSQAIQQKNKEKQQSRQKEQQEKHQQQQQQPQSQSPSDSNADGTLKNGSDFYETLKHPSDSSNDNGHLKENHSQDLSNGTANKNLITNPVDAAGNSNPSKDVKVLLLGSGESGKSTIVKQMKILHSDGYTQDELEEYRPFVYKNILDCIKNVINAIIDLQPDLIRKPDSPQLEEDHEEDLKVTGLTSENNHVPTANGSVTNQPPPPPKQRKHILEYDMLNEILDYDYPLNLNQQFDPDIAIKIKKVYETPEVKEFMLQRQGDFYLIDSTDYFLSNLDRICLAGNYEPNVTDVLRTRKKTSGIFIYTFDLGNGLNMNLFDVGGQRSERKKWINCFDNVSTIIFCVALSEYDNFLLEESNTNRLEESLALFDSVVNSRWFSRTTVVLFLNKIDVFAEKLKYSPLENFFPDYKGGSNISNGVKYILWRFNKLNRSGLNIYPHVTQATDTSNIELVMAAVKQTILENSLKDSGIL

SEQ ID NO: 28146 - protein, 218 aa, Aspergillus nidulans FGSC A4
MDPNMNNLLKWGIQNSTATQQTSDSNNNASQAPRSNITPEMLSALFGGPSEADLMKAAMEALRSDEVDLENKLIAFDNFEQLIESIDNANNLEPLGLWTPLVELLKHEEPDMRRMAAWCIGTAVQNNEKAQDKLIVMNAIPTLVSMSTQDPVPAVRKKAVYALSSAVRNYQPGTNELVKHLPGGYASGKVDAADMDTIDMIMDKLRAHPVSSSPPSAA

SEQ ID NO: 28147 - protein, 362 aa, Mycobacterium bovis AF2122/97
MSASLPVFPWDTLADAKALAGAHPDGIVDLSVGTPVDPVAPLIQEALAAASAAPGYPATAGTARLRESVVAALARRYGITRLTEAAVLPVIGTKELIAWLPTLLGLGGADLVVVPELAYPTYDVGARLAGTRVLRADALTQLGPQSPALLYLNSPSNPTGRVLGVDHLRKVVEWARGRGVLVVSDECYLGLGWDAEPVSVLHPSVCDGDHTGLLAVHSLSKSSSLAGYRAGFVVGDLEIVAELLAVRKHAGMMVPAPVQAAMVAALDDDAHERQQRERYAQRRAALLPALGSAGFAVDYSDAGLYLWATRGEPCRDSVAWLAQRGILVAPGDFYGPGGAQHVRVALTATDERVAAAVGRLTC

SEQ ID NO: 28148 - protein, 312 aa, Burkholderia xenovorans LB400
MKVSKETKQGRVLVVGSINTDLVARAPHLPRPGETIGGHEFSQVAGGKGANQAVAAARIGARVAMIGCVGSDANGAQRVKDLEVEGIDCSGVEVHPTQPTGVAMVTVSDDGQNTIVVVAGSNGELTPQSVARHEAAIKACDVVVCQLETPWDSVHATLALARRLGKITVLNPAPATGPLPAEWLPLVDYLVPNEVEAAILAGLPVESQSGARRAATELQQGGAHNVIVTLGAQGAYLLVEGGEGRHFPAPQVHAVDTTAAGDTFIGVFAAQLASRQPLEGAINLAQRAAAISVTRAGAQPSIPTRAEVDNAA

SEQ ID NO: 28149 - protein, 257 aa, Oceanobacter sp. RED65
MTVFRPCIDLHQGQVKQIVGGSLNDEGAKTNYVSPYDSAYYADLYKEKNLTGGHVIALGPGNQEAALKALKAWPNGLQFGGGVNRENASDYLNAGASHVIVTSALFENDEFSFERLEAIKKETGKNKLVLDLSCRRTKDGWHIATNRWQTVTRTAITAENLKSLAEHCAEFLIHAADVEGLQGGIDEELVTLLGKHAYAPMTYAGGARSLADLHRVSELSNGKVDLTIGSALDIFGGKGVTLDECIQWNQNYERSVR

SEQ ID NO: 28150 - protein, 184 aa, Bifidobacterium longum NCC2705
MANYPASQPGSQRHTLSVLVENRPGVLARIAGLFARRAFNINSLSVSPTERPDISRVTVTADVEAVPLEQIIKQLNKLLHVLKIVELDPNSTVERELVLIKVAANESNRSDVLEIVRLFRVRVVDVNPESLTIEATGAEGKIDALLGLLEHYGVIELVRSGAVAVTRGPRALSEKVVGSEVTGR

SEQ ID NO: 28151 - protein, 329 aa, Zea mays
MGEASPSIAKDVTELIGNTPLVYLNKVTDGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIDGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAAAAAVRLAKRPENAGKLFVVVFPSFGERYLSSVLFQSIKKEAESMVVEP

SEQ ID NO: 28152 - protein, 487 aa, Escherichia coli CFT073
MKPSTEWWRYLAPLAVIAIIALLPLPAGLESHTWLYFAVFTGVIVGLILEPVPGAVVAMVGISIIAILSPWLLFSPEQLAQPGFKFTAKSLSWAVSGFSNSVIWLIFAAFMFGTGYEKTGLGRRIALILVKKMGHRTLFLGYAVMFSELILAPVTPSNSARGAGIIYPIIRNLPPLYQSQPNDSSSRSIGSYIMWMGIVADCVTSAIFLTAMAPNLLLIGLMKSASNATLSWGDWFLGMLPLSILLVLLVPWLAYVLYPPILKSGDQVPRWAETELQAMGPLCSREKRMLGLMVGALVLWIFGGDYIDAAMVGYSVVALMLLLRIICWDDIVSNKAAWNVFFWLASLITLATGLNNTGFISWFGKLLAGSLSGYSPTIVMVALIVVFYLLRYFFASATAYTSALAPMMIAAALAMPEIPLPVFCLMVGAAIGLGSILTPYATGPSPIYYGSGYLPTVDYWRLGAIFGLIFLVLLVITGLLWMPMVLL

SEQ ID NO: 28153 - protein, 280 aa, Neisseria gonorrhoeae
RMKGKNIALIFEKTSTRTRCAFEVAARDQGAAATYLEPSASQIGHKESIKDTARVLGRMYDAIEYRGFAQETVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKGVGFIHTDVWVSMGEPKEVWQERIDLLKDYRVTPELMAASGNPQVKFMHCLPAFHNRETKVGEWIYETFGLNGVEVTEEVFESPAGIVFDQAENRMHT

SEQ ID NO: 28154 - protein, 456 aa, Corynebacterium diphtheriae NCTC 13129
MKSIMDSLFDSPVQTARSSSDSDAHNFFKAGPYAPLAARMRPQSLDEVVGQRHLLDSGKPLQRLIAGSGDASVILYGPPGTGKTTIASLISAGTGHEFVGLSALNSGVKEIREVIDQARRNLIHGKRTVLFIDEVHRFSKTQQDALLAAVENRTVLLVAATTENPSFSVVAPLLSRSLILQLKPLTHDDIKTVLLHALQDKRGLDNRITISDEALEQLVLLSGGDARRSLTYLEAASESLADGEELTPEIIRHNVDKAIVRYDRDGDQHYDVVSAFIKSMRGSDVDAALHYLARMIDAGEDPRFIARRLVIHASEDVGMADPQALSVAVAASQAVALIGMPEARINLAQATIHLATAPKSNAVITAIDAALADVKQGKTGPVPAHLRDGHYAGAKQLGNAVGYKYPHDDPRGIVEQQYIPNGLEDVVYYRPSEHGAEQRIESYLGKLRRIVRGQRR

SEQ ID NO: 28155 - protein, 242 aa, Triticum aestivum
RYFTYSVVSASAAATKLGRLVKEGRFTKMEEIYLHSLPVKEHQIVETLCPGLKDEVMKITPVQKQTRAGQRTRFKAFVVVGDSNGHVGLGVKCAKEEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 28156 - protein, 325 aa, Prochlorococcus marinus str. MIT 9313
MASLPNLPSKRTLSRWLTALLLPLLVAGLILVQPEPSHAARGGRIGGGSFRAPSMPRSSGGMRGGYGGGYGGYGGGYRGGGIGFPFLIPIFGFGGGGLFGFLILMSIVGVLVNAVRGGGRGNAALNGSGELAQRPTAAGPVTMLQLQVGLLASAKALQEDLRELAASAQTGSSSGLQRVLQETTLALLRQPELWVYANVETGSVPFASAESTFNRLSMTERSKLRAEVTSNVAGERRTDELSEKSAGEADAANEYIVVTILVASSSRIKLSESISSEQLRESLRILGSTSSTDLMALEVIWQPEGRGDVLSAEEVVTSYPNLQHL

SEQ ID NO: 28157 - protein, 302 aa, Leptospira interrogans serovar Copenhageni str. Fiocruz L1-130
MQELDSVRIHFNESNLAFLNLLLGLIMYGIALELRFEDFKLLVDKPRSSITGILSQFILFPFATYLLLWILNPSPGIALGMLLVAACPGGNISNFVTLLAKGNTALSISLTAFSSALAIVITPFNFFFWGNLYPPVQNTLRTISLNPWDVLKAILMILIIPILLGLLTKKFLPKTTAKIVIPIRILSAIIFAAFLLIALFANFQIFLNVIYKVFLYVFLMNAVGFLLGYYFSKLMRLDERDSRCISIETGIQNSGLGLVLIFAFFEGQGSMAIIAATWGIWHAIAGVTLAWFWSKKTSTLKT

SEQ ID NO: 28158 - protein, 465 aa, Thermosynechococcus elongatus BP-1
MPLIMSLLQPLLADVAAESVNLAEAGPLILAAVLLSLVVIYFASKVGGEICARINFPPVLGELVGGVVVGISVLHLLVFSEGGTTEPSLLTTFIQQTAGMDGAVAAVVANTASEVISVLSEIGVMILLFEIGLESDLEGLLKVGPQAAVVAVVGVIAPFVAGTLGLVTLFHVDLVPAIFAGAALTATSIGITAKVLAEIQRLTSPEGQIIIGAAVLDDILGIIVLAVVASLAKTGTVEISNVIYLMISSVVFLVGSVVVGRLLSPFFLGMVDRLSTRGNLLVPSLIFAFVLGYIAVILQLEAILGAFTAGLVLGETEKRRELEEQILPIADMLVPVFFVCVGARTDISVLNPLEPANRAGLIIASFLVLVAIVGKVVTGATVFGQPGINRWAIGIGMVPRGEVGLIFAAVGSVSGVLSKALDAGIIVMVIVTTFVAPPLLRLVFKPGATEALPTSDVAVESPPEG

SEQ ID NO: 28159 - protein, 357 aa, Bradyrhizobium japonicum USDA 110
MRTHSIAAIPADGIGPEVISAGVRVLEALARRSGDLAFNVKTFDWGSDYYKKHGVMMPADGLAELKKFDAIYFGAVGAPDVPDHITLWGLRLPICQGFDQYANVRPTKILPGVASPLRNVGVGDLDWVIVRENSEGEYAGMGGRAHRGLPEEVGTEVAVFTRVGVTRIMRYAFQLAESRPRKFLTIVTKSNAQRHGMVMWDEIAAEVAGEFPDVTWDKMLVDAMTVRMTLHPKSLDTIVATNLHADILSDLAGALAGSLGVAPTGNIDPQRRFPSMFEPIHGSAFDITGKGIANPVATFWTGAQMLEHLGEKDAAMRLMTAVERVCAAGVLTPDVGGKATTKEVTDAVIDAIHGSNV

SEQ ID NO: 28160 - protein, 470 aa, Yarrowia lipolytica CLIB122
MASIPHYDYLVIGGGSGGVASARRAASYGAKTLLIEGKALGGTCVNVGCVPKKVMWNASDLAGRIRQAKEYGFPDVDPKYADNFDWSGFKAKRDAYVKRLNGIYERNLQKEGVEYVFGWATLYKQEGQEFPLVHVKSDDGNTKLYSAKKIMIATGGKPRLPDVPGAEYGIDSDGFFALETQPKRVAVVGGGYIGVELAGVFHGLNSETTLFCRGQTVLRAFDIMIQDTITDYYVKEGINVLKGSGVKKIVKKDNGELLVTYEQDGAEKDITLDSLIWTIGREPLKDTLNLGEFGIKTNKRGYIEVDEYQRSSVDNIYSLGDVCGKVELTPMAIAAGRKLSNRLFGPTEFKNQKQDYTDVPSAVFSHPEVGSIGITEAAAKEQYGEENVKVYTSKFVAMYYAMLEEKAPTAYKLVCAGKDEKVVGLHIVGADSAEILQGFGVAIRMGATKADFDNVVAIHPTSAEELVTMR

SEQ ID NO: 28161 - protein, 271 aa, Yarrowia lipolytica CLIB122
MSSPQDVSMSDIKDKEPETTVKTEPAEPAAAENDPQPAPTEGAPDTDANSKEEGPKEGGKDGVEGDGEKKETGEKNSEDKEPGARDSGASGASGAPAAPGTEDVDMEDANPEENDIDIDFELEGPAQEEEETAQVPGPVPVTRKDKTLSEFLDNMNEYAPIIPDAVTDYYLAKSGFQTNDVRIKRLLALATQKFISDLASDAYQHSRIRSSSSVSSASNPQARAKALVAGVGGAQVQSSTSGRSKIVLTMEDLSSASSEYGLNLKRPDYYR

SEQ ID NO: 28162 - protein, 66 aa, Triticum aestivum
MKEATASGGGSTAGANDPRQPRTARPYAPPKLSAQDLPVDYADFLSGFFGVGDVMLQYKVCSWIVI

SEQ ID NO: 28163 - protein, 156 aa, Haemophilus ducreyi 35000HP
MKKSILALVLGTTFTLAACDKPQVEEMKQTVTDTAANTKAIVVEKAGDMKESASEMKDAAKAKLEDMKESAAEAKESLAEKANEMKDAAKAKLEGMKESAAEAKESLAEKANEMKDAAKAKLEDMKEAAADKKAEMAEKMDSAADAMKEKVDEMKK

SEQ ID NO: 28164 - protein, 468 aa, Idiomarina loihiensis L2TR
MPIVFDNRFARKFPEITTRQPIKPDGEVNLRWLNSPLWAELTNGETPPAELSQWLGGLEHCPGSDPVAQKYAGHQFGHFNPYLGDGRGLLLGQAVVGDKITDIHIKGAGPTPYSRGADGRAVLRSSIRELLASEALHALTIPTTRALALISTQGKIQRERVEPGAMLARTATTHVRFGHFEHCFHRGLEDTMHNLWQDTIEVTWPHLADADIEEQFSQVVKSTAEMIAAWQAYGFIHGVMNTDNMSLAGETFDFGPYAFLDDYQPEKIFNHTDAGGRYGLLQQPGVGLWNLQRLAQAISPLIEADKLRAALDTYEPELRKAYLNRMTKRLGMSSVPAKERMQLVGGWLSLLEVNQADYQLAFRDLIDSLEAKEPKGLLAQSGDSWWQEYNNVVNGESDIDVMKQVNPWVIVRTHHAQRVIEAAETGDDSLLHDYVQALMTPFSERLRESPWAKPPTAEEQVSELSCSS

SEQ ID NO: 28165 - protein, 512 aa, Torenia hybrid cultivar
MSPLALMILSTLLGFLLYHSLRLLLFSGQGRRLLPPGPRPWPLVGNLPHLGPKPHASMAELARAYGPLMHLKMGFVHVVVASSASAAEQCLRVHDANFLSRPPNSGAKHVAYNYEDLVFRPYGPKWRLLRKICAQHIFSVKAMDDFRRVREEEVAILSRALAGKRAVPIGQMLNVCATNALSRVMMGRRVVGHADGTNDAKAEEFKAMVVELMVLSGVFNISDFIPFLEPLDLQGVASKMKKLHARFDAFLTEIVRERCHGQINNGGAHQDDLLSTLISFKGLDDGDGSRLTDTEIKALLLNLFAAGTDTTSSTVEWAVAELLRHPKTLAQVRQELDSVVGKNRLVSETDLNQLPYLQAVVKETFRLHPPTPLSLPRLAEDDCEIDGYLIPKGSTLLVNVWAIARDPKVWADPLEFRPERFLTGGEKADVDVKGNDFELIPFGAGRRICAGVGLGIRMVQLLTASLIHAFDLDLANGLLPQNLNMEEAYGLTLQRAEPLLVHPRLRLATHVY

SEQ ID NO: 28166 - protein, 344 aa, Burkholderia vietnamiensis G4
MKIVKPLLIAAVVAATWSGASAATAASAQAVRPDTATSAFLAVLNGQKGPGLETLSPEKARQVLVDAQSGVKVDLSGIDVSNRTIEQDGLSVPITIVRPQQVSGTPPVFMFFHGGGWILGDFPTHERLVRDLVVQSGAVAVFVNYTPSPEAHYPVAINQAYAATKWVAAHGAEIGVDGSRLAVVGNSVGGNMAAVVALMAKDKGGPAIRFQGLLWPVTDHDFNTGSYGAYAQGHFLTRPLMKWFWNAYTKNEAQRDEIYASPLRASVAQLKGLPPALIQVAQFDVLRDEGEAYGRKLDAAGVDATTTRYDGTIHDFGLLNALANDAPTKAAMKAMGNEIAARLK

SEQ ID NO: 28167 - protein, 457 aa, Torenia hybrid cultivar
MAKTYGPLMHLKFGLKDAVVASSASVAEQFLKKHDVNFSNRPPNSGAKHIAYNYQDLVFAPYGPRWRLLRKICSVHLFSSKALDDFQHVRHEEICILIRAIASGGHAPVNLGKLLGVCTTNALARVMLGRRVFEGDGGENPHADEFKSMVVEIMVLAGAFNLGDFIPVLDWFDLQGIAGKMKKLHARFDKFLNGILEDRKSNGSNGAEQYVDLLSVLISLQDSNIDGGDEGTKLTDTEIKALLLNLFIAGTDTSSSTVEWAMAELIRNPKLLVQAQEELDRVVGPNRFVTESDLPQLTFLQAVIKETFRLHPSTPLSLPRMAAEDCEINGYYVSEGSTLLVNVWAIARDPNAWANPLDFNPTRFLAGGEKPNVDVKGNDFEVIPFGAGRRICAGMSLGIRMVQLVTASLVHSFDWALLDGLKPEKLDMEEGYGLTLQRASPLIVHPKPRLSAQVYCM

SEQ ID NO: 28168 - protein, 617 aa, Deinococcus radiodurans R1
MAAMVSHSSPVDGAPVSRPRSPVMATELKLPDVGDNIEKGTVVTVLVNPGDSVTEGQPIIEIETDKAVVEVPASAAGTIEAVNVKVGDTIPVGGVIATLGGGAASASDSAPSASAPSPANGGGDQAANVESTPATDSGTAQRVAQAQQDAQKEQAGQPTSGGTADANQAQATPSEGQSSGGQQVTLPDVGDNIEKGTVVTILVNVGDTVSEGQPVIELETDKAVVEVPANASGTVQSVAVKIGDSIPVGGTILTLSGAASTQPTAPAPESAQPASQSQQSTQPEPARPAGAPQAQAAAPQQSGTQNPQTFDGRPVVPAAPSVRRLAREIGIDIHAVHGTGIAGRISEEDVRRTAGTPSVQAQASAASAAAPAPMAAPLPNFEKWGTVRREDMSGIRKATVRSMTTAWTTIPMVTHFDKADVTAMEETRKRFGARVEKEGGKLTMTHILMKVVANALRKFPKFNASLDLGAEQVIYKEFVNIGVAVDTPVGLLVPVVKDADRKGITELVLDLSELAGRARERKLKPDEMQGATFTISNLGGIGGNAFTPIVNSPEVAILGVSRGGFEPVWNKEKGEFEPRNMLPLSLTYDHRLIDGADAARFLRYICESLEDPFLISL

SEQ ID NO: 28169 - protein, 397 aa, Pyrobaculum aerophilum str. IM2
MDLLAPLAAVILTYREVDADTLGRVGEEMKKCIEILGVKRPMFVLHTCGRVEAYLYNASEEEINSVTLRYRRYAESIRVVRGVEAARHLFRVAAGLESMLIGETDILGQVEEAFDRQVKAGFTKGLLKTIVERAIRAGKRVRAETGISRGPAGLGSLSIIYVSQLLDLTKSKVAVLGAGAVGAGLAKELAERGVAKLYILNRTLEKAVEIANKLGAEARPLTREEVQKCLMECDVVFSSVHSLEYVIDRVPDGAVVKIIVDLGVPQTVAPGLPVRVVRLSDLKQLAEKYSEARKQEAARAEAIVEEELAKLPQILARRYIEEAVSHLLEKAMEVAEEEGKRAGCPTAVLAARTTVKRTLFPIIEVLKKMAEDGRLEDAVKVVEILRSQKPLLRQSEE

SEQ ID NO: 28170 - protein, 477 aa, Candida glabrata CBS 138
MVKRSASDEAPTAKRVSTKKVLNQLDDYTHRYISVRPLDVFVWGTGSMCELGLGPLAKNKEVKRPRLNPFLPQDKVGIVSIAVGGMHTLALDKDNNIWSWGCNDYGALGRDTSGAKEKLKDANDSSDDEDGDLNELESTPTKLPFKFEGTSEKDAKIVQLVATDNLSSVLLSDGTIYAWGTFRCNEGILGFYQDEIEVQREPWVVPKFAKGKIVQMAGGKDHILFLDEAGIVYAWGNGQQYQLGRKILDRFRLKTLYPLPFGLKKVKYIASGENHCFALTETGKVVSWGLNQFGQCGIGESIEDGGIVAVPSQVMNLPLDNDSIRTISAGEHHSLFLMESGALYTCGRIDMNEIGLLKKELPTYAYKDEHERVRAVPLPTKVVKTLEELDPEDDEDDREYKEMKFKNIAAGSHHSIAISQDGKLYTWGFGETYAVGQGPAGDDIEVPVKITNTATKEVDMVLAGSGGQFSVSAGYKQ

SEQ ID NO: 28171 - protein, 118 aa, Pisum sativum
MAAENEVIAVHSDESWKEQIQKGTESKKLIVVDFTASWCGPCRFIAPILAEIAKKTPQVIFLKVDIDELESVAEEWSIEAMPTFLLLKEGMEVDKVVGAKKEELQLAITKHATTVATA

SEQ ID NO: 28172 - protein, 411 aa, Alteromonadales bacterium TW-7
MNIAQLREQFPALMQSVDGKSPIFLDGPGGSQVPQSVLNAMSAYLGHYNSNLGGAFFSSDKTVELMANTRQAAADLLNAPSAQNIVFGPNMTSLTFSFSRAISRDWQAGDEIIVTNADHFSNVSSWQQAAEDKGVKVNTALINEADCSLDMTQFESLLNSKTKLVAVTYASNTTGSINDIKRIIELAHAVGSLVYVDAVHFAPHELIDVQALDCDFLACSAYKFFGPHLGMVYGKKEHLEGFTPYKVEPAKDVAPGRWETGTQSFEAMAGFIAAVDYIAAISELDDSHTRREKLTAAFAKTKQHEMALSEHFLTRLVNYPRIKLYGIDDFDRLNERTPTFALTFEGLEPRAVSEFLGKQHICVWDGHFYAQGLCKQLNVLDTGGVVRIGCMHYNTVEELDKLFDMFDELLG

SEQ ID NO: 28173 - protein, 172 aa, Clostridium acetobutylicum ATCC 824
MDLKDSIRVIDGFPKEGISFKDVTTLIQDKEAYKYSVDKIGEYLKDKNVDLIVAPEARGFLFGAPVAYKIGAGFIPVRKKGKLPCETVEVTYELEYGEDILEMHKDAIKKGQRVAIVDDLLATGGTINSVAKLVEALGGEVVAACFVVELTDLNGKDKLGDYDTMSLVKYNV

SEQ ID NO: 28174 - protein, 517 aa, Candida albicans SC5314
MSNIDDILLGISESLKQLQKASQEKPIEQTQPVQIQNLEVNSTKKFTDDYYSKIADDYIEFTYKNPTIYHVVNFFKSQLESKGFTYLPESKSWADLKAGKYFTTRNGSSLAAFVVGKDWQASKGVGAIGSHIDSLTTVLKPNSTKAKVDGYELLGVAPYAGTLGSVWWDRDLGIGGRLLVKDGKGKVSQHLVDSTPHPIAHIPTLAPHFGAPANGPFNTETQAVPVVGFSGENDKEEEQPTEEEKNAPLYGKHPLKLLRYIAKLANVSVGDILQWDLQLYDVQKGTKGGLNKEFVFAPRVDDRVCSFAALNALIDSTVDNNLAEDSFSIVGLFDNEEIGSLTRQGARGGLIELVVDRVLSSNFYNPEVLDIQESLRLTYANSIVLSADVNHLFNPNFPGVYLEHHKPLPNIGVTLSLDPNGHMATDSIGLALAEELAKKNGDKVQYFQIRNDSRSGGTIGPAISTSTGARTIDLGIPQLSMHSIRATLGSKDIGLGIKFFYGFFKNWRDVYDNFVDL

SEQ ID NO: 28175 - protein, 306 aa, Sporothrix schenckii
MDGKRQLNSFQQLEKLGEGTYATVFKGRNRHTGEFVALKEIHLDSEEGTPSTAIREISLMKELKHENIVALHDVIHTESKLMLVFEYMDGDLKKYMDTNGERGALKPMLIKSFMYQLLKGIDFCHQNRVLHRDLKPQNLLINGKGQLKLGDFGLARAFGIPVNTFSNEVVTLWYRAPDVLLGSRTYNTSIDIWSVGCIMAEMYTGRPLFPGTTNEDQMLRIFRIMGTPAEHNWPGISQFPEYKATAPRYATQDLRQILPQIDATGIDLLQRLLQLRPELRISAHDALQHPWFHDILQYQHCQQAAG

SEQ ID NO: 28176 - protein, 474 aa, Aspergillus oryzae
MKTSTLCTIAFSATALAVPVSVTTSDHGLADPVPAHAPEGEDHARLQSRTFFPMGGLCPPCGEEGASLKARTFLPLIEGLIQHKMDKFGLCSPCDTSTNSNENSNSNDNSNTNDNSNTNTNTNTNNNSNTNNNSNTNNNSNTVTNNINGGTPPGGTPPTGGTPPTGGTPPTGGTPPTGGTPPTGGTPPSGGMPPTGGMPPTGDVPPTGGTPPTGSIPPSGSNPPTGGTPPTGSTPPTGSTPPSGGTPPSGGTPPTGGTPPTGGTPPTGGTPPTGGTPPTGSTPPSGGNPPIGGTPPSGGTPPTSGTPPTGSNTSCEEDDDTCTPTGGTPPTSGTPPTGGMPPTGGTPPTGTNTACEEGDDSCTPTTGGTPPTGGMPPTGGMPPTSGTPPSGGTPPTGGNPPTGMPPTSGTPPDGNNTGTNKGGNTSSGSSGSSSSSSSSSSSSSSSSSSSSSSTTGGTPGCAECQAPPPEDCEE

SEQ ID NO: 28177 - protein, 145 aa, Picea sitchensis
MEVEQPSAKQSAIAVEGQDKPVHGKPTYDGVIAGKVSGLKWKQAKTTRASALKVSHKRTTFEERSRAKEITKDYKERISELKEQIRVNKVEKRKKKEELVKRKKENELRLGMKLQKITNPKTLKKMSKSKKKKLLRVVPDVALKK

SEQ ID NO: 28178 - protein, 173 aa, Sordaria macrospora
FSNTVQSMRVILEAMESLELPLADQRVEYHVQTIFMQPAQIEGDVLPPEVGNAIEALWSDAGVQSCFKRSREYQLNDSARYLRSRVKTTGITETTFIIGDLTYRMFDVGGQRSERKKWIHCFENVTTILFLVAISEYDQLLFEDETVNRMQEALTLFDSICNSRWFIKTSIIL

SEQ ID NO: 28179 - protein, 176 aa, Yersinia pestis KIM
MKEYDRIRPPAGYEPILRKAMNVIEGVVATPNARVAIAIARFNNFINDSLLDGAIDALKRIGQVSDDNITVVWVPGAYELPLVANVLAKTNRYDAVIALGTVIRGGTAHFEYVAGEASSGLSSVAMNSDIPVAFGVLTTESIEQAIERAGTKAGNKGAEAALTALEMINVIKAIKG

SEQ ID NO: 28180 - protein, 463 aa, Variovorax paradoxus
MNTVDITEIIEKQKPNRKVLALLILSFLIMLCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFIAMSLPESIKYLVLSGQKPEAVARVVNAIDPSIRASSQTRFVLGTAEEGARIAGWKDSVKALFGGQLSKITPALWGAFVCSSVTVFFLASWIPVLTVGTGRSASLAAVGLALFSAGGAFGGIFSSRVIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMGADRANDPEARPIDA

SEQ ID NO: 28181 - protein, 219 aa, Haemophilus ducreyi 35000HP
MTQQEMKKIAAQAALQFVKPDTIIGVGSGSTVNCFIDALASIKDEIKGAVAASKASEDQLRAMGIEVFNANEVAGLDVYIDGADEITPQGAMIKGGGAALTREKIVSSLAKQFICMVDSSKQVDVLGSSFPLPVEVIPMARSYVARQLVALGGSPEYREGVVTDNGNVILDVHNFNIYEPLKMEHTINNIAGVVTNGIFAQRYANIIIVGTAEGAKIIK

SEQ ID NO: 28182 - protein, 509 aa, Zea mays
TQDRQANEARVLTTTIPCCNDAIANPDEGRMVGHYWLRDPALAPNSFLRNKIETALDRILAFSQDVVSGKILSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKANPAALLALCWYWASEGIGKKDMVVLPYKDSLLLLSRYLQQLVMESLGKEFDLDGNRVNQGLTVYGNKGSTDQHAYIQQLREGVQNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 28183 - protein, 177 aa, Sordaria macrospora
GVVWDSSAVHKPSGQKVAIKKITPFDHSMFCLRTLREMKLLRYFNHENIISILDIQKPRSYDTFNEVYLIQELMETDMHRVIRTQELSDDHCQYFIYQTLRALKAMHSANVLHRDLKPSNLLLNANCDLKVCDFGLARSAASQEDNSGFMTEYVATRWYRAPEIMLTFKEYTKAIDV

SEQ ID NO: 28184 - protein, 579 aa, Idiomarina loihiensis L2TR
MKFWLPTIIAASVLTACTPASEQETREPEAATGFVEKSAVTADNFMVAAANPHAVDAGYQVLKRGGSAVDAAIAVQAMLGLVEPQSSGPGGGAFILYWDNEENKLYSIDARETAPMDATESLFLDEEGNAPKWIDAVVGGRSVGTPGVIRGLELAHKRWGKADWSSLFSQTIELSKEGFEVSPRLAKLVEMEINPGVKKMPEASDYFFPNGEPLKAESILKNPDYAKSLSLIAEQGADAFYQGELAAKIVDAVQNSPIEPGALSLKDLSQYKAKLREPVCSAYRQYQVCGMGPPSSGGITTLQTLGVLENFELGELEPNSEQFVHLFTQASRMAYADRNQWIADPDFVEMPVEAMLDKTYLSSRADKITENDMGKAKPGVQLQPEYEQDIAYELPNTSHVSIVDAEGNVLSMTTSIEMGFGSTVMAGGFLLNNQLTDFSLAPGDGKEKYANRVEAGKRPRSSMDPIIVLDEKGEQVLHALGSPGGSRIINYVSQTLVGMLDWNLNVQQAINLGHVTNRNDYTSLEKGRDISELKADLEKRGHDVKVIDLNSGLHGVSIDSDGTLIGGADPRREGVAKGE

SEQ ID NO: 28185 - protein, 366 aa, Oryza sativa Japonica Group
MLRERSSRRRMASSSTAAAALVVAALLLSSSPSPAAAAAGRGGELRMKHSDGGYSYNRTLAHIFVQYASAVYTSDLTSLFAWTCPRCQSDTKGFEMIEIIVDVENCLQAFVGVAPDPQSILIAFRGTQEHSVSNWIEDLFWKQLDVGYPGMPDAMVHHGFYTAYYNTTVRHEILESVRWARKTYGRLPINVVGHSMGGALASFCALDLSVKYGSQEVQLMTFGQPRVGNPSFAAYFSDQVPRTIRVTHQNDIVPHLPPYFCYLGEWTYHHFSREVWLHETIVGNVVTRNETICDGSGEDPTCSRSVYGRSVADHLEYYGVSLHADSRGTCQFVIGSTNMAYGTILEVDRTIIMTRYPQEWHAVESI

SEQ ID NO: 28186 - protein, 459 aa, Pseudomonas sp. KIE171
MSEENKKQILKVRDFIEKHNIDTIRLGAVDIDGVWRGKQVGAEYFLNKAALDGTQISNILFGWDVADHLVDGLEFTGWDSGYPDIALIPDLSTLSLVPWQEKTASVLCDIQHLNGEPLNLSPRNLLRKAIEKAEQLGYKCYAAYEFEFYLLNDSIASISADQWRSINPVEKSGHCYSMLHHSSSSDIMGEVRKYMRDAGIVLEATNSEHGPGQYEINIKYDDALKAADDAIFVKNGIKEIAAKHGMTATFMAKPSAEWSGSSGHVHMSLSDLAGTPVFANPENPGALSEVGYNFLAGMVALAREMSAIYLPNINSYKRTAGASWAGGNSSWGFDNRTVSHRAITSAGSAARVENRIPGADTNPYLVIAASLLSGLYGIENKLKPKDPILGNAYKVSPELARPLAASLEEAAGIFRESEMARVIFPNEFVEHYAQMKVWEIKQSNSFVNNWELARYLDII

SEQ ID NO: 28187 - protein, 487 aa, Gibberella zeae PH-1
MQLKGVMVALLSMSVIADAAVVQRRHPLARALQRRQFGGGGGGNNGGNNGGNNGGNNGGNNGGNGGNNGGNNGGNNGGGGGNTLQGNAVQTGSQQDGNQPGSDEQAASATDDNNFINFCAGQTLTNGEQNRDGSCNGIPMGKIPAANKMVSSVFTSPQNGDNIQANQNFDISVQFINFAPGSFTNATNTYYSAPQDLDGGGNIIGHTHVTVQDTGNDLNPKQPLDPSVFAFFKGINDAGNGQGLLTASVEGGLPDGNYRICSMSAASNHQPVLMPVAQRGAQDDCIRITVGGNGGGGGGNNGGNNNGGQDGGQGGQGGQGGDQNNGQGGDQNGGQGGQGGQGGDQNNGQGGDQNGGQGGDQGGQGGDQNAGQGGDQNGGQGGDQNADQNAGDQGGDQNAGQGGDQNAGDQGGDQNAGQGGDQNAGDQGGDQNAGQGGDQNGGQGGQGGQGGQGGQGGGRFGRGGRGRFGGFNAASTDGAANSTTTDA

SEQ ID NO: 28188 - protein, 123 aa, Zea mays
  misc_feature (79)..(79): Xaa can be any naturally occurring amino acid
FVTVTKSEETSWDCLKPEVFAAIMDFYSSGQPLFLDSNAAASMDTAIHEDDSEIVAMIKELLETRIRPAVQDGFPVSLXHYFDPETGTVKLKMQGACSGCPSSSVTLKSGIENMLMHYVPEVT

SEQ ID NO: 28189 - protein, 331 aa, Solanum tuberosum
MGHLQVFIVSFLSISCVSIFMPNLVAAQLKTNFYAQTCPNVESIVRNVVNQKFKQTFVTIPAVLRLFFHDCFVEGCDASVIIASTSGNTAEKDHPDNLSLAGDGFDTVIKAKAAVDAIPSCKNKVSCADILALATRDVIQLSGGPGYAVELGRLDGLTSKSSNVGGNLPKPTFNLDQLNTMFASHGLNQADMIALSAAHTLGFSHCDQFSNRIFNFSPKNPVDPSVNKTYAAQLQQMCPKNVDPRIAINMDPITPRAFDNVYFQNLQKGMGLFTSDQVLFTDQRSKGTVDLWASNSKVFQTAFVNAMTKLGRVGVKTGKNGNIRIDCGAFN

SEQ ID NO: 28190 - protein, 212 aa, Triticum aestivum
YFGAQVLHPQSMRPAREGDIPVRVKNSYNPKAPGTLIAKGRDMDKVVLTSIVLKSNVTMLDIVSTRMLGQFGFLAKVFSIFEDLGISVDCVATSEVSISVSLDPSKIWSRELIQQELDHVVEELEKIAFVHLLQQRAIVSLIGNVRKSSLILEKAFHVLRRIGVNVQMISQGASKVNMSLIVHDSEAKLCVEAPPPRPFFKGRWRWRMAMIA

SEQ ID NO: 28191 - protein, 507 aa, Pseudomonas sp. KIE171
MSGDYMVQATTNLVGAAYWRGRADEIQFEGRCLIDGKMVEAQSGYTFDCVSPVDGRVLTKVSAGGEADVNRAVAAARSAFRDRRWSGQSPVSRKRTLQAFAALIRLHRDELALLETLDMGKPISASRSVDVEAVASCFEWYAEAIDKLYEQIAPTAETDLALITREPLGVVGAIVPWNFPMLTAAWKTAPALACGNSVVLKPAEQSPLTAIRLAQLALEAGVPEGVFNVVPGLGGSAGRALACHMDVDGIFFTGSTATGRLLTEYAAKSNLKRVCLELGGKSPNIILASYGDIEKAAVASAESMFNNQGEVCIAPSRLIVERSIHKRVVEIVAEVAKRRQPGDPLDPTTRMGALVDANHADRVMGFIGRAKADGATLVAGGTRALTETGGSYVVPTVFDNVSNCMEIARDEVFGPVLSVIPVANVGEAVAVANDSPYGLGAGVWTDRLSDAHKISRELRAGVVYVNCYNDCDITTPFGGVKQSGNGRDKSLYALDEYTELKTTWIKL

SEQ ID NO: 28192 - protein, 278 aa, Arabidopsis thaliana
MDQYGIPVERKEMKHKGRNVIWSVGMDKCLIEALAVQAKNGNKVDKCFNDKAYTAACVAVNTRFNLNLTSQKAINRLKTIKKRYRVMRDILSRDGFWWNSSTKMIDCESDELWRRYIAVNPDAKAFRGKQIEMYEELRTVCGDYQTPGSSEEHSDTDGTESYAGASEYMHEESQDLPPPRDPLRRPSKRSRNSDPCQEAMLVVASSIRRLADAVVQSKTLINTEELLKAVMEIDELEEAKQMYAFEYLNGDPVKARAFMAYNNRMRKMFLFRQFWWWK

SEQ ID NO: 28193 - protein, 613 aa, Bifidobacterium breve
MTKRLLEITSVTAHTECGPTGERSDMSLPLDAAELRKTGNLIEISVHAHVPVENPILEHATFQPGCSLTVSCALPRYSRPAQGTPILCLYQHKEWWMRPTWVSCFADVPERTQMLVWKTRRTYKGQVREQWHVLLAASDGECRADIRGCATDAAGAAGGALAVDSSTNRVGQTSLDGLALLYARGGDPYALIEQCVTATWRRLPVGPKSLRRFPEALRGFGWCTWDSLGQNVSESGILAKMDEFKAKQVPVSWVLIDDGWSQTRNNKLTGFGADPTRFPQGLAHTIDVLKQDYGVRYVGVWQAFQGYWGGVDPDSDAFKERRYMFETLPGGMTVPSAQPAWDMFVDGECLSEYGCERFWWRWSEELANAGVDFVKVDSQSTMSVLTRGAQSYGTLLMRHRAVDLAASAFFNNALINCMGMAPEDYWRRPYSPITRTSDDFFPRIPESLPEHAIENAYCSLLMGCLYHCDWDMFWTKHPDARVHAWLRWFSGGPVYCSDALGETDPETLKPFFDEDGVLTHPDGVGMPVIGSLLSDPVHSTVPLGVRNTFRGEEVLLFVGLNTAAVQSAHIPAGDSACLVRNLETGECTQVGAGETLDVELRYGEYAALAVARA

SEQ ID NO: 28194 - protein, 469 aa, Alteromonadales bacterium TW-7
MKLVPRYTDIADNFAIEDQPSSVAAPQLLLWNEALAKQFNIGVEPQLRPSTFAGNESQQIKSVALGYSGHQFGHFSPRLGDGRAHLLGAINDDKNQLWDIQLKGSGATPYSRGGDGRCALGPAIREYVMSEAMHALGIPTTRCLAVVGTGEAVYRNPPQPGAVVTRLASSHIRVGSFQYLATQGDAEGLKKLADLAIKRHYPEITSEGPERYIAFLTAVISNQVNLIINWMRVGFVHGVMNTDNTLVSGETIDYGPCAMMDSFDFDTVFSSIDKQGRYAFGNQPNMASWNCARLAESLIPLISDDEEKAVSLLTPVIHHFSEQFNTQFTVMWSKKLGLAGAKEGDKDLVSELLTLLQAHHLDYTNTFDALTEFVNGNATIPKELIGWANKWQSRTSNDSYKTMRAANPRIIPRNHIIETILAEYNELGSSKLMSRFVKVANKPYLFSDDMAEFQEVPSNDTDYKTFCGT

SEQ ID NO: 28195 - protein, 629 aa, Deinococcus radiodurans
MNELPGTSDTPLLDQIHGPKDLKRLSREQLPALTEELRGEIVRVCSRGGLHLASSLGAVDIITALHYVLDSPRDRILFDVGHQAYAHKILTGRRDQMADIKKEGGISGFTKVSESEHDAITVGHASTSLTNALGMALARDAQGKDFHVAAVIGDGSLTGGMALAALNTIGDMGRKMLIVLNDNEMSISENVGAMNKFMRGLQVQKWFQEGEGAGKKAVEAVSKPLADFMSRAKNSTRHFFDPASVNPFAAMGVRYVGPVDGHNVQELVWLLERLVDLDGPTILHIVTTKGKGLSYAEADPIYWHGPAKFDPATGEYVPSSAYSWSAAFGEAVTEWAKTDPRTFVVTPAMREGSGLVEFSRVHPHRYLDVGIAEEVAVTTAAGMALQGMRPVVAIYSTFLQRAYDQVLHDVAIEHLNVTFCIDRAGIVGADGATHNGVFDLSFLRSIPGVRIGLPKDAAELRGMLKYAQTHDGPFAIRYPRGNTAQVPAGTWPDLKWGEWERLKGGDDVVILAGGKALDYALKAAEDLPGVGVVNARFVKPLDEEMLREVGGRARALITVEDNTVVGGFGGAVLEALNSMNLHPTVRVLGIPDEFQEHATAESVHARAGIDAPAIRTVLAELGVDVPIEV

SEQ ID NO: 28196 - protein, 750 aa, Coccidioides immitis RS
MMSKLERRNQARQKQRLKRQVKAEAISIFSGQNGAPRHVAVVPVSNQVDPNAAISSLNESVDVTDGSAHGDLLRVRIDRFKQNVLYIPAKRDLISALDVCRLADFVVFVLPADETLDHDAQLLFRSVEGQGISNVVAVVQGLDKINPPKKRPQVLSSLKASINRFFPTLEKVHSLDSRQECANVSRGLCTATPRGIHWREDRSWMLIEDIQWPETRDECGQVSVTGIVRGKGLKADRLVHVPGWGDYQVSSIVAAPLSSRNKKEDSMNVDDDREVQILNEPTADADDLAIVAPEDVFMDDEMVSMADTERKGVLLDDHHYFSDEEEEEVSRRPRRLPKGTSSYQAAWYLDDVSDSGSDIVDNMYDDDEEMELDDEAGPEDGVFLHDNRDAMTEAGPSEYPQSEMFLDPSPEEEAQQIEEYRASRKKEESDDLEFPDEIELHPGTLARDRLARYRGLKSLKTSIWETEEDRAHEPENWRRLLQIADYKGSRNQCIREALAGGVAPGTRVKVLLRDVPLAVRQRCPEPLALFSLLRHEHKHTVVNINMTLNSNVEEPIKSKDELIIQYGPRRLVINPLFSAPGTTPNNVHKFDRYLHPGRNTVATYIGPIAWGSIPVLVFRNTSVPDPEVLDGNDTSSTINALQLIATGTTMAPDHGRVVAKRVILTGHPFKIHRKVVTVRYMFFNAEDVNWFKALQLWTKRGRSGYIKESLGTHGYFKATFDNKINPQDAIGISLYKRVFPREAKQWTGEN

SEQ ID NO: 28197 - protein, 434 aa, Aspergillus nidulans FGSC A4
MGPVSVMVAGEKRIGAVRSKHRVFIVCGVLVIQLASSNLQTTVQGDRKASEEALSPDSQQQSKKTRTDSPERELKPPLRIVPFPEKPAVLEERRGEIEFRVVNNDGSRDSFIVLTGLKCIFQKQLPKMPKDYIARLVYDRSHLSIAIVKHPLEVVGGITYRPFNSRRFAEIVFCAISSDQQVKGYGAHLMSHLKDYVKATSDIMHFLTYADNYAIGYFKKQGFTKEIQLDRSIWMGYIKDYEGGTIMQCTMLPKIRYLESGRMLLKQKEAVHAKIRAFSKSHIIHPPPKEWKNGPVKIDPLSIPAIKESGWSPDMDELARQPRHGPNYNQLLHLLNDMQNHSAAWPFTQPVNKDEVLDYYEVIKEPMDLSTMEEKHEKDMYPTPQDFIKDAVLMFDNCRRYNNENTPYAKSANKLEKFMWQQIRNIPEWSVSTI

SEQ ID NO: 28198 - protein, 370 aa, Glycine max
MNSNICNWKQNQVLPTEEAKGDDTYLSALTLCFSRIFPAILNAAVDLNLFDIIAKAESSSLSASEIASLLLPNPHPQLANRLERILPVLASYSLLNCSIRTNEDGVRERLYALSPIGQYFACDNDGGSLGPLSSLFHRGYFHVLKDVKDAIMDPNNNDHFQNVHGMPPYQYMKTDEELNKLFNKALAQTGPPAMKMLLKLYKGFEQVSTLVDVGGGVGETLKQIIFEYPSIKGINFDLPQVVQDAPPYPGIEHVEGDMFESVPKGDAILLKLVCHNWLDEDCVKFLRNCHKALPQHGKVIVIDYIIPEVPDSSKISMQTCVADSLMFLVTSGKERTEKEFESLCRNSGFSRFHVACRDSPSVLSVIEFYK

SEQ ID NO: 28199 - protein, 332 aa, Idiomarina loihiensis L2TR
MTEPYSYKLSVAPMLDWTDRHCRYFHRLLTRSTLLYTEMVTTGAIIFGQQDFLAFNAEEHPVALQLGGSEPAAMAECARLAQERGYDEVNINVGCPSDRVQNGSFGACLMAQPEKVAECVKAMKAVTDIPVTVKTRLGIDEQDSDDFLYELTDAVVAAGVDQLTLHARKAWLQGLSPKENRDIPELQYERVYRAQKRYPDVPVAINGGIVELHEVKQHLNQVHGVMIGRAAYQNPWLLTQLDSLSETKPAELTREAVVTAMIPYIDNHIRQGGRAWHVARHMLGLFQGMTGGKRWRQYLSVKGPRATSAEQLLYGALAFRDDHSQHVSSLTS

SEQ ID NO: 28200 - protein, 629 aa, Coprinopsis cinerea okayama7#130
MDRLIDLMNHPFLSTNLGRDVDDVPKAGLDPIYPLTLFFAMGIWLVYERYQKLHNSPLHFEISPPIAADPSWQSLPIENPSIRSHETNPDIMPPVALPGREYITCFDPATSLHLATVLADDAELISDKIDKAADAQRTWKHTSFTERRRVLRSLLKWLVDNQELCAKVACRDTGKTLIDASLGEILTTCSKLEWILNHGEAALRPEARRSNLMMSYKRSEVHYEPLGVVAAIVSWNYPLHNAWSPIMAAIFAGNGIVLKCSENVVWSTSWFVEAIQGALRVCGHDPELVQLVCCYPDQANALIQSPKIKHITFIGSETVGRKVAQAATKHLTPVTLELGGKDPAIILPGTDIPSIASILLRGVYQNMGQNCIGIERIIVHSSVYDELWAIFEEKVSRMRVGSVLAQTNEGYIPTVDGGAMINPDRFRGLEKVIHDAEEGGAQVIGGEQYNHVYLENGYYFAPTIVGPVDKSMEIANHELFAPIALFMPYDKIEEAIEIANGTKYGLGASVWGPHQDVCLKVAKKLECGMVSINDFGVFYINQDLPFGGVKASGYGRFGGPEGLRSLTNPKAIITDRWWIHTSIPKVLDYPLRSLSTSWEFSAALVRFLYGFGWRTRFAGLITVARNANK

SEQ ID NO: 28201 - protein, 117 aa, Brassica napus
  misc_feature (11)..(11): Xaa can be any naturally occurring amino acid
  misc_feature (28)..(28): Xaa can be any naturally occurring amino acid
  misc_feature (57)..(57): Xaa can be any naturally occurring amino acid
MGKKGRACVVXLGRSPRMQYHALSLACXGSIPHEAVLKHPSIHIHTMAQLRFINLLXKVPAPDIFLVQNPPFVPTLIAVKWASSWRRAAFLVDWHNFGYTLLALSLGRNNVFVSLYR

SEQ ID NO: 28202 - protein, 250 aa, Glycine max
  misc_feature (210)..(210): Xaa can be any naturally occurring amino acid
  misc_feature (234)..(234): Xaa can be any naturally occurring amino acid
  misc_feature (241)..(241): Xaa can be any naturally occurring amino acid
MDFHGGGPLRSRSSQSPSPSHSASASATSSIHKRKLVSEDHAPPFPPSSFSADTRDGALTSNDDLESISARGADSDSDSESEDAVVDDDEDDYDNDNDNDSSMRTFTASRLSNPPSAPRNTKLKTENSTVKIENSDGAKDAGAVGSGAAAAAGPVPGIVVKEDPTKIFTDNLQTSGAYTAREESLKKEEEAGKLKFVCLSNDGVDEHMVXLIGLKNIFARQLPNMPKEYIVRLXMDRSHKXSVMVIRRNH

SEQ ID NO: 28203 - protein, 184 aa, Corynebacterium diphtheriae NCTC 13129
MTVPLYADAREAIACKTRFVPDFPVPGVIFEDLTPVLADAAAFSLIVDELAKNAMRLGADFIGGLDARGFLLGSAVAYKAGTGILAIRKKGKLPPPVHSEEYSLEYGTAALELPAEGLELEDKKVVLVDDVLATGGTLDAARKLIEACGATVSGYAVVLEVDGLGGRERLNDAPLVVINESATA

SEQ ID NO: 28204 - protein, 318 aa, Prochlorococcus marinus str. MIT 9313
MAVNPQGVAAVLADLKGRDFLSCADFTAEQTVALLELSRQLKSGDRRIDLGNRVLGLIFTKASTRTRVSFQVAMARLGGQTVDLNPQVTQLGRGEPLEDTARVLSRFCDVMAVRTFAQQELLDYAHWASIPVLNALTDLEHPCQAMADFLTIQEALGSLTGQTLAYVGDGNNVSHSLMLCGALLGVNVRIGCPQGFEPLPEVIDQARNLAVADARIEVMTDPVDAVRGAQALYTDVWASMGQEQEQSQREEAFRGFCLNEDLLAHADPNAIVLHCLPAHRGEEISSGVMEGEASRIFDQAENRLHVQQALLAAVLGGL

SEQ ID NO: 28205 - protein, 435 aa, Xanthomonas campestris pv. campestris str. ATCC 33913
MMFISTRGAAPAVSLSQAIAAGLAPDGGLYVPQTLPPARTLQAGATLADTATTLLQPFFEGDALAGELAAICAEAFDFPAPLVPLATPGDYALELFHGPTAAFKDFGARFLAACLTRLRRAEDRPLTILVATSGDTGAAVAAAFHRQPGLRVVVLYPDGRVSPRQAHQLGCFGDNIQALRVAGTFDDCQAMVKQALNDGELQAQLPLSSANSISLGRLLPQMSYYAHAALQHHAGSGAALNLVVPTGNLGNGLAAILARALGVPLGQIVLASNANHVLPDYFAGDDYAPQPSVATVANAMDVGAPSNFERLRWLYDGDDAALREAFRALSVDDTAIRHTVQQRFARYGEVHCPHTATAVHVLEQLRAEGVEGGTGDWAVAATAHPAKFEAVVEPLIGRAVEIPPALAALLQRPAHAEPLAPDYLAFRQRLLADAP

SEQ ID NO: 28206 - protein, 768 aa, Yarrowia lipolytica CLIB122
MSGNNSPINAQLFPDARDVTKDALQTFVELPECTYMKGLGSSQQAEVMACDCKPGPTACDEDSGCINRLTSIECVRCCKGCQNKRFQGKKYASVDVISTEKKGFGLRATKDIAAGEFVYEYVGEVIDEPTFKERTAIYTTQGVKHFYFMMLQKGEFIDATAKGGLGRFCNHSCAPNGHVEKWVVGKRLRMGIFASRHIQRGEEVTFDYNVDRYGAEAQACYCGEKNCVGFLGGKTQTESASKVSGTLTAALGLTSRDINAILRGKKSAEDLRPRDLTVQDVSKVMASLMMNQEAWQVNLMLQRIALCTDTSVQAAVMKMHGYQIFAQILTATWGDNPLGLDDSDRVNVTLMLLRVLQKWPRITKNKISSSQIENVVKSLTSNDNSDIATIAQELLSEWANLKMAFRIPRRKIDPDGDEHSVSRGTSEEVTKESSKSEEPNDVEVVKVNKKADNNGNGVTDSPSTRSESPFTFIPTPYSNKTAPKGPKKAVKQPASPMVPPRSLPKGWQFANDPQGKVYYYNLELNIQQWDFPKASRASSPSTPKGPKGPKGPRGNRRDERRDNSETREPLSLQSQRESDLQRIIEQARLQEVKNNSEPAPSASAKPVNAQAHRLTKLLAKVVPNQVSKYDVDRERAKKCSKDIVQILVDKELKRPEPMTEISDEKAKKIKEFVKGYMGKVVKRLEEKEGGAKDFGRGRQGNRRDSERQSDRRGRQGQSDRDHSDNHGRKRKGEENQPYEAGPMYDDESAETSTETVKKPKVDMEIDLE

SEQ ID NO: 28207 - protein, 570 aa, Oceanobacter sp. RED65
MKDSQPNITSIQLLASHADYSLMNNLNCDPDATQDGIDHQPRQVFSGHYVPVKSTPIENPEYVAHSHTLFSELGLADSLTTTEDFTRLFSGDLSLVPAPMRQTGWACGYALSIYGTEYTQQCPFRTGNGYGDGRAVSVLEAVLNGQRWEMQLKGGGRTPYCRGADGRAVLRSSVREFLAQEHMHALGVPTSRSLSLYVSKTETVKRPWYSEGSHSPDPDQLVLEPVAISTRVAPSFIRVGQLELFARRARKQEHENALQELQQLVLHLIDREYKTEIDPTLDLSEKVIALASAFRQRLTKLIANWIRVGYCQGNFNSDNCAAGGFTLDYGPFGFCEIFHPLYQPWTGGGQHFSFMNQPLAAEQNFKSFCSALMPLIVDDEKAQAQLKDIENGFASVMQTEMENMWAAKLGLKTFDTELFQELMALMVETPVDYTLFFRALSSIPEDITPLIGSFYRTDEELTLRWGKWLTKWHSLIGIHSENQDKNAKLLRDKLSKAMKQVNPKYTMREWFIAPAYQQAAKGNYELVKELQTVLTHPYDEQTEKADTQYNKRKPSEFFNLGGVSFYSCSS

SEQ ID NO: 28208 - protein, 496 aa, Triticum monococcum
MARKMLKDGEAPLVADDGGTYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAEAKNDLLVYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 28209 - protein, 116 aa, Paracoccidioides brasiliensis
MVVHNLQNRASFVSAISTTSTADTSTDKKTSLVVIDCYATWCGPCKVIAPKLVEFSETYPNVTFYKVDVDECPDIAQELGVRAMPTFIFFKDGQKVDEVMGAVPQAVEAAIKKHAS

SEQ ID NO: 28210 - protein, 330 aa, Leptospira interrogans serovar Copenhageni str. Fiocruz L1-130
MLEKQFNSYNDFGNPMVMFRNRITRMAKHWKKWARKRNIECFRIYDRDIPQVPVCVDLYGPLCHISVYKNNYEISDEDRVKESEEISKIICEILSIHPNQIFWKKREPKKGKEQYEKQSEQSELFEVGENGLRFYVNLSDYVDTGLFLDHRITRDLVRKESKGKKFLNLFSYTGSFTVYAASGGATKSLSVDLSNTYSDWAEENLKLNGFSLTKHRILRADVMEWLRHERKNPDREKYDLIVVDPPTFSNSKKTNEIFDIQKNHVEVLNTLYRDFAFPGAVLFFSTNFRKFEFSKQSVLWDNLKDISKFTIPEDFRNEKIHFCWRMEKPV

SEQ ID NO: 28211 - protein, 166 aa, Paracoccidioides brasiliensis
MAPLRAGDSFPADVKFSYVPWTEEKGEITACGLPQPYDASKEWADKKVVLFSVPGAFTPSCSISHLPGYIKHLNNFKANGVDIVAVIAYNDPFVMSAWGKANNVKGDDILFLSDTDTAFSKSIGWTMGERTARYAIIIDHGTVTYAEKEPAKGVTVSSAETVLSKL

SEQ ID NO: 28212 - protein, 187 aa, Zea mays
QPVQRAHPDHSKICDLADKCVLASSGFQGDIKALHKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPARDAVTPLSESEAIDLVKDVFASATERDIYTGDKLEIVVINKVGTKREYIDLRKD

SEQ ID NO: 28213 - protein, 183 aa, Oryza sativa Japonica Group
MEKCPNWKFVWENKAPMKVQFFAWLLTKDRFPIKRNLHKKTIVPAPTCELCNSADETALHLCFQCPFAVTFWSAMNIPSQPDGKHSSDVLPVPALSQPSSSSRLRIFSGTANPTLAQEVAFYLGMELGRVKIKRFTDGGSVRGCDMFLVQATCPPPNENMMELLIMIDGRPPRILRFGRQQQH

SEQ ID NO: 28214 - protein, 434 aa, Thermoproteus tenax
MTDKWYNLSVEIHKKYNGKFATIPKVPITSMEDFAIYYSPGVAEVSRRISENVDLSFELTSRWNVIAVISDGTRVLGLGNVGSEAAYPVMEGKALIFKYLGGVDAVPLPIKARDADKFIEVVKALEPAFGGINLEDIESPKCFRILDKLSRELKIPVWHDDQQGTATATLAGLINATKIVGKKLREAQIALIGAGASNIYTARLLIAYGVKPGNIIMVDAKGILHPEREDMDSLMLENPWKYEYAIKTNAERRKGGIPEALRGADIVVAASRPGPGIIKKEWVTAMNKDPIVFALANPTPEIWPWEAKEAGAKVVATGRSDFPNQVNNSLVFPAVFRGLLDARAVTVTDEMLIAAAEELARYAEPKLSEDYILPKMTEWEVYPREAAAVAAKASELGLARKPLSYREELNIAQEIIGRSIKTMEVLINAGIIQK

SEQ ID NO: 28215 - protein, 197 aa, Haemophilus ducreyi 35000HP
MAVIPMVVEQTSKGERSYDIYSRLLKERIIFLNGEVEDHMANLIVAQLLFLEAEDPEKDIYLYINSPGGVVTAGLAIYDTMNFIKPDVATLCTGQACSMGAFLLSGGKKGKRFALPNARVMIHQPLGGARGQATDIQIQAQEILKLKEMLTRKMAEHSGQTFAKVAADTERDNFMSATEAKNYGLIDKVLTSRGEVA

SEQ ID NO: 28216 - protein, 96 aa, Zea mays
  misc_feature (14)..(14): Xaa can be any naturally occurring amino acid
  misc_feature (25)..(25): Xaa can be any naturally occurring amino acid
RIGTITLITLPGLXLIFMFFLPIAXANTIVSFLMSLATARGFFTCLVEVYIGAVSVAIFAICATVISAVVGVMIATGKSSLFPCKKKNKKIKKKKK

SEQ ID NO: 28217 - protein, 153 aa, Streptococcus oralis
EQFIRGQYRSGKIDGMKYISYRSEPNVDPESTTETCASGAFFVDSDRFRGVPFFFRTGKRLTEKGTHVNIVFKQMDSIFGEPLAPNILTIYIQPTEGFSLSLNGKQVGEEFNLAPSSLDYRTDATATGASPDPYEKLIYDVLNNNSTNFSHWD

SEQ ID NO: 28218 - protein, 141 aa, Glycine max
KFGSDVFPKNFQKGPLIGGKTLNESIPLSEQEDLIVWMRTAALPTFRKLYGRIYVDLKENDTITVTLDNYYNTYSFDGKKSLVLSTSTWLGGKNDFLGLAYLTVGGLCFFLAFAFTLLYLIKPRKLGDNNYLSWNRNSAGH

SEQ ID NO: 28219 - protein, 452 aa, Medicago sativa subsp. x varia
MKEVAPGTQDQKQPLRANSKRALSDVTYLPHKKRAILQDVTNNCGVNTKRSCLNPTEIQAKKRKVAKPAQPHVSNEVPSAAELPPFIADSKPVSSMEMRLRSSEDFRCLDDLEDNAPFRMSSNQCGTNNNLLQSQTSRISARPLSSQKKASQIVAAKKGNISELLDVSKHPDVADIDADFEDPQLCSHYAADIYDHLRVAELSRRPYPNFMETVQQDITPSMRAILVDWLVEVSEGYKLQANTLSLTVYLIDWFLSKNCIERERLQLLGITCMLIATKYEEINAPRIKDFCFIQDNTYTKEEVVKLESLVLKSSSYQLFAPTTKTFLRRFLRAAQASYKRPSIELEYLANYLAELTLMNYGFLNFLPSMVAASSVFLARWTLDQSSHPWNPTLEHYASYKASDLKATVLALQDLQLNSNDDCPLTTIRKKYTQDKLNCVAALSSPKLLETLF

SEQ ID NO: 28220 - protein, 328 aa, Triticum aestivum
  misc_feature (242)..(242): Xaa can be any naturally occurring amino acid
  misc_feature (260)..(260): Xaa can be any naturally occurring amino acid
LHRTSLYKKAGRYRSGIPGISSTHASADVCAYFGVFCAPSLDDPCARAVAGVDLNHGDLAGTLPFELGHLTDLAVLHLNSNRFAGGLPDSLPKLSLLHELDVSNNLLSGGFPQHILCLPNVKYVDIRFNNLCGPVPPAIFDKKIDALFINDNHFDFELPENLGNSPASVIVLANLRLRGCIPASVGRMGATLNELVMLNSGIRSCIPPEIGWLPELTVLLDVSFNQLPGTLPESMAGMRALXQLDVAHNELPGHIPEGLXGPLPRLANFTYSYNYFCGEPERCMALRRNDDRQNCIAGRPDQRPADQCLAFLHRPPVHCDGHGCLAQH

SEQ ID NO: 28221 - protein, 441 aa, Chlamydia muridarum Nigg
MTGKRTKEEQINRQRSHFYRDNVGVIVLCGGEGKRLSPLTCWRCKPTVSFGGRYKLIDVPISHAIASGFSKIFVIGQYLTYTLQQHLFKTYFYHGVMQDQIHLLVPERRDGSQVWYQGTADAIRQNLLYLSDSPVEYFLILSGDQLYNMDFRSIVDYAIDVQADMVIAAQPVSDKDVSRFGVLRVDDEWKLVDFYEKPQSEEILKHFRLSNAAMKKFGLDPQQGNFLGSMGIYLFRKECLFQLLLDETGDDFGKELIHRQMHRGKTVAYLYNGYWTDIGTIASYYEANMALTQRPSQNVRGFNCYDDGGMIYSKNNHLPGAIISDSKISSSLLCEGAMIESGQVSNSVIGVRGVIGQGSIFDHSIMMGSDSYVSGSVPFGVGKNCEIHKTIIDENCCIGNGVRLQNLQGHKDYDSPDGKLVVRDGIIIVPKGTKIPDNYVF

SEQ ID NO: 28222 - protein, 543 aa, Chlamydia muridarum Nigg
MSSEVKTFSKFRRYFFPIHKSEFPKFIPLLLLAFFVGFNYSLLKTTKDSLVLAGSRAGAEVIPFLKVWGIVPGAVIITMIYGWMSCRYSRGFVFCALVGGFLSFFALFACVIYPMGDALHLNGLAAKLQTILPRGARGFVVMVQYWSYSLYYVMSELWSSVVLSTLFWGIANHITSVREAGRFYALINVGLNVSSIVAGEISLWLGKHTLIPSSMAVDAWHGVLLNITLLIVAAGGLILYLYRKLDHLTEEAPVLGDGLVSEMSVAQLKQEKKRPKAKAKSLLSVLFRSRYLMGIAVVVLAYNLAIHLLEVVWKEQVCQIYSSRVEFNSYMSRITAFTGIVSALAGVFAAGQSIRRWGWTVGALITPLTMLITGGLFFGAIYAVKGDAMILGGFLGFSPLVLTAWLGGVQNVFSRAIKFTYFDQTKEMAFIPLEDDEKDYGKAAIDGVISRVGKSGGSLVYQALLIIFSSVADCMNAITIVLLLALGGWIWVVAWLGKEYSVRTAALGKARAAEEPSLQDEDESRVSSPISEPEAREEVVTTL

SEQ ID NO: 28223 - protein, 449 aa, Sorghum bicolor
MGGVLGALLHRRSGGRPPAQGTRNRHLGLTRQPSTYDATAAAAGGHRKAMLSKKYSYIPDTYTSLDQVAAALREQGLESSNLILGIDFTKSNEWTGKQSFGGQSLHRISDDAPNPYEQAISIIGKTLAPFDEDNLIPCFGFGDATTHDNNVFSFHRDNTPCHGFEEVLACYRTVVPHLRLSGPTSFAPIVEAAVDIVDRSGGQYHVLVIVADGQVTRSVDTGDGDLSPQEKRTVDSIVMASSYPLSIVLVGVGDGPWDDMRRFDDKLPARDFDNFQFVNFTSIMSRAATAQQKESAFALAALMEVPIQYKATMELGILGRSTGNAKRVSPAPPPLPNAQRQSSLRRGASNVGAAAAPRDDQVCPICLTNAKDLAFGCGHMVRTDSDISIFHDLITNAMQLQPIETKEKKNLICILIFLCIFVHASNRRAGSVGRASPDARFVDSRYDQS

SEQ ID NO: 28224 - protein, 338 aa, Oryza sativa
  misc_feature (206)..(206): Xaa can be any naturally occurring amino acid
  misc_feature (215)..(215): Xaa can be any naturally occurring amino acid
  misc_feature (272)..(272): Xaa can be any naturally occurring amino acid
MEKYGLNTDCLTLTRFFLSEQHKHKDATGELTQCLNSILTAVKALQSAVRRAGVAKLYGLAGNTNSTGDDQKKLDVLSDELFINMLKSSFTTCVLASEEDEEIIIVEKERRGKYIVCFDPLDGSSNIDCLVSIGSIFGIWKRECDDDDMEPTEKEALQPGRKMVCSGYALYGSACMIVLATDSGVNGFMYDPSIGEVILTMPDMRXEPGRNIYSXNEGSTVPWDKGSRSPFPKKNPPKGQGFPYRFVGFLAVDFAREFGFGEVLFFPFLSSXNGKFKFISESIPGGFFPKGRGVFPIGKTPVFSKTPLQSLTRFCFFYCFKKKILINFSLLSQILQIF

SEQ ID NO: 28225 - protein, 227 aa, Triticum turgidum subsp. dicoccon
GGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNG

SEQ ID NO: 28226 - protein, 211 aa, Picea sitchensis
MPELTELDKATASMTEKRKEETASSDSDSDDTIPELEDAGAPGAGGIANPIAGIDIISKAKQSRGEKKARKIMSKLGLKPVSGVNRVTIRKSKNILFVINSPDVYKNPHSDTYIVFGEAKIEDLSQQATMAAAERFKAPESAAAGTDSAAAGTTVAPIAEEEDEEGVDESGVDEKDVEIVMSQANVSRARAVRALRNNQSDIVNAIMELTM

SEQ ID NO: 28227 - protein, 309 aa, Yarrowia lipolytica CLIB122
MTSIDFTMNNGKTIPAIGLGTWKSTTEEVAGAVECALTEGGYRHIDTAFNYRNEDAVGLGIKRAMEKGVKREDIFVTTKIWVTYHDRVEENLDLSLERLGLDYVDMLLIHWPVPLNPNGNDPVYPLRPDGSRDIDESGSQPKTWKQMEAVLKTGKTKSIGVSNFSIPYLEELLKEAEVVPAVNQVELHPLLPQLELMEFCKKNNIIMTAFSPFGSVGGPLLKNELVLKLADKYETSPGGILTSYHIGNGTVVIPKSVTNSRIIENGKSAVNLSKEDLQALNDLHKTEGIHRTSKPKWGVDLGFPDFDFC

SEQ ID NO: 28228 - protein, 506 aa, Vibrio vulnificus CMCP6
MIYAQPGSDNAVVNFKSHYDNYIGGEWVKPVSGEYFDNISPVNGQAYCKVARSSAADINLALDAAHSVRYQWAKTSVTERANILLKIADRIEAHLEELAVAETWENGKPVRETLAADLPLVVDHFRYFAGCIRAQEGSAAELDANTASYHFPEPIGVVGQIIPWNFPMLMAAWKLAPALAAGCCVVLKPAEQTPTSILVLMEKIGDLIPAGVVNVVNGFGAEAGQALATSDRIAKLAFTGSTEVGNHILKCAAESLIPSTVELGGKSPNIYFPDVFDHEDAYLDKCIEGTLLAFFNQGEVCTCPSRVLVHESIYDQFIAKVAERAKSIKQGNPLDTDTQVGAQASQEQFDKILSYLEIGRQEGAKVVFGGEIAKQEDDLASGYYIQPTLLQGHNKMRVFQEEIFGPVIAVTTFKDEAEALAIANDTEYGLGAGVWTRDQNLAYRMGRNIEAGRIWINCYHAYPAHAAFGGYKKSGIGRETHKMMLNHYQNTKNLLISYDVNPLGFF

SEQ ID NO: 28229 - protein, 241 aa, Triticum aestivum
LEGPLSLIAMGTETFVTDVAFEDDVITTTVTSSGDAVVAWLRKIRYAYRWVYHKLIVGLDVEWRPSFGPGYNRAALLQLCVGRRCLIFQLLHADYIPRSLESFLADPDFRFVGVGVQDDADRLRNDHDLVVNNTVDLRGLAADGMRRPWLRQAGLKDITGAVMRANLEKPQRVRTGAWDAYRLSHEQIKYACIDAFVSFEVGRKLLTGDYYCSSDDEEEEEGVEEEDGSYYSDEYGSSEDY

SEQ ID NO: 28230 - protein, 422 aa, Deinococcus radiodurans R1
MHLLDLSALLVCVTAALAFLNVRVLHLPAAIGVTVGGLLISLLLVVLTALKVPFAQEAVELVRKIQFDEFVFQGVLSFLLFAGALSVDTHALWRLRGPVTVFALLSTALSTALVGGGTYLLLELVGLPTPLAYCLLFGALISPTDPVAVLGMLKEAHVPSRIETLVAGESLFNDGVGVVAFSVLAGVAASSAAGHGPELSAGGVLRFFLQEAGGGLLLGGFLGWLGFLALKRVDDFVTEVLLTLGVVMACTAIATHLHVSGPLAAVAAGLLMGSLTDWRPGALSSREKFDSFWHLTDELLNISLFSLLALEIVAVKFSASALLAGLIALPLVLLARSVSVVLPAAALSRAHEFEPYTRRLMIWGGLRGAISVALAFTVPAGPQRELFLVMTYVVVVFSIIVQGLTVSRLAAQAASAADPEAS

SEQ ID NO: 28231 - protein, 388 aa, Gibberella zeae PH-1
MAQRYISNNLPAQSLGSDPKELLTYALELVVRHTPPRKVYHEHHLGGLFTGYTGLAYLFLQLSELHPNLQISGQKLISWAQRYLEGDRGTLVLEKGSCGIASEKLSFQAVRVCVTKEEDHLIEFLSNMPILLGPYTSPQDDAFPSEIPYGRAGALYLLRMVRHWMPRSETLIESPLRRLTERIMSTNDDGRGNWEWHGKRYFGAAHGDIGIITQVVLSNPSLAPQLTRRMEKLLELQLPDGNWPSSVRSLKEGKNASLIQWCHGAPGFLYSLQSLRPYFPELQSRIDSAIEKGESITWRHGLLTKEPSLCHGIFGNALVLPQGAKRQHFLALATADAVEKVRRHNPDLFEPASYGHKAAVLMNYLPSAAWTWAVCEQEHPRLIMYNDV

SEQ ID NO: 28232 - protein, 573 aa, Haemophilus ducreyi 35000HP
MITGIAASPGAVFGKALVLKEEPIVLNTKKITADQIEIEKEKFFAGRAKAAAQLTAIKEKARHTLGEEKEAIFEGHLMILEDEELEEEILEFITNNLVTADFATHKIIEMQATMLAEIDDEYLKERATDLRDIGNRLLRNILNMYIVDLGDIQEEVILVAYDLTPSETAQLNLDKVLGFVTDIGGRTSHTSIMARSLELPAIVGTNNITEQVKTGDILILDAINNQIKINPSVDEISAFKAIQAKVEAEKAELVQLKDLAAETLDGHKIEVAGNIGTIRDIGGVLRNGGESIGLYRTEFLFMDRCELPDEEEQFEAYKEIVEAMQGKQVILRTMDIGGDKELPYLNLPKEMNPFLGWRAIRIGLTRREILDTQLRAVLRASAFGKLAVMFPMIISVEEIRELKAIVAELKAQLRAEGKAFDEHLQLGIMVETPSAAVNARHLAKEVDFFSIGTNDLTQYTLAVDRGNEIIAHLYNPLSPSVLNLIKQVIDASHAEGKWTGMCGELAGDVRATALLLGMGLDEFSMSAISVPHVKKLARSIHYTDAKALADEALAQPTVADVERLVNAFYAKLN

SEQ ID NO: 28233 - protein, 569 aa, Idiomarina loihiensis L2TR
MAKLNIIASAALAFSCAATTLPSNASDRITGHHFATRSEAMAPTAMAATSQPLATQVALDIMQDGGNAIDAAIAANAVLGLVEPTGNGIGGDLYAIVWDAETKKLHGLNASGRSPQSLTLDYFKENGYESIPARGVLPLSVPGAVDGWFELHDRFGELSMEKILQPAINYAESGFPVTEVIAYYMKRNAEVLKDIPGFADVFMRDGNVPEKGERFKNPDLANTYKILANEGRDSFYKGKIARTISDFVEKHDGFLSYDDLAQHSSTWVDPVSTNYRGYDLWELPPNTQGIAALQILNILEQFDIKAMGHDSPEYIHHFVEAKKLAFEDRAKYYSDPAFNDVPVQGLIDKEYGKKRAQLINSERAGRSFEPGNPPTEGDTIYLTTADKDGNMVSLIQSNYRGMGSGVTPTGLGFVLQNRGELFALDPNHRNVFEPGKRPFHTIIPAFVTKDGKPLMSYGVMGGATQPQMHAQILINLIDFDMNLQEAGDAPRILHTGSSQPTGSIMEDGGVVSLENGFSKNTRRELIKMGHTLQEALGPYGGYQAIWKDHEQDVYIGASESRKDGHAAGY

SEQ ID NO: 28234 - protein, 334 aa, Haemophilus ducreyi 35000HP
MAFNLKNRHLLSLVNHTEREIKYLLALARDLKRAKYSGTEQQTLKGKNIALIFEKTSTRTRCAFEVAAYDQGAQVTYIDPNSSQIGHKESMKDTARVLGRMYDAIQYRGFKQATVNELAKYAGVPVFNGLTDEFHPTQMLADVLTMLENCEKPLNQISYVYMGDARNNMGNSLLLIGAKLGMDVRICAPQALLPEDSLVTLCQQFAQQSNARITITDDIDLAIQGVDFIHTDVWVSMGEPLETWGERINMLMPYQVTPALMQRTGNPNVKFMHCLPAFHNSETTMGKQIAEQYPQLANGIEVIEEVFESSANIAFEQAENRMHTIKAVMVASLA

SEQ ID NO: 28235 - protein, 389 aa, Haemophilus ducreyi 35000HP
MFNPAILVLADGSTFYGKSIGYQAVSAYSIGEVVFNTAMTGYQEILTDPSYAKQIVTLTYPHIGNTGTNDEDNESNQIYASGLIIRDLPLLHSNFRATSSLSDYLIQHNIIAIADIDTRRLTRILRETGSQAGCIYIPNENESLAQAVEKAQDLAKSFGSMAGKDLAKEVTCQHRYEWQEGIWHLPTNNAGKPFNLQTTPTFHVVAYDFGIKQNILRMLAERGCKITVVPAQTSAEDILALNPDGIFLSNGPGDPEPCTYAIQSIRQLLNTQKPIFGICLGHQLLGLAVGAKTRKMAFGHHGANHPVQDLKTEHVLITSQNHGFEIDEYSLPENVIVTHRSLFDNSVQGIELTNQVAFSFQGHPEANPGPQDVAYLFDKFINAVQATKA

SEQ ID NO: 28236 - protein, 468 aa, Alteromonadales bacterium TW-7
MSQSVLDFIKENDVKFIDLRFTDTKGKEQHVSIPHHQVDEDFFEDGKMFDGSSIAGWKGINESDMVLMPVAESVKLDPFTEETTLIVRCDVVEPSTLQGYERDPRSVAKRAEDYMRSTGIADTVLFGPEPEFFLFDDVKYKSDMSGSMYKVDAVEAAWNSDKDYEGGNTGHRPGVKGGYFPCSPVDSSQDWRSATCLVLEELGQVVEAHHHEVATAGQNEIATRFNSMVLKADEIQEMKYVIHNMAHLYGKTATFMPKPIVGDNGSGMHCHQSLAKDGVNLFAGDKYGGLSEEALYYIGGIIKHAKAINAFANASTNSYKRLVPGFEAPVMLAYSARNRSASIRIPVVPSAKGRRIEVRFPDPTANPYLAFSAMLMAGLDGIKNKIHPGDAMDKDLYDLPAEEAAEIPQVASSLGEALDALSADREFLTQGGVFTDDLIDAYIALKGQEVEKLNMTTHPVEFEMYYSC

SEQ ID NO: 28237 - protein, 1248 aa, Oryza sativa
MELFYELLLTAAASLLVAFLLARLLASAATASDPRRRAPDHAAVIAEEEAVVVEEERIIEVDEVEVKSARARECVVSEGWVEVGRASSAEGKLECLPEEEEAPAKAARELVLDAVLEEREEEGQVGEERCDLAAAVAEVVGVKPHELGVEAAPGEVSDVTLEEGKVQDVGVEQHDLVAEAAPREALDTGLEKQGVPIIEAVEIKRQDDLGAEVAPSDVPEVEFEQQGVRIIEAIDVNQHHRVALAAPAEVVDAGLEERVQAIEAGSSGLTSETVPEEVLDELSEKQEEQVIEEKEHQLAAATAPVAIPGVALAETEELKEEQSSEKAVNVHEEVQSKDEAKCKLHLVDQQEGSASKVELVGRNTDNVEISHGSSSGDKMIAELTEEELTLQGVPADETQTDMEFGEWEGIERTEIEKRFGVAAAFASSDAGMAALSKLDSDVQLQLQGLLKVAIDGPCYDSTQPLTLRPSSRAKWAAWQKLGNMYPETAMERYMNLLSEAIPGWMGDNISGTKEHEAGDDAVGSVLTMTSNTINQHDSQGNEDNTGMYEGHLTSSPNPEKGAGAREPTERRTARLTKAGARRDERRTSAPRLGNRQLLWQGGNRIGLGRILYSRRLAPRQAMMRFFACGGAQRPSLPAALHLLLPSVGPVFEHHKGTAPNRFLEEAASAEDQLAIAKPESFLRSALGSWKMRRFSLHAVRYLVLWMLLRCGRELVAAVPPDGWYDYTAYTDCRGQPEPALYNGGILRFGNSDDPTGYRTTETGVFSPAFVVYNLNKTTMYTFSSWVKLEGASSALITARLALDNAGARCIGTVLARNDCWAFLKGGFVLDWPTQTSVIFFQNADKTPMKITVASGSLQPFTSDQWSMHQKDTIRKRRKRMATIHVADQQGGRVVGASVSVRQTAKDFPFGSAIASTILGNQAYQKWFVDRFNAAVFEDELKWYSTEPMSGQLRFDVPDQMLAFVRSHRVMVRGHNIFWENQDATPSWVKGLSPDDLRAAVNGRIQNLMTRYRGEFAHWDVNNEMLHYNFYEQRLGANASVEFFSVAQDADPLATLFMNEFNVIETCDDVSSTVDTYVAKLKDLRAGGAVLEGIGLEGHFLKPNIPLMRAVLDKLATLGLPIWFTEIDISNRYDAQTQAVYLEQVLREAYSHPAVTGVMLWTALHPNGCYQMCLTDWNLNNLPVGDVVDRLLQEWQTGQAAGPTDAHGAYSFSGFLGEYIVSVTYANSTSQATFSLSPGDETRHINIQI

SEQ ID NO: 28238 - protein, 637 aa, Arabidopsis thaliana
MAISTMLGSISCCPSPKGYEMVKQHSVRLKHCVFTVKSSVPVYSEGVNDGIKLHSFGNLVKKKVFLDTSKRFYFQGRWSESSGRRVETYAGVDVASAVDVINDLGFDTLTFLMVTVIIVPAFRILKASPILGFFFAGVVLNQFGLIRNLTDVKVLSEWGILFLLFEMGLELSLARLKALAKFAFGMGLTQVLLCTAAFTAFELPPNGAIGTKILEFLFHSRPDLVNIRSIDEAVVIGAALSLSSSAFVLQLLAEKGELPTRFGSATLGILLLQDIAVVPLLVILPVLESQDIGGESIWPMLAKESAKALGGLGILSLGGKFFLRRIFEVVAETRSSEAFVALCLLTVAGTSLVTQWLGFSDTLGAFLAGALLAETNFRTQIEADIRPFRGLLLGLFFVTTGTSIDMEVLFREWPNVLSLLGGLIVIKTLIITAIGPRVGLTIQESVRVGFLLSQGGEFAFVVFSLANRLGVLPNELNKLLIIVVVLSMALTPYLNQLGRKAADFLDERLDPGEKIGEDVNFDVSESIVIIGFGQMGQVLANFLSTPLVSDSDLVGWPYIGFDLNPAVVKESRKLGFPILYGDGSRPSVLQSAGVSSPKAIMIMYKGKKRTTEAVQRLRLAFPGVISLFLLPFVNKIV

SEQ ID NO: 28239 - protein, 565 aa, Shewanella sp. MR-7
MSEQKLALNEYLKTDSDYLRGTIKEGLDSSVTGSFSDGDQQLIKFHGFYQQDDRDLRNERKEQKLEPLYSFMLRARVPGGVCTPKQWLGVDEIASTLTSSNSIRLTTRQTFQYHGIPKRNLKTIIQGLDREALDSIAACGDVNRNVMCNPNPVESKLHAQAYEVAKKLSDHLLPHTRAYAEIWLDEEKLLTTEDETVEPVYGKTYLPRKFKMAVAVPPDNDVDVYTNDLGFIAVAENGELVGFNLTAGGGMGSTHGEVETFPRLADDFGFIKTEDVMKFAEAVMTVQRDWGNRTNRKRSRLKYTIVDHGYEKFKAEVEARAGVKFEPKRDVVIGDRGDRYGWVEGVDGKWHLTLFIESGRIKDVPGKSLQTGMREIAKIHKGDFRMTSNQNMIIAGVAPEDKATIEGLARKHGLLGQVLTQTRGHSIACVALPTCPLAMAEAERYFPEFIDHIDALQAKNGISDQAIVVRMTGCPNGCARPFAAEIGLVGKAPGRYNLYLGANFEGTRLNKMYRENIQEAEILAELDALFARYAVERNAGETFGNFTVRTGVVKAVIDAAKDFHG

SEQ ID NO: 28240 - protein, 268 aa, Vibrio vulnificus CMCP6
MKTELDIYQVDAFAREAFKGNPAGVCITEKPLDERLIQLIAAEMAVSETAFLSLETMNLRWFTPKAEVALCGHGTLATAHIMQQQGLLKAGEEITFDTLSGELKVKLAANKIEMDFPQSPIDFSVNIDANKLAHLGIKPEEVLCSGQFQQKDFIEITSEEALLALSPNFDALATLTGRGVVVTARSDSPIYDFISRYFAPWVGVNEDPVTGSTHCALAGYWGSKLEKDYLAGYQASARGGRIEMALLPYQRVKLIGTAVTTLKGQLLI

SEQ ID NO: 28241 - protein, 814 aa, Yarrowia lipolytica CLIB122
MMTNQPGQSPDPLFFQPHLRKHGPSHNGRLVFPHKHELHACKSPSGADHAGSSPGQPSGCTSPPVQAALRFESKIQGLLKRQCPILLLHARSTMERKASAASSVFSTASRGGGGMSSPDVAQSGGSGTSGADTTPDSEAPDQPEPCFIGINMPSADGHSSQLIVDCALEQGYDMITATITNTHYRTKVEQSITAGQLTVPPPSLDDVTIMPGGSHVHSTVVLASAWIELDAKNEATAAMSLQVLKHELAYASYCGVAFAIIPGPKSRKNVATYAHAVAAALRHSPCIQVAIHLPFAEADATQSSPHLGGHARKPSQMSDPLSIWEVWHSVRTMAGYPSSLSVALQLPRALPPLHVIDRWMAEPISFVCVSAGSFIPNPKGYPVFSKSLQQLLLRCLKLKPLTLLQEDAMAAEKFRGGEQAFLIYLRYIYARRPSPSALEKFSDGYHDFLQAPLQPLADNLENGTYEAFEQDPVKYTLYEEAIGKALVHLVREKKSATGTFMVCVAGAGRGPLVDRTIAAATTTKTQVKIVAVEKNPAAYVQLMQRNNDVWNAQGHRVEVIMSDMRTYESRSEQFFDLIISELLGSFGDNELSPESLDPIQRLLHPTRGIMIPQSYTAFAAPALSPKLYNSVLSGGPTPAQGPQQGSGGTTSSPNNSFNTPYVVMLKQVDILAQAKPLWSFAHPGNPAAFSKENIHNTRFSKTSFEIPAKACVHGIAGYFEAVLFQDVSLSTVPHTRHKSPDMLSWFPTWFPLKTPMNVPDHSEADLCFWRKTDGKVVWYEWAAETFFKPLQSGPRMRLSCSEIHNVGRESVMRL

SEQ ID NO: 28242 - protein, 136 aa, Corynebacterium diphtheriae NCTC 13129
MTNFKLITDTEWRQRLSSEEYRVLREAGTEAPHTGEYTNTTTEGIYSCRACGTELFRSTEKFNSHCGWPSFFSPLAGDKVIERTDTSHGMVRTEVICANCESHLGHVFAGEGYDTPTDLRYCINSVCLTLIPAEES

SEQ ID NO: 28243 - protein, 568 aa, Physcomitrella patens subsp. patens
MSLKELLIDPDNRLANWNESDADPCRWVGVRCLLNTSRVQMLVLPFKQLRGPISPEIGKLDQLSRLSLHSNKLYGPIPKELGNCTSLRQLYLRGNFLTGSIPTELGNLRLLAVLDLSSNGLTGSIPSSIGSLFRLTFLNVSSNFLSGDIPTNGVLKNFTSQSFLENPGLCGSQVKIICQAAGGSTVEPTITSQKHGYSNALLISAMSTVCIALLIALMCFWGWFLHNKYGKQKQVLGKVKGVEAYHGAKVVNFHGDLPYTTLNIIKKMDLLDERDMIGSGGFGTVYRLVMDDGKIYAVKRIGVFGLSSDRVFERELEILGSFKHRNLVNLRGYCNSPTAKLLIYDYLPCGNLEEFLHEPQEVLLNWAARLKIAIGAARGLAYLHHDCSPRIIHRDIKSSNILLDENLDPHVSDFGLAKLLEDKASHVTTIVAGTFGYLAPEYMHTGRATEKGDVYSYGVVLLELLSGRRPSDPSLIAEGLNLVGWVTLCIKENMQFEIFDPRIIDGAPKDQLESVLQIAVMCINALPEERPTMDRVVQLLEADTLSPCPSELSNFYRSPHSDEEARGR

SEQ ID NO: 28244 - protein, 571 aa, Gibberella zeae PH-1
MALSRSSRQAMLLGRQFGRQSSRLQISSQRRAVANLTPPHHAGAISRIQTSVDPSSEEFKENEKQMSEVMSRMQELARKIQKGGSDKARQKHIDRKKMLPRDRVTALIDPGTTFMELSPMAGYDLYPEAEVPAGGIITGVGVVEGVTCVIVANDSTVKGGTYYPITVKKHLRAQAVARENKLPCIYLVDSGGANLPHQADVFPDQNHFGRIFYNQARMSSEGIPQIAVVMGPCTAGGAYVPAMSDESIIVQEQGHIFLAGPPLVKAATGEVVSHEDLGGGKMHSSVSGVTDYLAVDDAHAVVLARRCISNLNWPKKSPETQAPKPTYLEPLHNPEELLGIATTNLRKPLPIREVIARVVDGSEFSEFKRDFGTTLVTGFAEIYGHKVGIVANDGILFAKSAVKGAHFIELCSQRGIPLVFLQNISGFMVGSESEREGIAKHGAKLVTAVACADVPKFTVVIGGSYGAGNYGMCGRAYSPRFLWMWPNAKVGVMGSEQLAAVMETVGKTVDAGLKERIEKESDATFSSARLWDDGIIPPQHTRRYLGLGLQAAMGGRNEVKAGDTKFGVFRM

SEQ ID NO: 28245 - protein, 154 aa, Chlamydophila caviae GPIC
MKTFKGVASAKDMRVAIVGACFNGPIADALVSGAQQTFLDLGGAEDMLTVVRVPGSFEIPCTLKKLLTSGVKYDAIVACGVLIKGETTHYDHIADQVSARISELSLEFNLPITFSVITAPCIDSAWQRAGIKGSNLGISGMKTALEMADLFKKL

SEQ ID NO: 28246 - protein, 419 aa, Chlamydophila caviae GPIC
MMKSEGDASASCFVPIEKAIADISEGKFVIVVDEASREDEGDLIIAGEKITVEKMAFLLKYTTGIVCASLEQERIRDLEFPPMVEDNRCRYRTAFTVSVDAAKGITTGVSAADRTKVVELLSNPNSRPEDFVRPGHFFPLAGTPGGVLKRAGHTEAALDLMRLANMQPCGVLSELVNEDHTMMRLAQIIEFAKEHEISVISISDLIAYRMLSERLVIPVSSARLPTEYGDFNIHVYESLLDGIQHIALVKGDVSGKENVLVRVHSECLTGDIMGSMRCDCGHQLRSAMEYIGLEGEGVIVYLRGQEGRGIGLGHKVRAYALQDRGYDTVDANLEIGFPVDSREYGIGAQILVDLGLTKIKLITHNPHKYFGLQGFGLEIVDRIALPIHVSEENEHYLRTKKERMGHWIDLPYAEEVNIR

SEQ ID NO: 28247 - protein, 665 aa, Zea mays
MGPAAGDGDRGPGAAAEHKVNLSARQPFVESVRTCLAETFFPDDPFRGLGSRPPAARAWGALKYFVPALEWAPRYTAGKFKYDLLAGVTIASLAIPQGISYAKLANLPPIIGLYSSFVPPLLYAVFGSSNNLAVGTVAAASLLLASIIETEVPPEENPQLYLQLFYTAAFFTGVFQTALGVFRLGLIVDFLSRSTITGFMGGTATIIILQQLKGMLGMKHFTPKTDLVSVMRSIFYYRHEIYLGVMTMATPSQIYKWRWQSLVLGICFLLLLLLSKHLRKKKPNLFWVSAIAPFLIVVIGGVFAFLVKGDEHGIPIVGDLKKGINPLSISQLTFTDKHVNTAMKAGFLSGILALAEGIAVGRSLALVKNEQIDGNKEMIAFGIMNIAGSFTSCYLTTGPFSKSAVNFHAGCRTPMSNVVMSVCILLVLLFLAPLFKYTPLVALSSIIVVAMIGLIKVREFCHLYRVDKFDFCICMVAFIGVVFFTMVIGLSASVGLSVVRALLHVARPSTCKLGSVAGGDIFRDVRHYPHARSVPNVLVLQLGSPIYFVNAGYLRERILRWAEEEENGSKIDGQDLQYVVLDLAGVTSIDNTGIGMLVEVHKSLDRKGIRIALTNPRLEVTEKLVLSGYIKDIIGEEWVFLTVKDAITACRYALQRSRSKDDGEV

SEQ ID NO: 28248 - protein, 160 aa, Oryza sativa
LCVGWLCGREAIGSGAAKKPMSRSSMAGLQFPVGRIARFLKAGKYAERVGAGAPVYLAAVLEYLAAEVLELAGNAARDNKKTRIVPRHIQLAVRNDEELSRLLGTVTIASGGVMPNIHNLLLPKKAGGGGCGCSGWMDDMLCSSSSVLGCLGVALISSRI

SEQ ID NO: 28249 - protein, 141 aa, Zea mays
MGIGEHFEGVKQHWASNFAFLDYFKKVYGRTEPLPKWSDADVDEFIASDPVYGPQLKALRESRKFALAGALVGAAHLGGVALKYSKAPHGVLLATGFGAITGAVLGSEVADHWYQLYEMDKQGANLRFIYWWEDKVSGQKS

SEQ ID NO: 28250 - protein, 444 aa, Kluyveromyces lactis NRRL Y-1140
MRRFGIRSVSNMTQQGKTGIRANKYFMGNVPKDVWTLTNEAAQAASKNEKNQGRSILNLGQGFFSYSPPKFAIEQAVSALNVPLNNQYSPTRGRPSLLKSLTDFYSPIYNETLNESNVTITTGANEGILASLVGLLNPGDEVIVFEPFFDQYISNIEIPGGKVRYVPLVAPKELSERVTIGAEWKIDFDILNKTINERTKCIILNTPHNPIGKVFTREELTQLGDICVKNNIYIISDEVYEHLYFGDEFTRIATISKEIGDLTLSVGSAGKSFAATGWRIGWVVSRNAELLSYVSKAHTRICFSSPSPFQEACAHSIDIGLHNGYFENMREEYKEKFAILTRVFDELGLPYTKPDGTYFVCVDFSKVQIPDEYPFPRELNERAKDFKLSYWLVNELGVVAIPPTEFYIKEHEKAAENLLRFAVCKDNQYLEESVERLRLLKDYL

SEQ ID NO: 28251 - protein, 227 aa, Chlamydophila caviae GPIC
MAFLILLRHGKSVWNEKNLFTGWVDIPLSQQGIDEAIHAGQVIKDLPIDCIFTSSLVRSLMTALLAMTHHSSKKIPYIIHDDEQQKLMSRIYSDEEKSMIPLYRSSALNERMYGELQGKNKKETAEEFGEEQVKLWRRSYKISPPGGESLYDTGLRTVPYFQETIFPLLKNSKNVFISAHGNSLRSLIMDIEKLSEEEVLSLELPTGKPIVYLWTGHTFERHPEPLG

SEQ ID NO: 28252 - protein, 565 aa, Alteromonadales bacterium TW-7
MSEQDKNVKLSDNERLKRESNFLRGTIEQDLKDEITGGFTADNFQLIRFHGMYQQDDRDIRPERAKQKLEPLHNVMLRARMPGGIIKPEQWLAIDKFADEKTSYGSIRLTTRQTFQFHGVLKPNIKGMHQMLNSVGIDSIATAGDVNRNVLCTTNPVESELHQEAYEWAAKISEHLLPKTKAYAEIWLNGEKAETTEEPILGSNYLPRKFKTTVTIPPNNEVDVHANDLNFVAIAEDGKLVGFNVLVGGGLAMTHGDTATYPRKADDFGFIALEDTLKIAEHVVSVQRDWGNRSNRKNAKTKYTLDRVGSDVFKAEVEKRAGVSFAPSRPYEFTHRGDRIGWVEGIDGKHHLTLFIQSGRILDYPDKPLKTGCRKIAEVHQGDMRMTANQNLIIAGVPADQKAVIEEIARNHGLIDDGDTEQRKNSMACVALPTCPLAMAEAERYLPSLIEKTEALLAKHGIPDDSIIMRVVGCPNGCGRAMLAEAGLVGKGPGKYNVYLGGNLEGTRIPKLYLENVGEDVYLEAFDKLIGQWASERSDGECFGDFVIRKGIVAEVKVSVTDFHA

SEQ ID NO: 28253 - protein, 221 aa, Brassica napus
MEDLRVNSQSSLSDVDDLSRLLDRPRLNIERKRSFDERSFSEMGIMDSGINSPGGRSGWETPASSTRNSFEPHPMVAEAWDALRRSLVHFRGQPVGTIAAYDHASEEVLNYDQVFVRDFVPSALAFLMNGEPEIVKNFLLMTIQIQGREKRIDRFKLGEGAMPASFKVIHDPIKKTDTVIADFGESAIGRVAPVDSSFWWIILLRAYTKSTGDLSLADTPE

SEQ ID NO: 28254 - protein, 154 aa, Aspergillus nidulans FGSC A4
MGRGSKSDNSGTIDRDEFLSLPQVSTNPLATRMIAIFDEDGGGDVDFQEFVSGLSAFSSKGNKEEKLRFAFKVYDIDRDGYISNGELFIVLKMMVGNNLKDVQLQQIVDKTIMEADKDHDGKISFEEFTDMVESTDVNLSMTLNADVIDSRPII

SEQ ID NO: 28255 - protein, 264 aa, Glycine max
PVPTLLCLNTIGYRAPPRVSYVGPPPLGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNALSETGGIPIGIGKNSHIRKAIIDKNARIGENVKIINFDNVQEAVRETEGYFIKSGIVTVIKDALIPSGTII

SEQ ID NO: 28256 - protein, 125 aa, Picea sitchensis
MAEGNVFACHSTEAWRSKLQEAIDTKRLVAVDFTATWCGPCRVIGPVFVELSKKFPEIFFLKVDVDELRDVAQEWDVEAMPTFIFIKDGKAVDKVVGAKKDDLERKVAALAAAATTTEATLPAQA

SEQ ID NO: 28257 - protein, 635 aa, Corynebacterium diphtheriae NCTC 13129
MSILEHISSPADVKTLSYEQLDTLASEIREFLVEKVSATGGHLGPNLGVVELTLAIHRVFSSPSDPIIFDTSHQSYVHKILTGRAGAFDTLRQKDGLSGYTSRAESNHDWTESSHASASLSYADGLAKAFQLKGEKARNVVAVVGDGALTGGMCWEALNNIATGTERNVVVVVNDNGRSYSPTIGGFADNLAALRMKPSYDRVMEQGKTTLKSLGWVGERTFEALHAFKEGVKSSVIPTEMFPELGMKYIGPVNGHNTKAVEAALRYGRDHKGPLIVHVVTEKGKGYAPAENDVAELMHSTGVINPKTGEPVGTKSPGWTSVFSKELVKAGETRKDIVAITAAMAGPTGLSAFGEKFPDRLFDVGIAEQHAMTSAAGLALGGLHPVVAIYSTFLNRAFDQLLMDVGLLNLPVTIVLDRAGVTGSDGASHNGVWDFAVAGIVPGIRIAAPRDDENLKELFAEALTIDSPTVVRFPKGELPSRLSAQQRFDDGAELLHYSDSDHEDSTPSILVVAVGSLVSSVMEIVSDIEECGCNVTVVDPRWAVPVAPSIVGLAADHELVITVEDGIIHGGVGAMINEALNASEIDVPVRNLAFPEVFPEHQSRNQLLDAVGLSPRGIKTQIIAAAESLYLLDKE

SEQ ID NO: 28258 - protein, 71 aa, Picea sitchensis
MIIPVRCFTCGKVIGNKWDTYLDLLQADYTEGDALDALGLVRYCCRRMLMTHVDLIEKLLNYNTLERSETN

SEQ ID NO: 28259 - protein, 327 aa, Thiobacillus denitrificans ATCC 25259
MGREELCLFSLNASRGLGERIAARLGQPLAEHEEREFEDGEHKARPLESVRGRDVYVVQSLHGEPGSSANDKLIRLLFFIATLKDASAARVTAVVPYLAYARKDRRSKPRDPVGSRYVAQLFESLGTDRIVSLDVHNLAAYQNAFRIPVEHLEARPLFVAHFAPAFANDDVVVVSPDVGGAKRAEALRASLSRRIGRPAGMAFIEKYRSGGIVSGEAVVGDVDGKHVLIVDDLVSSGTTLARAAAACRSRGATRVLAVATHGVFGGDAVRTLGDSALDALVVTDSIPTSHLPPPLGERVEILDIAPLFAEAIRRLHEARSLGDLLGD

SEQ ID NO: 28260 - protein, 403 aa, Oceanobacter sp. RED65
MTQSIAPPADLPLDSILPDEPLLLMGAGPVPVSQKVATANTVVINHLGDTMNQVIERVRLMAQYVFQTASPHILGVAGPGSAAMEMAITNLVWPGKKVLCIQNGFFSGRLAEMATRCGGDVDILRCEDGEGVKLEQVQQALAEKQYDVLTLVQGETSNTVCNHELADVCKYAHEQGLFTIVDAVCTLSTMPLEMDAWHVDVVITGGQKGLASIPGVSLIAFSERVWPYMMDRDVNMPHWCFDVRLAKQFWEEKGYHYTAPVSGILALHEALRQVCLETLDRRFNRHRLCSQALQQAIEAMGLSLYVEPHSRLNSVVGINLPDGVEGKQLLNTMSQLYKVEISGSFGLPIVRIGQMGEQSRAHNLFRTLHALGMSMKSCGGNVDLPAAMAALERGLDRSSALTA

SEQ ID NO: 28261 - protein, 208 aa, Physcomitrella patens subsp. patens
FKRKKSKTVLLVGLNGAGKTALFYQLRDGTTHQGAVTSMEPNADTFILHSETSKKGKVKPVHVVDVPGHPKLRPQLEELLPKSCCLVFVVDALDFMPHVRAAAEYLYELLTNKEVVKRRIPILLTCNKMDKITAHSSNFIKGQLEKELNKLRKSRTSVSAADVSSEISLGVQGEVFNFTQCSNKITIAEVSALTGKVEQVEQFIREYV

SEQ ID NO: 28262 - protein, 437 aa, Candida glabrata CBS 138
MAVSKVYARSVYDSRGNPTVEVELTTEKGVFRSIVPSGASTGIHEALEMRDGDKSKWLGKGVENAVKNVNDVIAPAFVKANVDIKDQKAVDDLLLSLDGTANKSKLGANAILGVSMAAARAAAAEKNVPLYQHLADLSDSKTSPFVLPVPFLNVLNGGSHAGGALALQEFMIAPTGAKSFREAMRIGSEVYHNLKSLTKKRYGSSAGNVGDEGGVAPDIQTAEEALDLIVDAIKAAGHEGKVKIGLDCASSEFFKDGKYDLDFKNPNSDASKWLSGPQLADLYHSLVKKYPIVSIEDPFAEDDWEAWSHFFKTAGVQIVADDLTVTNPKRIATAIEKKAADALLLKVNQIGSLSESIKAAQDSFAAGWGVMVSHRSGETEDTFIADLVVGLRTGQIKTGAPARSERLAKLNQLLRIEEELGDKAVYAGDNFHHGFKL

SEQ ID NO: 28263 - protein, 277 aa, Corynebacterium diphtheriae NCTC 13129
MDSLREYAELAAIAAEVACQASDHIRRTMRELGDVTAGMETKSSDVDPVTIVDKAAEHFIADALSHLRPGDGLLGEEGAESSSSTGITWIVDPIDGTVNFIYGIPQYAVSVAACIGENVVAGAVINVAISDLYVAACGSGAFVLRSDSDALKSIEASKCSDLQHALIATGFSYSSPRREDQAKLLVSLLPNVRDIRRFGSAALDLCAVAEGCFDGYYEHGLNAWDFAAGALIAQEAGAKIKQPELKLASSAGALLLASSSPIFRELELQFYPFDMRK

SEQ ID NO: 28264 - protein, 159 aa, Idiomarina loihiensis L2TR
MKIRVGHGYDVHRWGSDKPLILGGVEIEHHQGLVAHSDGDVVLHAVTDAVLGALALGDIGQHFPDTDERYAGADSAELLSHAVSLCQEKEFKTGNIDVTIVAQAPKMAPHIDDMRSSIAQCLKTCIDNVNVKATTTEKLGFVGREEGIACHAVVLMESF

SEQ ID NO: 28265 - protein, 548 aa, Rhodospirillum rubrum ATCC 11170
MPRCDPRDGDTPRHDALAALQSGEVFDLLVIGGGATGCGIALDAAGRGLRTALVERFDFAEGTSGRSTKLVHGGVRYLEAAVRHLDSAQYHLVRDALRERWAFLANAPHLCDRLSLITPLYSWAEVPYVYAGLTLYDLLSGKRSLGRSRLIGRAEALARCPMLKAEGLKAAVLYYDGQFVDTRMTIALAMTARRDGAVVANHVALEALIHDDAGTVVGARLRDGLDGASWPIAAKVVINATGPFADHLRKMDDPGAKPILRASSGVHIVLEGRFAPPDGGVLIPKTDDGRVLFILPWQGHALVGTTEGESEVVDHPPAKAVDVAYLLGHLRRSLALDVSEGDVLSVWAGVRPLVFDPEAIGTAQLARDHVIIEDPSGLITITGGKWTTYRKMAEQAVDRAVARGGLAPARPCATVSRKVIGGEAFKKDGAAALVGRFALAGDIARHLHRAYGDRAPLVAELAARGAGARLHPDHPHIEAEVVYAATLEAAEHGADVLVRRLTLALVDRAAARAAAPRVIALLGDLRGWDAARRAAETALLDERLSGSL

SEQ ID NO: 28266 - protein, 467 aa, Prochlorococcus marinus str. NATL1A
MSSIKIQKICCIGAGYVGGPTMSVIADKCPDLEIRVVDINKERIDAWNDLDLNKLPIFEPGLDRIISRTRGRNLFFSTEMEKSISDADMIFISVNTPTKTKGLGAGQASDLSWVEASARQVAKYAKGHTIVIEKSTLPVRTAQAIKEILKTTDKETQKNEISKTFSVLSNPEFLAEGTAIDDLEKPDRVLIGGEDSDSIDALVKIYLNWVPYEQIICTNLWSSELSKLAANAFLAQRISSINSISAFCEATGADVQEVAKAIGTDKRIGNQFLSAGPGFGGSCFKKDILNLVYLSGYFGLPEVANYWNQVVVLNTWQQDRIYKIVLEKLFGTVNGKNIAILGFSFKANTNDTRESPAIRISSDLLEEGAILSIYDPKVTFERIEEDFEKFSFNNQGIWKMATSIPEALKNVDAVIILTAWDEFFGLDWNYLASLMRSPAWVFDTRSVVNRQEVEDTGVNLWKLGEGN

SEQ ID NO: 28267 - protein, 268 aa, Haemophilus ducreyi 35000HP
MSKIPLRNADEIQKIREACKLASEVLVMIEPYVKENITTGELDRICHEYIVNQQQAISACLGYHGFPKSVCISVNEVVCHGIPSDDKKLKKGDIVNIDVTVIKDGYFGDNSKMYVVGEANIRDKRLLEVTQEALYIGIRTVKAGIRLKEIGKQIQRYVEKQGFSVVREYCGHGIGTEFHCDPQVLHYHSDDGGVVLQAGMAFTIEPMVNAGKKEIRLMNDGWTVKTKDRSHSAQYEHQIVVTQDGCEIMTIREEEIASGRVSRIMHNN

SEQ ID NO: 28268 - protein, 518 aa, Actinobacillus pleuropneumoniae serovar 1 str. 4074
MISEKDKTRLFKQNFASGLVVFLVALPLCLGIALASGAPPLSGVVSGIIGGIVIGALSSSHISVAGPAAGLVAIVLAAITQLGSFELFLCAGIIAGVIQLSLGFLRAGSITNYIPIAVIEGMLAGIGILIIFSQLPYALGNKQFFQELSQSFINIHLGSFSIALLSLFLMLGWDSSPTLKKIKMLPSALIAVIISICLNRLFIGMDSSLAIPATQLVQLPIPNSWAEMSDLIRFPDFAGFSSSIVWVTGATMAIVASIETLLSIEAADRLDSKRRITDTNQELRAQGVGNIVSSVLGGLPITAVIVRSSANANAGATHKLSSIIHGVLLLVCVLAIPSILNQIPLATLSAVLILVGYKLARPTVFKHFWHKGIYQFIPFVATAAAVVAFDLLKGVGLGLVISIIFLLQGNMKRAYYLSREELEDASYIKMQLSEEVSFLNKAAIKKTLKNIRPNSKVIIDASRTSYIASDVLELIEDFANITARENHIRVYLKGFKSDYNNQEIDHASHVKVEHGSRI

SEQ ID NO: 28269 - protein, 752 aa, Arabidopsis thaliana
MAAGRNIRYPDHELRDQESNSRFSRRDSAYANEDYNHVRNGAIDNGKGRVSNLRHGDRDRIKSGARQEENKMVSSGFRLSKSNPGSREVFIDLGPKRCGFSARSVDREPGELSSESGSDDLIESESLAKVNGVVKEVENRAQSPVEKKRKFSPIVWDRDDHERSNLSRNEKPVEVTPLPPPPPLVKRSSQSPSVSCGGNSHYSPAKSDMHQDPVEVGVSAVSMPALSPSVEMSSLCVVEQSSNAEQDDKQEHATHLEEDENMPTRHISSSRWAAGNSSPTDEVEIVEEVGEKKRRKKPFPVQGRFRNTSQTPEVGELVREGYRSSDSDERGHHSLPGSRDDFEERDAVKSDKMEIDEEEHRRENSVDSLSETDSDDEYVRHETPEPASTPLRSINMLQGCRSVDEFERLNKIDEGTYGVVYRAKDKKTGEIVALKKVKMEKEREGFPLTSLREINILLSFHHPSIVDVKEVVVGSSLDSIFMVMEYMEHDLKALMETMKQRFSQSEVKCLMLQLLEGVKYLHDNWVLHRDLKTSNLLLNNRGELKICDFGLARQYGSPLKPYTHLVVTLWYRAPELLLGAKQYSTAIDMWSLGCIMAELLMKAPLFNGKTEFDQLDKIFRILGTPNESIWPGFSKLPGVKVNFVKHQYNLLRKKFPATSFTGAPVLSDAGFDLLNKLLTYDPERRITVNEALKHDWFREVPLPKSKDFMPTFPAQHAQDRRGRRMVKSPDPLEEQRRKELTQTELGSGGLFG

SEQ ID NO: 28270 - protein, 601 aa, Actinobacillus pleuropneumoniae serovar 1 str. 4074
MAAEGASQLTSVVALLGAAIIAVPIFKRIGLGSVLGYLAGGLAIGPFGFGLFTDSHTILHIAELGVVMFLFLVGLEMQPAHLWGLRKYIFGLGSFQVVGASIALTGLVMAFGYSWQVAFVSAAGFVLTSTAIVMQVLSERGEMTSERGRKMVSILLFEDMLIVPLLAVVAFLSPIHSTEASTPIWQKIAIAVLAMVFLFIIGTKMLNPFFKILARTKIREMMTAVALFVVLGSALLMEVSGLSAAMGAFAAGVLLSTSSFRHQLEVDIDPFKGLLLGLFFLAVGMSLDLNVVWDNLGLILSGVALMMLIKGGVIFLVARLSGSNKLDAHDRAIVMAQGGEFAFVLFAAAHAQKVIDDTVHANMTAIVVLSMVFTPLMIIASQKFIVPRLQKIDEIKPHDHIEEQNPIILVGLGRFGQVVNHLLQMTGYHPTIIELNPKLIAAMKKRGVKSYYGNGAHPDLLKAAGIQTAQMLIVVIDNPKQTLEIVKYARSVNPHIKIIARAYDRYHVYDLVQSGADIEVRETFDSALRTGKQALRELGLDADKVHEIGNMYFGKDRHSIKLMSEVYDPKIERFKNEEMYRTALEQDQEIMAEIQKILARE

SEQ ID NO: 28271 - protein, 434 aa, Chlamydophila caviae GPIC
MTNLNYEKSQLQYWQPYRTCGLLSRVSGNLLEVQGLSACLGELCRICTPKYPDLLAEVIGFHNQTTLLMSLSPMHYVALGSEVLPLRRPPSLHLSDHLLGRVIDGFGNPLDNKKSLPKTHIKPLIAPPPPPMSRQPIQEIFPTGIKAIDAFLTLGKGQRIGVFSEPGSGKSSLLSAIASGSKSTINVIALIGERGREVREYIEQHSSGLKQLRTIIVASPAHETAPTKVIAGRAAMTIAEYFRDQGHDVLFIMDSLSRWIAALQEVALATGETLAAHQYAASVFHHVSEFTERAGNNDRGSITALYAILHYPNHPDIFTDYLKSLLDGHFFLTNQGKALASPPIDILLSLSRSAKKLSRPHHYAAAEKLRALLKTYQEALDIIQLGAYTPGQDKDLDDAVKILPNIKKFLSQPLSSYCQLENTLKELEALVNLE

SEQ ID NO: 28272 - protein, 312 aa, Zea mays
MASKYVARVPSPWWAPQRRLVGSWVSVCSVKCGALGGRDVVCAAVSFRPCIDIHKGKVKQIVGSTLRDSSNDGMELVTNFESDKSPAEFAKSYKEDELLGGHVIMLGSDPASQAAALEALHAYPGGLQVGGGINLQNAMSYLNEGASHVIVTSYVLSDGKMNIERLTKLVELVGKQRLVLDLSCRKKDGRYTIVTDRWQKFSDVFVDEPALEYLAAFADEFLVHGVDVEGKRLGIDEELVELLGHHSPIPVTYAGGVSTMDDLERIKKAGKSRVDVTVGSALDIFGGDLPYKDVVLWHKKQSMVGQVSRNMW

SEQ ID NO: 28273 - protein, 334 aa, Chlamydophila caviae GPIC
MKEKIAYLGMGIWGFCLASLLANKGYHVVGWARNAELIAQLQTEKRHPQVPDVPIHPNLSFTTDMAEAVENASMIVEGVSSAGIRPVSEQLKTITNLNVPFVITSKGIEQHTGLLLSEIVVEIFGNDASQYLGYLSGPSIAREVLKGCPCSVVISAYNPDTLKKIHNAFLTPTFRVYPNSDLKGVALGGALKNIIAIACGISDGFRFGDNAKSGLVTRGLHEIRKFATIMNCRPDTLNGLAGLGDLCTTCFSSLSRNTKFGKLIAQGMTVAQAKAEIGMVVEGVYTALSAYQIAKHHKIDMPITTGIYRVLYENLDIQEGIAALLQRNTKEEYL

SEQ ID NO: 28274 - protein, 416 aa, Aspergillus nidulans FGSC A4
MAYDRSYNPEFPCCFGSWWNTVSGPERCWGRDNGGPDHPVITSRYEGIVKKLHFQADDTVPTGRALCDIEVDDAQYPEDHPPTESNAETSPPARTTIDSQPVPRPTTPLPASPAAEIPSNGAKGRYATLATPAVRGLLKQLNVNIEDVKGTGKDGRVLKEDIHRFVAMRDAPSATPSLSQDADTAVNLTHIQTQMFKTMTRSLTIPHFGYADELNINNITALRKKIANDKSDPRKITFLSFVVKAVSLALNDYPILNAKLDTSNADKPQLIMRPRHNIGIAMDTPQGLIVPNIKDVGSRSILDVAQEISRLSALGKEGKLTPADLSGGTITVSNIGNIGGTYVSPVLVPNELAILGIGRARTIPVFDDAGQVTKGEVVNFSWSADHRVVDGATMARMASKVKELIESPERMLLSLR

SEQ ID NO: 28275 - protein, 341 aa, Streptomyces coelicolor
IHPDTGLPISTSGADWTSVFGDEMLKLGKEREDVVAITAAMLQPVGLDKFAKAFPDRVYDVGIAEQHGAVSAAGLAHGGVHPVFAVYATFLNRAFDQVLMDVALHKCGVTFVLDRAGVTGTDGASHNGMWDMSILQVVPGLRLAAPRDADQVRAQLREAVVVDDAPTVVRFSKGAVGPAVPAVGRVGGMDVLRAPGTGTPDVLLVSVGALAPMCLEVADLLNKQGISTTVVDPRWVKPVDEAMAPLAERHRVVVTVEDNSRVGGVGSAVAQALRDAGVDVPLRDFGIPPRFLDHASRAEVLAEIGLTAPDIARQVTGLVARLDGRYDRAGAEVDQVEAARD

SEQ ID NO: 28276 - protein, 519 aa, Arabidopsis thaliana
MAAISVDFQLCFIFILLAIFSLFCFSAFFFKKPKDPQLQGCGLPPSPPSLPIIGHLHFLLSVPCYKSFQKLSSKYGPFLHLRAFNIPIVLVSSGSMANEVLRIQDLNFASRDSGQTPIMEKSLLFGSFGFVSVPYGDYWRFMKKLLVKKLLGSHSLEQTRLLRGKELQTFRAMLFDKAAKNETVDVGKEMMKLTNNSICRMTMGRSCSEENGEAEQVRGLVTKSLSLTKKFLIASIVGQFSKLVGISLFGKEIMEVSQRYDELLEKIIKEHEENPNNGEDRDMMDVLLEVCADDNAEFKISRNQIKALFVEIFLAGTDTSAQTIQWILAELINHPEILEKLRKEIESVVGVRRLIQETDLPNLPYLQAVMKEGLRLHPHTPILVRNATEGCKIGGYYIGQNTTMMVNAYAVLRDPDSWEYPEEFQPERFMTSPLKGKEDEKAQLALNFIPFGSGRRGCLGKNLGYIFMGVAIGTMVQGFDWRINGDKVNMEETGEMTLTMAHPLKCIPVARINPASFDP

SEQ ID NO: 28277 - protein, 110 aa, Glycine max
MASNRGQGGIQQLLAAEQEAQRIVNAAKNEKLARLKQAKEEAEKEIAEYRAQLEAEFQKKVSDSTGDSGANVKRLEQETEEKIHHLKTEAARISDDVVAMLLKYVTSVKN

SEQ ID NO: 28278 - protein, 134 aa, Zea mays
MRNETRHLLTIQGDVCRTEEDGMRVLIVENLRNPYESNLGGTNKRFKLTLNKLYAWTLVDYERVVMIDSDNIFLQNTDELFQCGQFCAVFINPCYFHTGLFVLQVCTESFVVPLVTCPDTTKICVILLEIVRAC

SEQ ID NO: 28279 - protein, 431 aa, Candida glabrata CBS 138
MTKNQKTVCIIGGGPGGLAAARVLSKDFPEAKITLIEKEEDVGGVWYYPENNKEGRVMYDYLETNLSKDLMKFSGFPFKDDVPFYPRKNQVFDYLKEYYQTYIKNHSNVDIELETEVINVDKKSDKWIVTTKHANSETVRELDFVIVSNGHFKEPKYPKDVFGLDSWLSNGKAFHSKDFYNCEFAKDKKIIVVGNGSSGSDIANQISTVAAKVYVSVTNVEDFKDKNNDPEFIVEYIPKIKSVGGDDSSVKLEDGRVIENIDYIIYATGYLYSLPFFASHISEKLLKQDQSGITNLWEQCVYKEDPTLGFLLLSIMVVPFPLAESQSTILSQVFQGNIDIATVTPSRDEVEHEKNYGHNFPKLSDIDFYRELQDILDKHGSNTFKPVVWDEVYEKKRKESAEVKQQRNEYLAKHAQKLHKENRPYYLPDNF

SEQ ID NO: 28280 - protein, 473 aa, Thiobacillus denitrificans ATCC 25259
MGSETDHDNFDAVIVGAGQAAAPLAVALGAAGWRTAVVERRHVGGSCINFGCTPTKAMAASARVAALARRAAEFGLRAGTVEVDFPAVMQRARAIVARFRRRLEASLAGADNVELIFGDAIFQDARTLIVRRPDGESRTLAAAHVFINTGTRAALPPIPGLERLPLLHDDALLALETLPPHLLVIGGGYVGLEFAQMFRRFGSEVSLIQRDEQLAPREDPDVAEALREMLVEDGVKVYLEAKILDADRGRSSDGDSIALNLKTPTGPLRLLGSHLLVATGRRPNSDDLDLAAAGVETGADGYIRVNDRLETSAAGIYALGDVKGGPAFTHIAYDDARVLKTNLLGDGGASVADRPVPYTVFTDPQLGRIGLSEREARQSGRRVLRAHLQMAQVARAIETGEARGFVKALIDADSGEILGAAALGADGGELMAMLQLAMMGRIPYSRLHDAVFAHPTLAESLNALFAAPQPLPR

SEQ ID NO: 28281 - protein, 531 aa, Acidobacteria bacterium Ellin345
MATTLTSRVEVRVPTKFSNEPLTDFSREDNARKMRSAIEKVRGELGREYDLIIGGKRIKLAKKLQSVNPSNPTEVVGVFQEAGAAEVEPAMQAALKAFETWSRTSWEERANLLFRVANMLQERKFEFSAWMVFEVGKNWVEADADVAETIDFAYFYALEALRLSQAKTPIQLPGEVNTLKYIPLGVGAVIPPWNFPCAIMAGMTMASIVCGNTVVLKPSSDSPAIAAKFMELLEEAGLPDGVVNFCTGGGRSFGGNVVNHPKTRYIAFTGSKEVGLDIHEHAAKTQPGQVWIKRTILEMGGKDSIVVDADADFDAAVEGVAQAAFGFSGQKCSACSRAIVDERIYDRFIGALRERVAKITVGDTTKNPGMGPVINESSMKKILGYVEKAQQEGGRLILGGVRDEEAGPGYFIKPTIIADVAPNATISQEEIFGPVLAVMKCRDFEEGVKIANNTEFGLTGAVYTGTQDKLDYAAQEYFAGNLYLNRKCTGAMVGAHPFGGFNMSGTDSKAGGPDYLLLFTQAKSIAEKVIR

SEQ ID NO: 28282 - protein, 181 aa, Physcomitrella patens subsp. patens
MGLTFTKLFTRLFSKQEMRILMVGLDAAGKTTILYKLKLGEIVTTIPTIGFNVETVEYKNISFTVWDVGGQDKIRPLWRHYFQNTQGLIFVVDSNDRDRVVEARDELLRMLNEDELRDAVLLVFANKQDLPNAMNAAEITDKLGLHSLRQRHWYIQSTCATSGEGLYEGLDWLSSNIANKS

SEQ ID NO: 28283 - protein, 181 aa, Physcomitrella patens subsp. patens
MGLTFTKLFQKLFSKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIANKA

SEQ ID NO: 28284 - protein, 541 aa, Oryza sativa
MAEAATTTPLLTSHEAEPSIDDVIEAYIGATGARQLLKAMLLAFAWAFDAQQVFMSVFTDAEPPWHCTGVVDAAAAAAADSGSSCSPPAASASPCALPPGTWEWDRPAETSVVSDWALNCGPALVSLPASSFFAGNLAGGFLLATLADTHLGRRKMLLLSLVTMSVAAALTAFSPNVWVYSALRFVSGFGRSMVGTSAMVLSTELDGKRWRNTVSAAGFVFFSVGFVSLPALAYTFREASWRNMYVWTSLPSLCYAVLLYLLVQESPRWLLVRGRKQEAIEAVRQIASLNGGGGGITTSSFSMLDACAVELGDGGEGMFATLHSIWERRRALRRLAAITAASFGVGMVYYGMPLNVGSLSPSNLYLSVAYNAVAELPSSILAWLLMGRWFNRRGSVVALTTASGLCSLAACVPAVVLPDGARMAAEVASFFASCTAYDMMLMYTIELFPTSVRNSAVGLVRQAVALGGVVAPVLVALGRETTSYWSSSFGVFGLAVGCLGLLVTCLPETRGRRLSDTMEEEEAAVLSSSGASDMDNNGELV

SEQ ID NO: 28285 - protein, 227 aa, Triticum turgidum subsp. dicoccoides
GGGRMYVTMDRYENDWSVVKRGWDAQVLGEAPHKFQNALEAVKTLRAEPKANDQYLPPFVIVDESGKSVGPIFDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNG

SEQ ID NO: 28286 - protein, 486 aa, Candida glabrata CBS 138
MPHSLTGTPSPGMITSNSSTQGSMSSSKDNGNGGTIAGLHYQIGKKIGEGSFGVLFEGTNIINGMPVAVKFEPRKTEAPQLKDEYRTYKILAGTPGVPQAYYFGQEGLHNILVMDLLGPSLEDLFDWCGRQFSPKTVVQVAVQMITLIEDLHAHDLIYRDIKPDNFLVGRPGQPDENNIHLIDFGMAKQYRDPKTKQHIPYREKKSLSGTARYMSINTHLGREQSRRDDMEALGHVFFYFLRGQLPWQGLKAPNNKQKYERIGEKKRTTDVYDLANGYPVQFARYLEIVRNLGFDETPDYEGYRKLLASALDDIGETMDGKYDWMELNGGRGWDLTINKKPNLHGYGHPNPPGDKSHRNRNAAKGGNHANDANHGGLDPTSYEAYQQQTQQKMLQQQQKQSQRNQNTAVDQQNYRLNNNPINNTSQPNNYKGNGGKDTNMMNGNGNGNRYNFQEQPTTTHGQTKNTQQDMHSSSSEKGFFSKLGCC

SEQ ID NO: 28287 - protein, 366 aa, Bacillus coagulans
MKMKLAVLPGDGIGPEVMDAAIRVLKTVLDNDGHEAVFENALIGGAAIDEAGTPLPEETLDICRRSDAILLGAVGGPKWDHNPASLRPEKGLLGLRKEMGLFANLRPVKAYATLLNASPLKRERVENVDLVIVRELTGGLYFGRPSERRGPGENEVVDTLAYTREEIERIIEKAFQLAQIRRKKLASVDKANVLESSRMWREIAEETAKKYPDVELSHMLVDSTSMQLIANPGQFDVIVTENMFGDILSDEASVITGSLGMLPSASLRSDRFGMYEPVHGSAPDIAGQGKANPLGTVLSAALMLRYSFGLEKEAAAIEKAVDDVLQDGYCTGDLQVANGKVVSTIELTDRLIEKLNNSAAGPRIFQ

SEQ ID NO: 28288 - protein, 66 aa, Pyrobaculum aerophilum str. IM2
MIIPIRCFTCGKPLGHLYAVFKRRVLAGEHPGRVLDDLGVTRYCCRRTLMAHVEWIDDVLLYERRS

SEQ ID NO: 28289 - protein, 287 aa, Neisseria gonorrhoeae
MFEPLWNNKYIESVQLTIAEQLGVEERGEFYDITGALRDMVQNHLMQMLCMTAMEAPASLDADAVRDEKVKVIKSLKPLTIESVNENVVRGQYTAAKGMNGYLEEINVPQDSFTETYVAIKAEIENERWKGVPFYLRTGKRMAGKVAEIVLNFRPLQNHIFDNSQTAPNRLVIELQPNESVRLYTQVKTPGAGNKVEVTPLGVDLGKAVEGRRAEAYERLLLDVINGKLALFNRRDELEAAWEYVMPILENWANNTTPPHGYGAHSWGPEAARELLARDGNKWHEEQ

SEQ ID NO: 28290 - protein, 306 aa, Cryptococcus neoformans var. neoformans B-3501A
MEYSEIFDFAYGLAEKASKIILDASAKRWISTADLNEKKNSVDLVTETDELVERMIKSAVAKKYPQHKFIGEESYAAGDRPPLTDEFTWIVDPIDGTMNFVHSYPFVACSIGVAHKSRPVIGVIALPFLNQIFSARLGGGAYMNRDIPLPLTGGIPQPLSDLSRCMIGAEWGSDRGLSTFKHKASSFTKLAGDPSKGVDGGVMVHALRTTGSTACNAVAVAAGQLDIYWMLSLGCLPIILNETGGFFAGGKDSLDAPVGRIMMGRRYIFVRAVPATESESSSQIQHRLARELYDVVEEWTNEDMMD

SEQ ID NO: 28291 - protein, 366 aa, Bacillus coagulans
MKMKLAVLPGDGIGPEVMDAAIRVLKTVLDNDGHEAVFENALIGGAAIDEAGTPLPEETLDICRRSDAILLGAVGGPKWDHNPASLRPEKGLLGLRKEMGLFANLRPVKAYATLLNASPLKRERVENVDLVIVRELTGGLYFGRPSERRGPGENEVVDTLAYTREEIERIIEKAFQLAQIRRKKLASVDKANVLESSRMWREIAEETAKKYPDVELSHMLVDSTAMQLIANPGQFDVIVTENMFGDILSDLASVITGSLGMLPSASLRSDRFGMYEPVHGSAPDIAGQGKANPLGTVLSAALMLRYSFGLEKEAAAIEKAVDDVLQDGYCTGDLQVANGKVVSTIELTDRLIEKLNNSAAGPRIFQ

SEQ ID NO: 28292 - protein, 616 aa, Zea mays
MASISGAAAPPSSAVCRLRLRRHLLLRPSHLRLRAPHSIADLSRSSNSAPSPARPALGSGPENGSGGVRAVEKDPIKLWERYVEWLYQHKELGIFVDVSRMGFTEEFLRQMEPRMQQAFVDMRELEKGAIANPDEGRMVGHYWLRDPALAPNSFLRNKIETALDRILAFSQDVVSGKILSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKANPAALLALCWYWASEGIGKKDMVVLPYKDSLLLLSRYLQQLFMESLGKEFDLDGNRVNQGLTVYGNKGSTDQHAYIQQLREGVHNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 28293 - protein, 505 aa, Coccidioides immitis RS
MASCARVAKALQYCCRQIRFFTPTKNMPTIMEPSKVKYAYVEEGVERLDYYVRGGYHPVKIGDEFQEGRYVIAHKLGFGRSATTWLAEDKVMKKLVALKISTAESVERTHEEQILLRLAKSRSALPGKAIVQTLLDSFTFSGPNGTHRCLVMDAARVSIHVAKDMAYHRLLQLEVARAIASQLILALQFVHAQGVVHGESKPDDTDLHAGNILLHLPPNIRSMTREQLYINGGRPDEEPVVRADGLPLDNGVPSKVVFPVLLGLGSDEIKLADSSILLTDFGEAFDPQRTQRFTAHAPVPLSPPESRFADELLSFPSDIWTLGCVIWDLFGSSPPFEAFPGSQDDITVEHVETFGKLPDQWWSKWETRGNWFDEDGHKNVKESLRQYYGNTSRSWTQRFAEINISRKSKKLEAFDTEEKKSFHDMMQSMLVLEPSERASIDNVVRLHVGHAPQTLHLIAFGTGDRAHWALFISNSTADPTGTLVHIGIRGEDVKSGDGEAELLIN

SEQ ID NO: 28294 - protein, 275 aa, Oryza sativa Japonica Group
MLVSPSPYRKYFGASGARKKTAGFLSIPQPKKPPNKTAKLARSLRAISPRDDAMATASSLFLASPVATAPTARARSTPSASPARPSLRLRRPSTLAAAAVQAEHQPAVAAAPKPPALPFRVGHGFDLHRLEPGLPLIIGGIDIPHDRGCDAHSDGDVLLHCVVDAILGALGLPDIGQIFPDSDPRWKGADSSVFMREAVKLMHEAGYELGNLDATLILQKPKISPFKETIRSNLCDLLGADPSVVNLKAKTHEKVDSLGENRSIAAHTVVLLMRK

SEQ ID NO: 28295 - protein, 176 aa, Triticum aestivum
  misc_feature (21)..(21): Xaa can be any naturally occurring amino acid
MGPTEMASSATSVAPFQGLKXSTAGLPVSRRSNGASLGSVSNGGRIRCMQVWPIKGIKKFETLSYLPPLSTEALLKQVDYLIRSKWVPCLEFSKVGFIFREHNTSPGYYDGRYWTMWKLPMFGCTDATQVINEVEEVKKEYPDAYVRIIVFDNMRQVQCVSFIAFKQPSCEESGKA

SEQ ID NO: 28296 - protein, 240 aa, Idiomarina loihiensis L2TR
MTVAMTTKVAEKITNNLAEIRQQLQILSEESPHQQSVKLLAVSKKHSLEAIKAAIAAGQMHFGENYVQEAVAKITQLKEQTTDPVQWHFIGPVQSNKTKDIAQHFDWVQSVEREKIARRLNEQRPDDSQQLNLLLQVNIDDDDNKSGLAPEQVEALAEYVMNCPKLKLRGLMTILKAGTTEDEREKSFQQMYKLYQQLQQTYGEQIDTLSMGMSGDMRQAVLEGANMVRIGTAIFGERES

SEQ ID NO: 28297 - protein, 274 aa, Idiomarina loihiensis L2TR
MNDIRNIAFIGAGNMTQSIVGGMCKSGYPADKVWVSNPSDAKLEKMKSELGVNTSNDNLEVVNNADAIVLSVKPQLMAEVCAHLRENVHNLTDKLIITIAAGIRIPKYREYLGENIRIIRVMPNTPSLVGQGMSGLVTDDSVDEADKNFVTEAFNGVGETLWVSDEDQLDILGAVAGSGPAYFFEFMDSLAKAATELGFDAEKARAMVQQTCLGAAQMAKESELSLEDLRKQVTSKGGSTAKGVEAYQDSDLHGISEKAVKAAVNRNQEMAKLF

SEQ ID NO: 28298 - protein, 205 aa, Zea mays
  misc_feature (150)..(150): Xaa can be any naturally occurring amino acid
MIGSFITGMLTLVLGYAYPAYDCYKTVELNRPEVEQLRFWCQYWILLAFLTVLERVGESFVSWLPMYSEAKLAFIVYLWYPKTRGTAYVYESFFKPYIAKHETEIDRNLLELRTRAGDMAVLYFQRVTNYAQTRSYEILQYIASQSPTQXRAHQQQQRPPPPRTRQVNPAPPPIPAWLGDLDHRKISVDQDFHLTRIAPHWSGSW

SEQ ID NO: 28299 - protein, 574 aa, Idiomarina loihiensis L2TR
MDSANTLILLCGLLLVVSILAAVASNRLGAPVLLTFLLIGMLAGEQGVLGVEFNNPDIAFFIGSAALVIILFDGGMRTHPERFRVALWPAISLATIGVALTCTLVASAAVYWFGLPWPAALLMGAILSSTDAAAVFGIFQSRGLQIKERVASTLEIESGSNDPMAVILTLTMTGAVASGSFPDWYWVGLDVIWQLIGGLTIGWLGGRLFIIAARKLPLSFSFFPLLAVACAISIYALTAKLHASGFLAVYLMGFVIGNARLPQLVHILQVQDGLAWLSQIAMFLILGLLVVPSHLMANAPVAIGIAFTLIFIARPLAVVVSLLPFSFPWREQVFISWVGLRGAVPIILALFPWLSGVPDQELYFDIAFVVVMISLIIQGWSIAPVARWLGLEVPLKAKPQQRMPLSSVPSKEALEVWLYQIDKNSPACDHTWKELKLTAPATFVGLIRDGEWLQPETQPMVEEGDGLLVAATVNDIDEVSRILASGGKGLKVSEKDFFGDFTLRGDLTLADVGSFYPLGNLDDALLSTTIADYFSQKFHRRVVIGDNIRLGDVILTVRKISDKGDIQSIGVKPV

SEQ ID NO: 28300 - protein, 412 aa, Burkholderia xenovorans LB400
MPFDVVSIIGLGYIGLPTAAAFAARRKKVIGVDVSQRAVDTINKGEIHIVEPELDMLVHAAVTQGYLRATQTPEPADAFLIAVPTPFCDGNKPDLSYIEAASRSIAPALKKGDIVVLESTSPVGATEKMSAWLAECRPDLTFPQHSGEQSDIRIAHCPERVLPGHVIRELVQNDRVIGGMTRRCGELARELYQIFVQGDCILTDARTAEMCKLSENAFRDINIAYANELSMICDRLDINVWELIRLANRHPRVSILQPGPGVGGHCIAVDPWFIVDSAPEEAKLIRAARGVNDGKPHYVIDQTKRLAARFKAPVIACLGLAFKANIDDLRESPAIDIVNQLADEKVADIVVVEPNVSVLPDALRGKVELTSLASAIEAADIVLLLVDHREFKDINRRRLQSKLLVDTRGLFA

SEQ ID NO: 28301 - protein, 171 aa, Coprinopsis cinerea okayama7#130
MRVFVTVGSTKFDALVQKVLTDEVLSALKKRGYSEIVVQCGNSFFAGHDSVGDVEHVVQRGSVTVTIWKFKPSLEEEYEKADLVISHAGSGTILDVLRRGKPMIVVPNPTLLHNHQQELADALADQGHLKASNVHGLAQAIEEFETSALVPFPQFDGTRFAKILDETMGFT

SEQ ID NO: 28302 - protein, 358 aa, Vitis vinifera
MDTFFRDLNKGFLTSDSLPSQQDILRCPFLRNINEPTNFSFASPMAFPMPVRGAKGPIFEDGPNFDMAFRVFHGRDGVVPLSGRVFLRSENFEPEQAPPQFNPLAAKAATISLSGFGLGGPFSFDSFSNKWKNQKRESKSSKKEPSSQRGDSKHEAMSNEWLETGNCPIAKSYRAVSHVIPIVAKALQPPPGMKFKCPPAIVAARAALARTAIVKNLRPQPLPAKMLVIGVLGMAANVPLGIWREHTEKFSPSWFAAVHAAVPFIAMLRKSVLMPKTAMAFTIAASILGQVIGSRAERIRMKTVASRRLNLAENSVVGSSQMTQIQVVGVQGGHCGKSVEWDPVALQVAGPSSPNVFC

SEQ ID NO: 28303 - protein, 431 aa, Vitis vinifera
  misc_feature (50)..(50): Xaa can be any naturally occurring amino acid
  misc_feature (248)..(248): Xaa can be any naturally occurring amino acid
  misc_feature (287)..(287): Xaa can be any naturally occurring amino acid
MANMNIREEARRIRSADAAAAGQQFSAKYVPFNAGPDSSESYSLDEVVYXSRSGGLLDVEHDMQALKRFDGEYWRALFDSRVGKTTWPYGSGVWSKKEWVLPEIDSDDIVSAFEGNSNLFWAERFGKQFLGMNDLWVKHCGISHTGSFKDLGMTVLVSQVNRLRKMNRPVVGVGCASTGDTSAALSAYCASAGIPSIVFLPANRISIAQLVQPIANGAFVLSIDTDFDGCMKLIREFSGGNLGNIYAXYKGFKMCHELGLVDRIPRLVCAQAANANPLYQYYKSGWXEFKPVKANSTFASAIQIGDPVSIDRAEFALKNSNGIVEEATEEELMDAMASADSTGMFICPHTGVALAALIKLRNSGVIGPTDRTVVVSTAHGLKFTQSKVDYHSKKIPDLACRFANPPVEVKADFGAVIDVLKKHLSSKTRKH

SEQ ID NO: 28304 - protein, 373 aa, Zea mays
  misc_feature (252)..(252): Xaa can be any naturally occurring amino acid
MMAAAAISGSSGHLVVSSPRFRQPLTLPSRSGRPIAAAASPVARGGVSVAAVSSPAVSAVAGKDAKQAPKDFLHINDFDKDTIMNILNRAIKVKAAIKSGDRSFQPFNGKSMAMIFAKPSMRTRVSFEAGFFLLGGHAIYLGPDDIQMGKREETRDVARVLSGYNDIIMARVFAHQDILDLAKYAAVPVINGLTDYNHPCQIMADALTMLEHVGRIENTKVVYVGDGNNIVHSWLLLAAVLPFHFVCACPKXGFEPDAKTVEVARSAGISKIEIPNDPREAVKGADVVYTDVWASMGQKEEADYRNQKFQGFPVDEPLMEIAGPQASLMHCFPPERGVEVTDGAIEAPNSIVFPQAENRMHAQNAIMLHVLGA

SEQ ID NO: 28305 - protein, 192 aa, Coprinopsis cinerea okayama7#130
MSAHIDEVHSDHSDHEHHDHEHEHEEDPTSAAALEKIQSRSERKARKALLSLGLKKVHGINRVTLRRPKNVLFVLAHPEVYKSPNSDCYIVFGEAKIEDNGGAGPLAAAQQLASASAASQQVLQDAAKDNDDDDDIPELEAAEEEGPVDETGVDPKDIELVIQQVGCSRAKAVRVLKESGGDLINAIMAASE

SEQ ID NO: 28306 - protein, 230 aa, Glycine max
MAGGDDLKLLGAWPSPFVTRVKLTLALKDLSYEDVEEDLYKKSELLLKSNPVHKKIPVLIHNGAPVCESMIILQYIDEVFAGSGPSLLPADPYECAIARFWMAYVDDKLVAPWRQWLRGKTEEEKSEGKKQAFAAVEILEGALRECSKGGGFFGGDGLGLVDVALGGVLSWMKVIEVLSGDKIFDAAKTPLLAAWVERFSELDAAKVALPDVGRLLEFAKAREAAAAPSN

SEQ ID NO: 28307 - protein, 475 aa, Physcomitrella patens subsp. patens
MESLALRSAVVATGLTSSVASQTSVQTRATVSSAFIGKSIRVNTKLNASAVPVQQKFRYVRADAGAQTAQVETVEKKASIKDVPESEFQGKVVFVRADLNVPLNDACEITDDTRIRASLPTIQHLTKAGAKVVLASHLGRPKKGPEDKFSLKPVAGRLTELLGQTVELAPDCIGAEVESKIAALKNGEVLLLENVRFYKEEEKNDSEFSQKLAKGVDIFVNDAFGTAHRAHSSTAGIAEYVGKTVAGFLLEKELAYLAGAVKAPARPFVAIVGGSKVSSKITVIESLMNVCDKVILGGGMIFTFFKADGKDVGSSLVEDDKIDLAKDLVALAKKKGVELILPVDVTAADKFSPEANTQVCSSSNIPAGWMGLDIGPKAIDQFQDALKGAKTVLWNGPMGVFEFEKFADGTTAVAKTLAGLTKEGAITIIGGGDSVAAVEKAGLADQMSHVSTGGGASLELLEGKVLPGVAALDNA

SEQ ID NO: 28308 - protein, 430 aa, Idiomarina loihiensis L2TR
MSKIVKVVGREIMDSRGNPTVEADVYLESGHMGRAAAPSGASTGSREALELRDGDTSRYLGKGVETAVANINGAIAEALSGIDAINQEAVDNIMLRLDGTDNKEKLGANAILAVSLAVAKAAALSKGIELYEHIANLNNTSGKYSMPLPMMNILNGGEHADNNVDIQEFMIQPVGAESFKEGLRMGAEVFHALKKVLQKRGLSTAVGDEGGFAPNLASNEEALQVIVEAVENAGYKMGSDITLALDCAASEFYRDGKYELSGEGKSFTAEEFADYLAELCDRYPIISIEDGLDESDWDGWKVLTEKLGSKVQLVGDDLFVTNTRILKEGIDKSIANSILIKFNQIGSLTETLAAIAMAREAGYSAVISHRSGETEDATIADLAVGTAAGQIKTGSLCRSDRVAKYNQLLRIEGDLNGQAPYRGRQEVNAG

SEQ ID NO: 28309 - protein, 374 aa, Guillardia theta
RSLLLIGVIASSSAFVPSVSLRGASPARSSLPAASRVARHGAVVATKMNTETKPEGFGASHTSFYTSAKAKDSYATLDEVLNQKMKDEGVRQVTREMLDAAVKITEALRVNLVTVADAQNSVFGDVQLGVDVIADNIMWDAAKASKVVKEAASEEEPVLVETNPNGRFTICWDPLDGSSIVDNNWAVGTMIGIWDKKTGMLGATGRDQVTSIVVLYGPRTTALVACDDGVYEFTCGAGNKWIASREKIQIKKDSKIFSPANLRCCQEDAGYDALVKHWMEKRYTLRYSGGLVPDVYQHFTKEMGVFANPTSPKSPAKLRVAFEIAPFSLLVEKAGGKTSDGVTGNSCLDIKIEAVDQRTPACLGSANEVDLFNK

SEQ ID NO: 28310 - protein, 179 aa, Brassica napus
MKKLRSYYSNVRHHQKHHHPERTRWWWILLPTLFASLFFLLFLTTGPRFLPFTRPVLLTGSEPPSFVESKIKPKPISSLPSPPRFAYLISGSAGDGESLRRTLLALYHPSNRYVVHLDRASSEEEREDLHGYIRSSSLFRRFRNVHMIEKANLVTYRGPTMVANTLHAAAILLREGAEW

SEQ ID NO: 28311 - protein, 349 aa, Nicotiana tabacum
MSEADKVVPAAAKEDEKPGSSESKRSSESASTEAQTGETRPTSAAAAGLQNPFDFSAMTGLLNDPSIKELAEQIAKDPSFNQMAEQLQKTFQGAAVEEGIPNFDSQQYYSTMQQVMQNPQFMTMAERLGSALMQDPSMSGMLENLTNPSQKNQIEERMARIKEDPSLKPILEEIESGGPAAMMRYWNDQDVLKKLGEAMGFAVVGEGATSAGVSGTDETEDANEDESVVHQCASVGDAEGLKSAIATGADKDEEDSEGRTALHFACGYGEVKCAQVLLEAGAKVDALDKNKNTALHYAAGYGRKECVALLLENGAAVTLQNLDGKTPIDVAKLNNQNEVLKLLEKDAFL

SEQ ID NO: 28312 - protein, 348 aa, Nicotiana tabacum
MSEADKVVPAAKEDEKPGSSESKRSSESASTEALTGETRPTSAAAAGLQNPFDFSAMTGLLNDPSIKELAEQIAKDPSFNQMAEQLQKTFQGAAVEESIPNFDSQQYYSTMQQVMQNPQFMTMAEQLGSALMQDPSMSSMLENLTNPSQKNQIEERMARIKEDPSLKPILEEIESGGPAAMMRYWNDQDVLKKLGEAMGFAVAGEGATSAGVSGPDETEEANEDESVVHQCASVGDAEGLKNAIATGADKDEEDSEGRTALHFACGYGEVKCAQVLLEAGAKVDALDKNKNTALHYAAGYGRKECVALLLENGAAVTVQNLDGKTPIDVAKLNNQNEVLKLLEKDAFL

SEQ ID NO: 28313 - protein, 287 aa, Neisseria gonorrhoeae
MFEPLWNNKYIESVQLTIAEQLGVEERGEFYDITGALRDMVQNHLMQMLCMTAMEAPAGLDADAVRDEKVKVIKSLKPLTIESVNENVVRGQYTAAKGMNGYLEEINVPQDSFTETYVAIKAEIENERWKGVPFYLRTGKRMAGKVAEIVLNFRPLQNHIFDNSQTAPNRLVIELQPNESVRLYTQVKTPGAGNKVEVTPLGVDLGKAVEGRRAEAYERLLLDVINGKLALFNRRDELEAAWEYVMPILENWANNTTPPHGYGAHSWGPEAARELLARDGNKWHEEQ

SEQ ID NO: 28314 - protein, 477 aa, Bradyrhizobium sp. BTAi1
MDQSLKSPPVLALDDAFHAMIEASRSAPPPSLAARLDSLRRLRTMLADNEKRLEQAISADFGHRCAVETTIAETLFLQAEIKHTLKLLPRWMAPRRIATALQFWPARNRLLPQPLGVVGIIAPWNYPLQLTLAPAIGAIAAGNRVLIKPSELTPRFAALLREVIAAHFDPTVLSVTGIEDGVAQAFAALPFDHLVFTGSTRVGRIVAEAAGRNLTPVTLELGGKSPTIVDVSADLDQAAERIAYAKLLNAGQTCIAPDYVFVPEPQRDAFADKLHRNMLQMFGTNPANNDYTSIISDRHYARLEGLLRDAIARGAKPLSATSPEDPAWKKLRKFPPTVLIGATPDMAIMQEEIFGPLLPVMTYRAADEVIRYINAHDRPLALYWFGRDDAAREAVLARTVSGGVTINDCLLHFAQMNQPMGGVGASGIGHYHGEWGFNSFSKLKPVFYRSPFNRMKDLYPPYGTSIARIEKLLRLLS

SEQ ID NO: 28315 - protein, 773 aa, Candida glabrata CBS 138
MFGGEYDHAYDANNGQRFQPPVLDAMEFEKPGSPSVGDHFLRQQISNQSLHDQYSSHMEQQQQQQQQQHNAAYGAGFTDIPQLHPSTPPHGLVQKISNGNFHPAMNQGGNIPSTSNMNNMFNTPPPTMGNNPLYSHDNNSTNLLQDNLNQARSQFSPDRYSVDSDFNNGAGNHVMANGNYNINGSQSSSPYHQPQTFYTNSNLSSGQLSAHRSSPQRQPAQPLQQTTFTQLPQPSLPPQQQQQQQQQQQQQQQQQPKFQSMVPPQQTQLQQQQQQELQNAGSYMYFERRPDLLSKSTQDKAAAVKLKVENYYQQSVKYAIERNERRVELETELGSHNWSEERNARQLASLGKKESQFLRLRRTRLSLEDFHTVQVIGKGAFGEVRLVQKKDTGKIYAMKTLLKSEMYKKDQLAHVKAERDVLAGTDSPWIVSLYYSFQDAQYLYLIMEFLPGGDLMTMLIRWQLFTEDVTRFYMAECILAIETIHKLGFIHRDIKPDNILIDIRGHIKLSDFGLSTGFHKTHDSNYYKKLLQQDEATTKNGAPNDAGDGSNNRQTMIVDSINLTMSNRQQIQTWRKSRRLMAYSTVGTPDYIAPEIFLYQGYGQDCDWWSLGAIMYECLIGWPPFCSETPQETYRKIMNFEQTLQFPEDVHISYEAEDLIRRLLTHSNQRLGRQGGADEIKSHPFFRGVDWNTIRQVEAPYIPKLSSITDTRFFPTDELENVPDSPAMAQAAKQREQMMKNGVNPNQNQVKEDLPFIGYTYSRFDYLTRKNAL

SEQ ID NO: 28316 - protein, 385 aa, Streptococcus agalactiae A909
MNKLKVNSVVERKIKSGAQLLEKKDFDTSLVNQLVQLFSQSNQFLGMAYLSPQNKGIGWLLSRQVFDFNHDYFVSLFEKSREKRQKFEKSSQTTAYRLFNQDGDNFGGLTIDFYSDYALFSWYNEFVYTNRQMIVAAFKQVYPNIKGAYEKIRFKGLDFESAHLYGQEAPESFLILENNIKYSVFLNDGLMTGIFLDQHDVRKALATNLSEGKKVLNMFSYTAAFSVAAAVGGALETTSVDLAKRSRELSKAHFDANQIVTDNHRFIVMDVFEYYKYAKRKHLSYDVIVIDPPSFARNKKQTFSVTKDYYKLIEQALDILTPGGTIIASTNAANLTVSQFKKQLEKGFGKASHNYISLQQLPEDFTVNDKDQQSNYLKVFTIKVK

SEQ ID NO: 28317 - protein, 388 aa, uncultured bacterium
GCVPSKIMIRAAHIAHLRRESPLDGGMPPTPPTILRERLLAQQQARVEELRHAKYEGILDGNSAITVLHGEARFKDDQSLIVSLNEGGERVVMFDRCLVATGASPAMPPIPGLKESPYWTSTEALVSDTIPERLAVIGSSVVALELAQAFARLGSQVTILARSTLFFREDPAIGEAVTAAFRAEGIKVLEHTQASQVAHVDGEFVLTTGQGEVRADKLLVATGRTPNTRSLALEAAGVAVNAQGAIVIDKGMRTSSPNIYAAGDCTDQPQFVYVAAAAGTRAAINMTGGDATLDLTAMPAVVFTDPQVATVGYSEAEAHHDGIETDSRTLTLDNVPRALANFDTRGFIKLVIEEGSHRLIGVQAVAPEAGELIQTAALAICNGMTVQE

SEQ ID NO: 28318 - protein, 478 aa, Aspergillus nidulans FGSC A4
MNENDENGPSTRLTRAKAAALTTDAPAANGALKKPLQTKKAATGANGTQRKRAALGDVSNVGKADNGETKDAKKATSKTGLTSKATMQSGGVQKLSRSNLSRTAVGAKDNNVKKPATEAKRPGSGSGMGSAMKRTSSQKSLQEKTIQQEEPPRKKVDIEKVVEKQAEAVSVKGDVKAGAQTEELEKPQDFVADLDTEDLDDPLMAAEYVVEIFDYLRELEMETLPNPDYIDHQPDLEWKMRGILVDWLIEVHTRFRLLPETLFLAVNIIDRFLSAEVVALDRLQLVGVAAMFIASKYEEVLSPHVANFSHVADETFSDKEILDAERHILATLEYNMSYPNPMNFLRRISKADNYDIQTRTLGKYLMEISLLDHRFLGYPQSQIGAAAMYLARLILDRGPWDATLAHYAGYTEEEIDEVFRLMVDYLHRPVCHEAFFKKYASKKFLKASIMTRQWAKKYHHLYIDSALTEPYNSIKDNE

SEQ ID NO: 28319 - protein, 378 aa, uncultured bacterium
MIPAAHVAHLRRESPFDDGMPATPPTVLRERLLAQQQGLVDELRHAKYEGILESTPAITVLRGTAHFQDGHTLSVELIEGGEREVAFDRCLIATGAGAAVPPIPGLQDTPYWTSEEALASASIPQRLAVIGSSVVALELAQAFARLGSRVTILARNSLFFREDPAIGEALTAAFRMEGIDVLEQTQASQVTHANGEFVLTTNHGELRADQLFVATGRTPNTQSLNLEAAGVLLDERGAIQIDQGMRSSAVDIYAAGDCTNQPQFVYVAAAAGTRAAINMTGGEATLNLDAMPAVVFTDPQVATVGYSEAEAQRAGLETDSRTLSLDNVPRALANFDTRGFIKLVAEAGSGRLLGVQAVAPEAGELIQTAVLAIRNRMT

SEQ ID NO: 28320 - protein, 462 aa, Chlamydophila caviae GPIC
MSTDFDCVVIGAGPGGYVAAITAAQQGLKTALIEEQQAGGTCLNRGCIPSKALLVGAGIVSQIKHAKQFGIHIDGYSVDYPTMVQRKNTVINGIRQGLEGLIRSNKITVLNGRGSLISSTEVRVKGQDTTVIKAKHIIIATGSESRPFPGVPFSSRVLCSTGILNLTELPKKLAIIGGGVIGCEFASLFNTLGVEVTIIEVADQILSVNNADISKTMLDKFSQRGIQVITRASINQLEDLGDRVKITVNDQPQEYEYVLVAIGRQFNTTDIGLDNAGVIRDERGVIPVDEMMRTNVANIFAIGDITGKWLLAHVASHQGIVAGRNAAGHNEIMDYSAVPAVIFTFPEVAMVGLSLEAAQKQNIPAKLTKFPFKAIGKAVAMAEADGFAAIISHETTQQILGAYVVGPHAASLIAEMTLAVRNELTLPCIYETIHAHPTLAEIWSESALLATNHPLHLPPPRL

SEQ ID NO: 28321 - protein, 415 aa, Clostridium perfringens SM101
MRPLADIMRPKKLEDIVGQKHIVGEGTPLSNLIKNKNMINCIFYGPPGVGKTTLANIISNYTDKKFYKINATTSSIKEIQSITSDIDNLLNFKGIILYIDELQHFNKKQQQALLEFIEDGRVILIASTTENPYFAIHKAILSRSTIFQFKPVSTEDIIIALERAVSKLEKEGYVISLEEGVLKYIGEISQGDVRKAYTILELAIKSQEKDNILLNKEYVEKLGQSNLKSDSSGDDYYNLLSALQKSIRGSDPDASIHYLARLIKGGNMDSVIRRIGVIAAEDIGLAHPNALQVVNSGIDLALKIGMPEARIILSELVIYLATLPKSNSAYMAIDDALRDLERNNSGDVPKHLKDAHYSGASNLGVGGYLYPHNYPNSYINQEYMPENMRGKEYYKPKDNKYESSIKAYWNNVKNK

SEQ ID NO: 28322 - protein, 488 aa, Mycobacterium leprae TN
MADPAGFLKYTQRELPRRRPVPLRLRDWKELYEEFDKETLRNQASRCMDCGIPFCHNGCPLGNLIPEWNDLVRRGRWHDAVERLHATNNFPDVTGRLCPAPCESACVLGINQDPVTIKQIELEIIDKAFDEGWVQPLPPQQLTGKTVAVVGSGPAGLAAAQQLTRAGHRVTVFERDDRIGGLLRYGIPEFKMEKRFLERRLDQLRAEGTEFRSGVNVGVDITADQLCADFDAVVLAGGAATWRELPIPGRELDGVHQAMEFLPWVNRVQEGDDVLGDDGQPPITAKDKKVVIIGGGDTGADCLGAVHRQGAIHVHQLEIMPRPPDARAASTPWPTYPLMYRVSPAHEEGGERVFSVNTEEFVGKNGRVHALKAHEVTMQDGRFVKVENSVFELEADLVLLAMGFVGPEKPGLLTDLGVKFTDRGNVARGADFDTSVPGVFVAGDMGRGQSLIVWAIAEGRAAAAAVDRFLMGATALPAPVKPSSLPLQ

SEQ ID NO: 28323 - protein, 267 aa, Alteromonadales bacterium TW-7
MNKLLEPCIELAERAGDAIMAIYKKDDIGQQEKSDHTPVTKADLAANDVLVAGLKALAPDIPIMSEETPIPALADRQDWQRYWLLDPMDGTGEFILESGDFAVNIALIENNHPVLGVIHWPSKGITYFASAKNGAFKREEKSDTRIYVAPPESLTLAVSRRQKIESVSQYLNSQFTTIAVGSCSLKACIVAEGKADCFLRIGPTGEWDTGASQVIVEEAGGCITDAEFNPLTYNQRESTENPDFIVMGHPDWEFQKMITPHQRASIE

SEQ ID NO: 28324 - protein, 311 aa, Bacillus subtilis
MLSYADSTNSSCMFPAFVIFYFHNTYGLEDNSSKEGKPLKIGFIGTGNMGTILIESFIESKAADPSNMTITNRTIEKALHIKNRYNSINVTESLEKLVSENEMIFICVKPLDIYPLLARALPYLRKDHILISITSPVQTEQLEQYVPCQVARVIPSITNRALAGVSLVTFGTSCGESAKAKINELMQHISQALQIESDITRVASDIVSCGPAFMSYLIQRFIDAAVSETSVSKQDAILMCKEMLVGMGKLLETELYTLPALQEKVCVKGGVTGEGIKALESGVQDMFHRVFQNTHMKYEEDISAVKKQFHV

SEQ ID NO: 28325 - protein, 362 aa, Oceanobacter sp. RED65
MSEEQELSKLRDQIDQIDQQIQQLVNDRAKCAQAVAEVKERYAQGQQIQFYRPEREAQVLRKVMDRNQGPIANEDMARLFREVMSMCLALEEPLKVAYLGPQGTFTQAAALKHFGHSVLCESQVSISDVFREVEAGTMNYGVVPVENSTEGVVTHTLDSFAGSSLQICGEVALRIHHHFLSNTDPEKITRVYSHPQSLAQCRQWLDSRWAKIERIPVSSNAEAARRAASEEGAAAIAGDAAAELYSIKVLASSIEDMPDNTTRFLIIGRDETDASGDDKTSIMVSSRNQPGALYHVLAPFHEKDISLTRIETRPSGVGTWNYNFFIDFEGHVTNENIKEVLGKVSASATEVKVLGSYPKAVL

SEQ ID NO: 28326 - protein, 248 aa, Mycobacterium sp. JLS
MSTSSGELEDLAVAAAQTGAELCLRRLGEPIIVSTKSAAGDVVTPVDRAAEEAVREILLAARPGDSVLGEELPAHTGVSGLEWVVDPLDGTTNYTRLIPYFATSVAVRRTSDGVWLAGAVTAPALGATWSAARGGGAQLRSPAQRAVLPLQLPATSARLIGTGLSYDPGRRRRQVRELGALVADYTDMRRFGAAAVDLCLVAQGSLHAFVEDDLAVHDWAAGALIAEEAGATVCRPADGDESVSARWG

SEQ ID NO: 28327 - protein, 324 aa, Mycobacterium sp. JLS
MYAIEVSETGGPEVLTHVEKEPPSPGPGQVLIKAEAIGVNFIDTYFRSGLYPREVPFVVGTEVCGTIEAIGDDVAALQVGDRVVTDKALGAYAEYTLAPADFVAYVPDGVAPAVAASSLLKGMTAHYLIKSTYPVQQGDTVLVHAGAGGVGLILTQWATSLAAKVITTVSTPQKAELSRQAGAIEVLDYPDDAQEFGARIRELTGGNGVAAVYDGVGAATFDASLASLAVRGTLVLFGGASGPVPPVDPQRLNSAGSVYLTRPSLVHYTRTPDEFSWRAGEVLDAIAKGAITVTVSEHYPLQEAERAHRDLQGRKTVGSVVLIP

SEQ ID NO: 28328 - protein, 339 aa, Listeria monocytogenes str. 4b H7858
MLELHKNGFLRLEKVVMRATAIAHTNVALIKYWGKRDEHLILPANSSLSFTVDKFYTKTTVEWDENLAQDTFILNNEQKTDAKVARFIDKMREEFGISAKAKITSENHVPTAAGLASSASAFAALALAGSSAAGRKDTKEYISRLARFGSGSASRSVFGDFVIWEKGELADGSDSFAVPFTNKLCDKMSLVVAVVSDKEKKVSSRDGMRLTVETSPFFEKWVSAAETDLEEMKQAILDEDFIKVGEITERNGMKMHATTLGAEPPFTYFQPKSLEIMDAVRELRENGIPAYFTMDAGPNVKVICERENENIVADKLSGLAKNVLICHAGKEASVVSDEK

SEQ ID NO: 28329 - protein, 268 aa, Triticum aestivum
  misc_feature (191)..(191): Xaa can be any naturally occurring amino acid
MASVTSRCSGLLLPDLRPGLAGLRSRSRPPSSPRVSLRGGRRRPRTLSCVAPPDSAEPKTDEQKVKAELGEEKPQPSSSSSSSTPQEAAAEPPVPDRGLNRRIAVLTTLAAVGLFGSQRLQLGGFSLKDLAANAVPYEEALSNGKPTVVEFYADWCEVCRELAPDIYKIEQQYKDRINFVMLNVDNTKWEXQELDEFGVEGIPHFAFLDKEGNEEGNVVGKLPRQYFLDNVVALSSGDPTIPHARAVGQYSSAEFRKVHQVADPRSHG

SEQ ID NO: 28330 - protein, 369 aa, Arabidopsis thaliana
MDKYQRVVKPKADTPIDANEIRITSQGRARNYITYAMTLLQVFNESEMCQFTIHCLVFVACWEIWFRDKGSTEVVFKAMGRAINKTVTIVELIKVFFWRFALSNSRSVVQMGRRIPDLHQNTSIGSTDITDTWEPTEEGLLPYQCPIPIELVKPMGDIDYEGREGSPGGRGRGRGRGRGRGRGRGGRGNAYVNVEHEDGGWEREQSYGRGRGRGRGRSSRGRGRGGYNGPPNEYDAPQDGGYGYDAPHEHRGYDDRGGYDAPPQGRGGYDGPQGRGGYDGPQGRRGYDGPPQGRGGYDGPSQGRGGYDGPSQGRGGYDGPSQGRGGYDGPQGRGRGRGRGRGGRGRGGGRGGDGGFNNRSDGPPVQAAA

SEQ ID NO: 28331 - protein, 447 aa, Rhodospirillum rubrum ATCC 11170
MSDFDPALAGGLSRAELEAHWMPFTANREFKANPRMVVGAEGVHYIDARGRKLYDSLSGLWCCGAGHGRREIIEAVSAQIAALDYAPAFQFGHPSSFKLANKVASLTPKGLDHVFFTNSGSESVDTALKMARAYWRLKGEPARTKLIGRAKGYHGVNFGGLGVGGIGGNRKLFGVGIDADHLPHTMLPENAFTKGCPETGAELADALEDLVALHDASNIAAVIVEPLAGSTGVLPPPKGYLQRLRAICDKYGILLIFDEVITGFGRMGAAFGADAFGVVPDIMTIAKGLTNGAVPMGAVVASGEIYRTFMENSGPDHLVEFPHGYTYSAHPVACAAGLAALEIFEKDQLAARAAALAPYFENSLHGLRGLKHIVDIRNYGLAGAVQIENAPGQPAKRPLEIGRKCWEAGYYVRFGGDSLQFGLPFFSEPAQIDGLMNAVADAVSSVA

SEQ ID NO: 28332 - protein, 499 aa, Rhodospirillum rubrum ATCC 11170
MTLVTHFINGAATAPAAGRCQDIVNPASGAVIGRVELAAKATVEAAIAAAEAAFPAWRATPPAKRARVMVRFRQLLEDNADALCALITAEHGKALDDARGELGRGMENVDYACGIADLLKGERSANAGPGIDCWSEFQPLGVVAGITPFNFPAMVPLWMIPLAIACGNTFVLKPSERDPSAAFLLAEIALRAGVPPGVFNVVNGDKEAVDTLLTDPRVQAVGFVGSTPIAEYVYATGTAHGKRVQALGGAKNHALVLADADLDFTVNALMGAAFGSAGERCMAISVVLAVGDQLADALVAKLAAQLAGLKVAPGTEAGCEMGPLVSRAHADKVAGYVAKGVAEGAELVVDGRGLSIPGHEQGFFLGGCLFDRVTPAMTIYREEIFGPVLCVVRVASMEDGMALIDAHEFGNGTCLFTRDGEAARYFADHVKVGMVGINVPLPVPVATHSFGGWKRSLFGDLAAYGPDGVRFYTRRKTVSQRWPSSTVREGAQFAFPSMK

SEQ ID NO: 28333 - protein, 287 aa, Neisseria gonorrhoeae
MFEPLWNNKYIESVQLTIAEQLGVEERGEFYDITGALRDMVQNHLMQMLCMTAMEAPAGLDADAVRDEKVKVIKSLKPLTIESVNENVVRGQYTAAKGMNGYLEEINVLQDSFTETYVAIKAEIENERWKGVPFYLRTGKRMAGKVAEIVLNFRPLQNHIFDNSQTAPNRLVIELQPNESVRLYTQVKTPGAGNKVEVTPLGVDLGKAVEGRRAEAYERLLLDVINGKLALFNRRDELEAAWEYVMPILENWANNTTPPHGYGAHSWGPEAARELLARDGNKWHEEQ

SEQ ID NO: 28334 - protein, 171 aa, Buchnera aphidicola (Baizongia pistaciae)
MSNIGRNVSGDLKEKLISVNRVSKTVKGGRIFSFSALTVVGDGHGKVGFGYGKAREVPSAIQKAMEKARRNMIQVPLNNGTLQYSVTGSYTGSYIFMKPASNGTGIIAGGAMRSVLEVAGVHNVLAKTYGSTNPINVVRATMLVLESMKSPEMIALKRNKLVKEILENSYL

SEQ ID NO: 28335 - protein, 383 aa, uncultured bacterium
VPSKIMIRAAHIAHLRRESPFDGGMPPTPPTILRERLLAQQQARVEELRHAKYEGILDGNSAITVLHGEARFKDDQSLIVSLNEGGERVVMFDRCLVATGASPAMPPIPGLKESPYWTSTEALVSDTIPERLAVIGSSVVALELAQAFARLGSQVTILARSTLFFREDPAIGEAVTAAFRAEGIKVLEHTQASQVAHVDGEFVLTTGQGEVRADKLLVATGRTPNTRSLALEAAGVAVNAQGAIVIDKGMRTSSPNIYAAGDCTDQPQFVYVAAAAGTRAAINMTGGDATLDLTAMPAVVFTDPQVATVGYSEAEAHHDGIETDSRTLTLDNVPRALANFDTRGFIKLVIEEGSHRLIGVQVVAPEAGELIQTAVLAIRNGMT

SEQ ID NO: 28336 - protein, 311 aa, Ralstonia eutropha JMP134
MALDEQARYILDMIASAGRPPLHTCTPEQARQSFDFRPLAGVPDAVAQIEEVTIPGPAGDIRVRIYTPDGEGPFPALVYCHGGGWVVGDLDTVDVPCRRLATRASCVVVSVDYRLAPEHRFPAATEDAYAAFQWLVSNARAQQVDATRIAVGGDSAGGNLAAAVALMARDRAAPQPCFQVLLYPVTDGTLDTPSYRENAEGYLLTRDSMVWFWNHYVGDADRTHPYASPLRADHHRGLPPAFVVTAEFDPLRDEGEAYARRLAEAGTPVECKRYDGTIHGFCWMPGVLDKGRQALDDTAAALAAAFQSDNR

SEQ ID NO: 28337 - protein, 147 aa, Helicobacter pylori J99
MEEINREEFQEVVVNIGRVTKVVKGGRRFRFNALVVVGNKNGLVGFGLGKAKEVPDAIKKAVDDAFKNLIHVTIKGTTIAHDIEHKYNASRILLKPASEGTGVIAGGSTRPIVELAGIKDILTKSLGSNNPYNVVRATFDALAKIKA

SEQ ID NO: 28338 - protein, 386 aa, uncultured bacterium
VGCVPSKIMIRAAHIAHLRRESPFDGGIAATVPTIDRSKLLAQQQARVDELRHAKYEGILGGNPAITVVHGEARFKDDQSLTVRLNEGGERVVMFDRCLVATGASPAVPPIPGLKESPYWTSTEALASDTIPERLAVIGSSGVALDLAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIAIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMT

SEQ ID NO: 28339 - protein, 489 aa, Sinorhizobium meliloti 1021
MQSYQIREMATPLCQPAASHFIDGTFIEDRTGPEILSVNPVDGEIIAKLHGATSCIIEKAIASAKRAQKEWARKEPAERGRVLSRAADIMRARNRELSVLETRDTGKPISETLVADAASGADCLEYFGAIAATLSGDSIQFGEDWVYTRREPLGVCLGIGAWNYPIQIAAWKAAPALACGNAMIFKPSEVTPLSALKLAEILTEAGLPPGVFNIVQGAGDVGAELATHPAIAKVSLTGSVKTGARVASAAMAGIRPVTMELGGKSALIVFDDADVEAAVSGAILGNFYSAGQICSNGTRVFLQRGIREAFLARLLARVAALKIGDPMDEETDIGPLVSAAHRNRVATYVARAEVEGAYQMAPPRKLPPGDAWHEPVVFTNVTDWMTLAREEVFGPVMAVLDFDDEQDVVARANATDFGLAAGIFTRDLVRAHRLAAELEAGTVWINAYNLTPAGMAFGGIKRSGIGRENGRVAIDHYTQLKSVFVSMQT

SEQ ID NO: 28340 - protein, 251 aa, Ralstonia eutropha JMP134
MRLQGKVAILTGAAGGIGRATALGFAREGASIVVTDINRDGAQEVADTINAAGGRAMALAHDVGCETQWTRVVDAAVEAFGTVDVLFNNAGIFVLKPLAETTLDEWNRLMAINVTGVFLGMKHVMPLMARAGKGSVINVSSVAGLVGSPRSTMYSASKGAVRAMTKGAALEYAAKGVRVNSIHPGLIDTAMADYASGTAGRSKQDLGQVMSPMGRLGTADEVGGLALFLASDESSYMNGAELVLDGGFTAA

SEQ ID NO: 28341 - protein, 253 aa, Ralstonia eutropha JMP134
MEYIDMKLKDKVAIVTGGASGIGEATVRLFASQGASVVIADRSALGEKLARELSESSLAAHYSEVDVSREDDTRRLIDDTVSRFGRLDIMVANAGIAHPSAPVEDVSVEQWQQMIDVNLTGVFLSNKLAIVQMKKQGTGGAIVNMASILGHVGMPGAASYNAAKGGVVNLTRSLGVSHAQDGIRVNAVCPGFVATPLIERATEEARARLVAAHPIGRLGHADEVAKAVLFLASDDASFIVGTSLMVDGGYCAQ

SEQ ID NO: 28342 - protein, 287 aa, Neisseria gonorrhoeae
MFEPLWNNKYIESVQLTIAEQLGVEERGEFYDITGALRDMVQNHLMQMLCMTAMEAPASLDADAVRDEKVKVIKSLKPLTIESVNENVVRGQYTAAKGMNGYLEEINVPQDSFTETYVAIKAEIENERWKGVPFYLRTGKRMAGKVAEIVLNFRPLQNHIFDNSQTAPNRLVIELQPNESVRLYTQAKTPGAGNKVEVTPLGVDLGKAVEGRRAEAYERLLLDVINGKLALFNRRDELEAAWEYVMPILENWANNTTPPHGYGAHSWGPEAARELLARDGNKWHEEQ

SEQ ID NO: 28343 - protein, 160 aa, Frankia sp. CcI3
MNTVILPRVGVGVDVHPFAAGRPCWVACLEWPGETGLAGHSDGDVAAHAACDALLTASCLGDLGRVFGTDRPEYAGASGAVLLAETARLLGAAGWAIGNVSVQVIGNRPRMAGRREDAQKAMSVALGASVSLSATTTDGLGLTGRGEGLAAIATALVIRA

SEQ ID NO: 28344 - protein, 440 aa, Clostridium perfringens SM101
MGKPKLKKEIGLFTATALVVGNMMGSGIFMLPSSLAGVSGPGSTIMAWLLTGLGSLILALTFANLGSKIPKTGGTYEYSRLAYGNFMGFMTAWLYWNGSWIGNATIFIVITTYLGEVITSLTNSSIIGFLFCSSILWICTYINIRGTKLAGRVASVITVFKVLLFIFFIVVGLIYFDPSNLTPMFPEGKGVSTIPVAASLTLWAFMGLETASVAGGEIKDPEKNVKRSTILGMLISTVLYILISVVAMGVMSQSELASSTAPISDIIVKVLNLKSLNFLNIAIAISILGTAMGWLLSTARVGYAAGEDGIFPSVFAKVHPKYNTPYVALIIGSIFINIIFLMNFTKGLAGAYSFIVVLATLSYLPIYAISTIAEIILMVKEDKKPSFKKHLGLITRCLIGFAFAIWAIYASGAEIVMYGFILILLGVPIYGYMSIKKHFR

SEQ ID NO: 28345 - protein, 153 aa, Streptococcus viridans
EQFIRGQYRSGKVDGMKYISYRSEPNVNPESMTETFASGAFFVDTDRFRDVPFFFRTGKRLTEKGTHVNIVFKQMDSIFGEPLAPNVLTIYIQPTEGFSLSLNGKKVGEEFSLAPNSLDYRTDATATGASPDPYEKLIYDVLNNNSTNFSHWD

SEQ ID NO: 28346 - protein, 211 aa, Arabidopsis thaliana
LLRENKRMLDKSIREIERERQGLQTQEKKLINEIKKTAKQGQMGAVKVMAKDLIRTRHQIEKFYKLKSQLQGVSLRIQTLKSTQAMGEAMKGVTKAMGQMNRQMNLPSLQKIMQEFERQNEKMEMVSEVMGDAIDDALEGDEEEEETEDLVSQVLDEIGIDINQELVNAPSGAVAVPAAKNKVVQAEATGAEDSGGIDSDLQARLDNLRKM

SEQ ID NO: 28347 - protein, 642 aa, Opitutaceae bacterium TAV2
MSNTITAPASTTTGANQAASTASPPPPPAPTTGDSAAPAAAPACKPLSANEGIKTASNYLRGTIVDDVLNTATGAFTPDNAQLIKFHGFYEQDDRDQRLALRKAGKERAYSVMLRVRLPGGRCTAEQWRILDDLSLKVAGKHTLRLTTRQTFQFYGVLKGDVRTLIQGLNKALLDSIAACGDVNRNVMAPPNPERHPALQEVYEHAKSWSEFALPRTRAYHEIWIDDELVAGGEPKAPPPPPSLASPQTEYTAAGIDPAQLKPGEEPLYGTTYLPRKFKVGFAIPPSNDVDVFSQDLGFIAILENEKLTGYNVTVGGGMGASHGNEATFPRLGDLIGFITPDQLKRLGAAVLTTQRDYGDRVNRRHARLKYTIEDRGIAWFKAEVERRAGFALAPARPFEFTTIQDPHGWHACADGTWFYGLHLLSGRIEDREGWPMQTALREIAQIHTGDFRLTPSQNLTISGVTAEQKPRIEAILQKHSLSRENAQSALRLNALSCVALPTCPLALSESERELPSILEKFQPVFDAAGLRDQPVSIRVTGCPNGCARPFLAEIALVGKAPGKYAVYLGGNYTGLRLNRLVAASATVEESVRLLTPVIERYATERRAGEGFGDFCDRVIVPADATTHKVGATPLTPSAATQ

SEQ ID NO: 28348 - protein, 480 aa, Idiomarina loihiensis L2TR
MSSLTKKDCFIEGHWVPTDKRFSVTNPATGEVIAEVADADEDLTQRAINVAETALKSWRKKTARERAMLLRKWYEAMMDNKQALGELMSAEQGKPVAEAVGEVEYGASFVDWFAGEAERIDGDILPNADSSKRVMVTKEPVGVCAAITPWNFPNAMITRKIAPALAAGCTIVVKPPQLTPLSSLALAQLASEVGIPDGVINIIPTSDAKSVGKRLATSPQVRKLSFTGSTGVGKILMQQCSEHVTKLSLELGGNAPFLVFDDADIEQAAEQLIACKFRNAGQTCVSANRILVQQSVAEKFTDAVVSKVKALKVGPGTEENVDLGPLIDQDAVDKVQRLVLAAKSDGATIETGGSVMTELGDLFYAPTVITGVTEEMDISEEEIFGPVVAINTFETEEEGIEKANNTPFGLASYFAAKDTARIFRVSDALEYGMVGVNTGGISHAYNPFGGIKESGVGREGSKYGIDEYLELKTVTLGGLG

SEQ ID NO: 28349 - protein, 457 aa, Idiomarina loihiensis L2TR
MNPFENTLKQLKSHFDSGLTRPLSWRLNQLQQLQRFLTENEKSLLQALKSDLNKHPSEARLTELQFLQSDIKQTIKALPKWSKPRKVGNPLLAWPATSQLIPEPLGAVLILGAWNYPLQLLLAPLIAAIAAGNCAVIKPSEHATATADLLAHQLPDYLDNAAIKLVTGSVTESQQLTALPFDHIFYTGGENAAKAIMASAAENLTPVTLELGGKSPAVVLADAPIQVAARRIIWGKFLNAGQTCIAPDYVLVEDSVKEPLIAAMQHELISFYGEDPQHSSDYGRIIHQQHWQRLTQMLEGENVVVGGDSDKSERYIAPTIVDGVKDGSALMQEEIFGPILPVITIKSAADAIEEIRRHPKPLALYVFSNNQRLLDLFTQQVSAGNVCYNDTLMFMLNDELPFGGVGRSGMGRYHGKWGFDTFSHLKPVMTRSFRFDVVLRYPPYSKLKDKILSWFSH

SEQ ID NO: 28350 - protein, 283 aa, Idiomarina loihiensis L2TR
MSESNIVNLDLQNFQQVLLEGSKEKLIIIDFWADWCEPCKQLMPVLEKLAMQYSDQVILAKINCDEQQELAAQFGIRSLPTVAFFKDGQPVDSFGGVKTEGEIQEILTKHLPSPSDDLIQQAQTAMGEGDANTAYTLAKQAYDLDNTNMQALKLLAEAAVDAGRLDQAKELVAKIPLVEQDGDYQRIKGKLELAEDAADSPELRALQEQVENTPDDLALKLQLALKFHEASRDEEALQQIFTVLGKDVNFADAKKYALDIINSLPDGDPLAATYRRKLYSTMY

SEQ ID NO: 28351 - protein, 396 aa, Buchnera aphidicola (Acyrthosiphon pisum)
MPDIGLEEVEIIEILVSINEKIAPEQGLITVEGDKTSMEIPSPISGIVKHIFIKIGEKIKTDALIMRCEVENIDFHVKKKEEICLDNNVLNKVEKNFKKDIFFHATPLIRRLARNLNINLYDVVGTGPKNRILKEDLDLYQSNIKENLIEEKNKINFGDSKKSKTKELELSDIQKNIGNNLHRNWMNIPHVTQFDEVDITILEKFRQKYNNEKRNQKKTNENITILVFIIKVVAYALEKFPIFNSSLNINNKKIILKKYINIGFAIDVNNDLFVPVLKDVNKKNIKQLSSELILLSEKARTRKLNIEDMTGGCFTISNLGGIGGSWFSPIINSPEVAILGISKSQIKPSWNGKEFIPSLMLPLSLSYDHRVINGAYAARFITFISRVLSDMHFLIM

SEQ ID NO: 28352 - protein, 492 aa, Vitis vinifera
  misc_feature (6)..(6): Xaa can be any naturally occurring amino acid
  misc_feature (135)..(135): Xaa can be any naturally occurring amino acid
  misc_feature (357)..(357): Xaa can be any naturally occurring amino acid
MPSTAXVLSTYTTFAASAMLVRTVVSEVETMANQLIPQQLREKIVSKLGGLLGSHSSEMVLVIQEFNGLSVNQIYQASELYLRTKITPSVGRLNVSKGLREKNLSVTVSKGEMVVDVFEGIELRWQLICAETQKXSFDYDSGSMATEKSEQRSIELIFHKKYKEVVLSTYLPYVIERSRAIKEENKVVKLCSLGNFSEDYDGPWGSINLSHPCTFDTLAMDPTLKKELIADLDRFVRRREFYQKVGKAWKRGYLLYGPPGTGKSSLIAAMANYLKFNIYDLELTSLWNNSDLRRLLVSTANRSILVIEDIDCSVELQNRQNGSDNNTDSQLTLSGLLNFIDGLWSSCGDERIIVFTXNHKERLDPALLRPGRMDMHIHMSYCTPSGFKILAANYLNINTHPLFTKIERLMTEVEVTPAEIAEELLKCEEVDVALEGIIKFLERKKMQVEHDEKSNEGVKEVDEQEVSNGIKGDKMGVKRNKMKKTRRAKGRH

SEQ ID NO: 28353 - protein, 153 aa, Streptococcus oralis
EQFIRGQYRSGKIDGMKYISYRSEPNVDPESSTETFASGAFFVDSDRFRGVPFFFRTGKRLTEKGTHVNIVFKQMDSIFGEPLAPNILTIYIQPTEGFSLSFNGKQVGEEFNLAPSSLDYRTDATATGASPDPYEKLIYDVLNNNSTNFSHWD

SEQ ID NO: 28354 - protein, 173 aa, Bacillus subtilis
EFKEAKAILLEEKEKLVKAGQAVSDDIEVGMMVEIPSTAVIADQFAKEVDFFSIGTNDLIQYTMAADRMNERVSYLYQPYNPAILRLITLVIEAAHKEGKWVGMCGEMAGDEIAIPILLGLGLDEFSMSATSILPARTQISKLSKQEAESFKEKILSMSTTEEVVAFVKETFK

SEQ ID NO: 28355 - protein, 238 aa, Aeropyrum pernix K1
MEGRYKPSLEGSIARAVDSLRNGMPVMIYDGDRREGEVDLVYYAGSVTWREVYTLRTLAGGLICFVTSERVGRLLGLPFAQELLLSQESLAPLASKTPGYGDPPAFSIWVNHVSVKTGISDEDRGITISGLHRVVEKAYSGLVGEARRMLREEFMSPGHVPILLARSLDRRRGHTELTVALGRLAGLPPSFVIAEMLGERWSLGLREAEAIARERRIPLLRGEEIVEACSRGEVCRGG

SEQ ID NO: 28356 - protein, 207 aa, Synechococcus sp. WH 7803
MSIFVGNLPFRAEQEDVIELFAAFGEVTNCALPLERDTGRKRGFAFVEMADDAAEAAAIEALQGAELMGRPLRINKAEPRGSAPRRGGGGYGGGGGGGGYRGGGGGYNDGGGGGGYRGGGGGYGGGGERRSGARGWEDRSYGGGASGGGGGYGGGGGSYSDGGGGGDDGRSRRRRGGAAPSEGGGFNDGGYGGGGGDDYGGYGGAEG

SEQ ID NO: 28357 - protein, 334 aa, Synechococcus sp. WH 7803
MDSLTDADREPPWRFSVAPMLDCTDRHFRQLMRQISRRSLLYSEMVVAQALHHSNRRERLLGFDPEEHPIVLQVGGDDPQLLAEATRMAADWGYDEINLNVGCPSPRVQAGNFGACLMAEPERVAQCVEAMVSASDRPVTVKHRVGIDDLDSDDLLTAFVDRVADAGASRFSVHARKAWLEGLDPKQNRTIPPLQHDRVIALKARRPQLTIELNGGLDTPEQCLDALQHCDGAMVGRAAYAHPLRWASVDTLIYGDAPQTVRASDVLIGLIPHAERHLQRGGRLWDIGRHLVQLVEGVPGARHWRRDLGQKAQRSGADLTVLEASARQLIDAGL

SEQ ID NO: 28358 - protein, 417 aa, Mycobacterium sp. JLS
MTTAASRLDVAGIRADFPILQRVMRGGNQLAYLDSGATSQRPLQVLDAEREFLTTSYGAVHRGAHQLMEESTDAYEAGRADIAAFVGADTDELVFTKNATEALNLVSYVLGDDRFEGHAVGPGDVIVTTELEHHANLIPWQELARRTGATLKWYSVTDDGRIDLDSLDLDERVKVVAFTHHSNVTGAVAPVAEIVRRARSVGALTVLDACQSVPHQPIDFHALDVDYAAFSGHKMLGPNGIGVLYGRRELLAEMPPFLTGGSMIETVTMEGATYAPAPQRFEAGTPMTSQVVGLAAAARYLSTIGMAEVEAHEAELVAAALEGLSGIDGVRVVGPLSLVDRGSPVSFVVDGIHAHDVGQVLDDDAVAVRVGHHCAWPLHRRFGITATARASFAVYNTFDEVERLVAGVRHAVEFFGR

SEQ ID NO: 28359 - protein, 446 aa, Oceanicola granulosus HTCC2516
MTSPFTPGIAAGRLPPEEIGRNFSDLHAPFDKHEAHVAADRCYFCHDAPCVTACPTSIDIPLFIRQIATGQPEAAGVTIFEQNIFGGMCARVCPTEELCEEVCVREVAEGKPVEIGRLQRYATDSVMTRQGHPFVRAADTGKRVAVVGAGPAGLACAHRLAMQGHKVDVYEMRDKPGGLNEYGIAAYKTVDEFAQAEVDWLLGVGGIEIHTGVTVNDSKLAELRASHDVVFLGIGLPGAFGLPELGDEGVTAAIDFIAALRQSDDLSALPVGRHVVVIGGGMTAIDAAVQAKALGADSATILYRRDRAAMPASDWEQDLAAARGVRIVYNAAPVKTHGKGAARELECERTVVEDGRLVALGDTFRIPADQVLLAIGQWLPSAPAEVALEGKVLGADDDTGRTSLAGVWAGGDCVAPGKNLTVWAVRQGRDAAEDIHAALAAPSVGG

SEQ ID NO: 28360 - protein, 171 aa, Triticum aestivum
  misc_feature (100)..(100): Xaa can be any naturally occurring amino acid
  misc_feature (152)..(152): Xaa can be any naturally occurring amino acid
MQCRGVNLLFLPPPPPPLVVSRGRLQPQRSRMSEEDSTSRPAPKLNERILSSLSRRAVAAHPWHDLEIGPGAPAVFNVVVEITKGSKVKYELDKKTGLIXVDRVLYSSVVYPHNYGFIPRTLCEDNDPMDVLVLMQEPGIPGFFLRAKAFGXMPMIDPGEKDDQILAAWAD

SEQ ID NO: 28361 - protein, 367 aa, Zea mays
  misc_feature (325)..(325): Xaa can be any naturally occurring amino acid
MDQVCTKKQAGTGPEFPGSPLLSPLPHLCVRALCLFRRQPRGAMAAGRELVVSFGEMLIDFVPTVAGVSLAEAPAFLKAPGGAPANVAIAVSRLGGGAAFVGKLGDDEFGRMLAAILRDNGVDDGGVVFDSGARTALAFVTLRADGEREFMFYRNPSADMLLTADELNVELIKRAAVFHYGSISLIAEPCRTAHLRAMEIAKEAGALLSYDPNLREALWPSREEARTQILSIWDQADIVKVSEVELEFLTGIDSVEDDVVMKLWRPTMKLLLVTLGDQGCKYYARDFHGAVPSFKVQQVDTTGAGDAFVGALLQRIVKDPSSLQXDEKKLVESIKFANACGAITTTKKGAIPSLPTEAEVLQLIEKA

SEQ ID NO: 28362 - protein, 216 aa, Rhodospirillum rubrum ATCC 11170
MIDRDPIDVFNNTLVPMVVEQTNRGERSYDIYSRLLKERIIFLTGQVHDGVASLICAQLLFLESENPSKDISFYINSPGGVVTSGMAIYDTMQYIRSPVSTVCIGQAASMGSLLLCAGEAGKRYATPNARIMIHQPSGGFQGQAADIEIQAREILALRERLNRIYVKHTGQPLETIERAMDRDNYMTAEESRAFGLTDSVIERRALSDDGDTKSSS

SEQ ID NO: 28363 - protein, 220 aa, Synechococcus sp. WH 5701
MRESLNPGAPAALLLDAMGTLIGLRRSVGHTYADVARRHGVIAEPEAIDQAFPAVLRQAPPLAFPGLEGPELLSAEQQWWHQRIEDTLRSTGGNLGELELPPQLALELFERFAEPDLWRVYPDVIGPIGRWHGAGLRLAVVSNFDQRLHGLLEALGLAQLLELVVVSSAAGAAKPSPKPFELALEGLELRPEQVWHVGDSPEDLAGARAAGITCLLIRRH

SEQ ID NO: 28364 - protein, 243 aa, Ashbya gossypii ATCC 10895
MMAATTTGSDYANEVHSVPIQHQFNPYDDTAGTILGIAGEDFAVLAGDTRHTTGYSINSREEPKVFDCGDNILISANGFAADGDALVKRFKNSMKWYRFDHNKKMTIKSAARSIQHLLYGKRMFPYYVHTIIAGLDEEGKGAVYSYDPVGSYEREQCRAGGAAASLIMPFLDNQVNFKNQYEPDSNGTKKRALRFLSVDEVVRLVRDAFTSATERHIHVGDGLQIMIVTKDGVREEFYSLKKD

SEQ ID NO: 28365 - protein, 244 aa, Zea mays
MAAADATRPLLVAISLAVAACCLAQLAAGDTNGVYEPCSDARIQRGDGFTFGVVFAGYNAFFSGNTQLSPCDRRLNLAASGQLAVFRPKVDEISLLTINTTTGFNPASAGGFMVAFAGRKYAARSIPIFVSNTSVTVSSFTLVLEFNKGRLQNLHWKKDGCGACSGKSNFVCLGKQTCAIRTQSCKSQGPVDCSVGIQLAFSGTDKHESVLNSWYEVSNLRQYSLYGLYSNLKDTLSGQFNKIF

SEQ ID NO: 28366 - protein, 482 aa, unidentified eubacterium SCB49
MQFKGLLKDQSYINGAWVSSDNKATFKVTNPFDNSVIAEVANLGSSETKNAIDCANEAFKTWSKTTAEERSRLLKKLYQLQMDHVEELAQILTLEQGKPLSESRGEIKYGASFIEWFAEEAKRTYGDTIPSHGVDKRIITIKQPIGVVAAITPWNFPNAMITRKVAPALAAGCTVVIKPAHQTPLSALALAALVEKAGFPKGVFNIITSDTAKEIGNELTANPIVRKLSFTGSTRVGKLLMRQCADTVKKVSMELGGNAPFIVFEDADIDKAVEGAIASKFRNAGQTCVCTNRIFVHDKVHKTFVDKFTTAVNKLKMGSGLDEETVVGPLINKEAVEFINGLVKNAVDEGAELITGGHKIEDKDNFYPPTILSNVNSSMEIFNNEIFGSIAPIIKFDNEDEVIRMANDTPFGLASYFYTNDYAKIWRVSEGLEYGMVGINTGMISTTVAPFGGVKESGNGREGSKYGMDDYLEIKYLCIGGI

SEQ ID NO: 28367 - protein, 415 aa, Cryptococcus neoformans var. neoformans B-3501A
MAPQLSTAAPRNKLVIRRLPPTLPEDIFWQSVSAWITDKNCLWKSFIKGKAGDSNYDSHPVYSRAYVLMADPESLVNFHRSEFQAVVEYAPFQKAPLKTKVKVDNRQGTIDEDPDYLSYIQSLNAPVTKPVLEVATPVAQPTTTPLLEHLRSQKSASKNKSKAAKTAQNQAQSSATAPESARRAAALASINAASQRRGGQTNTGPVMVAGKGREVMITPSSTPPVPDGAKQKQQGEQAQQGAKPEQADKEKKSRGGRKRNKGKDKQKEGVNSVPSGRQTPSAPSTSSTTTQAPLSGRPVRSARIDNPVPNMPSQSQFVPAPKTASGSARAPQAPAGKSGPGAGNNGEPRGNESGRGRQRGGRGRGGGGQPKTSSAGPQVKILSRNPVPPVGSGPRRGDREGAGSDAGAAFARIDM

SEQ ID NO: 28368 - protein, 322 aa, Mycobacterium leprae TN
MSVARIAYLGPEGTFTEAALLRMTAAGLVPDTGPDGLRRWPTESTPAALDAVRGGAADYACVPIENSIDGSVAPTLDNLAIGSPLQVFAETTLDVEFNIVVKPGITAADIRTLAAFPVAAAQVRQWLAAHLAGAELRPAYSNADAARQVAYGQVDAAVTSPLAATRWGLIALAAGIVDEPNARTRFVLVGMPGPPPARTGTDRTSAVLRIDNAPGMLVAALAEFGIRGIDLTRIESRPTRTELGTYLFFVDCVGHIDDGVVAEALKALHRRCADVCYLGSWPAGLATGPTVSPPPPDEASRWLARLRAGKPDQASEPGGGKL

SEQ ID NO: 28369 - protein, 425 aa, unidentified eubacterium SCB49
MKKNKELQQRKELAIAKGQKNLFPIYIDKAINAEIWDVEGTRYIDFCAGIAVTNVGHGHPKVMAALKEQIENFTHTCVMINPYESAIALAEKLNTLVPIKKAKSVFLNSGAEAVENAIKIAKAYTKRSSVISFVGSFHGRTHMCLGLTGKFHPYKEGFGPFPNGIYHIPFPNNNYGISIEDSLDTLKELFKTTVDPTEIAAIIIEPVQGEGGFHIAPKKFIEALRLLCDQYGILLICDEIQTGFARTGAFFAIEHSNVEPDIITLGKGLANGIPLSAVVGKEKIMDAAISLGGTFGGSPIGCQSALAVIDIINDENLCERALEIGKTCSDSLNKLKNRYPDKIACVRNSGAMIAIEIVTDGNFKQPDTNTTKKIIQESSNLGLLLLSCGMDGNIIRLLPPLTIEFDILNEGLDILNKTIIKFFSE

SEQ ID NO: 28370 - protein, 195 aa, Clostridium perfringens SM101
MASLLLVGCGGTGKKAKENIPENKLPVATIEVKNFGTIEAELYPNKAPNTVDNFISLANSGFYDGLTIHRIVKGFVLQGGDPKGTGTGGPGYMIKGEFSSNGVENDIKHEEGILSMARSQNPDSAGSQFFIVTKEAPHLDGQYAAFGKVTKGLDVVHEIEKISVGANDKPVEDVVIESIKVDTKGIEYKEPEKVK

SEQ ID NO: 28371 - protein, 1077 aa, Zea mays
  misc_feature (494)..(494): Xaa can be any naturally occurring amino acid
MEGDADGVKSGRRGGGQVCQICGDGVGTTAEGDVFAACDVCGFPVCRPCYEYERKDGTQACPQCKTKYKRHKGSPAIRGEEGDDTDADSDFNYPASGNEDQKQKIADRMRSWRMNVGGSGDVGRPKYDSGEIGLTKYDSGEIPRGYIPSVTNSQISGEIPGASPDHHMMSPTGNIGKRAPFPYVNHSPNPSREFSGSIGNVAWKERVDGWKMKQDKGTIPMTNGTSIAPSEGRGVGDIDASTDYNMEDALLNDETRQPLSRKVPLPSSRINPYRMVIVLRLIVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKVRVNGLVAKAQKVPEEGWIMQDGTPWPGNNTXDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKGGFLSSLCGGRKKASKSKKGSDKKKSQKHVDSSVPVFNLEDIEEGVEGAGFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPLWYGYGGRLKFLERFAYINTTIYPLTSIPLLIYCILPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 28372 - protein, 248 aa, Cryptococcus neoformans var. neoformans JEC21
MSDDDWDADETIAPAAPAVTLPPKVPAKKWADEDAEDNDSDDDWDKSEDEKPQATKVAAVAPAKKKGTLKQKLAEKERLAKEAKEKGVDDDNDLMYTMTEQERRRLAREKEQEADLAVASDLMGAVDLGDEGDALKSVLSAHPSTKNDFSELSKNIYTSIIKKHESNPLYAHFVEQLAKDISAALTAVQTRKVSSALSVLGNTKQQEEREKASGKKKAASKPKLGAAKVLSKVDTEAYDDVLGDDDFM

SEQ ID NO: 28373 - protein, 461 aa, Roseovarius nubinhibens ISM
MFNRAVALMDLPPGLEEKIRVCNATYTVRFGVRLRGQIHTFTGYRSVHSEHMEPVKGGIRYAMGVNQDEVEALAALMTYKCALVEAPFGGSKGGLRIDPREWDEDELERITRRFAYELIKRDLINPSQNVPAPDMGTGEREMAWIADQYKRMNTTDINGRACVTGKPINGGGIQGRTEATGRGVQYALQEFFRHPEDMKAAGLSGTLDGKKVIVQGLGNVGYHAAKFLSEEDGCIITGIIERDGALVSEDGLHVEEVRHWIAKHGGVKGYPDAEYVEDGSKVLENACDILVPAALEGVIHMGNAANIQAPLIIEAANGPVTAGADEILRKKGAVIIPDMYANAGGVTVSYFEWVKNLSHIRFGRMGRRQEEARHQLIVDELEQLSADRGLGWTLTPGFKQQYLRGAGELELVRSGLDDTMRAAYQSMREVWHGRQDVTDLRTAAYLVSIDKVAASYRAAGL

SEQ ID NO: 28374 - protein, 411 aa, Arachis hypogaea
MLEGGAKFPGLIDLNKHTTDNYYDFSQGFYHKLGEGTNMSIDSMQTSNGGGSVAMSIDNSSVGSNDSHTRILNHQGLRRRANDNYSVQNSVNRRGRVTHALSDDALAQALMDSSSPTEGLENFDEWTIDLRKLNMGEAFAQGAFGKLYRGTYNGEDVAIKILERPENELSKAQLMEQQFQQEVMMLATLKHPNIVRFIGACRKPMVWCIVTEYAKGGSVRQSLMKRQNRSVPLKLAVKQALDVARGMAYVPWLGLIHRDLKSDNLLIFGAKSIKIADFGVAGIEVQTEGMTPETGTYRWMAPEMIQHRPYTQKVDVYSFGIVLWELIPGMLPFQNMPAVQAAFAVVTKNVRPIIPNDCLPVLRDIMPRCWDPNPDVRPPICRNCRNAETEIMTTVRKARFRCCMTQPMTAD

SEQ ID NO: 28375 - protein, 395 aa, Oryza sativa Japonica Group
MDHHQRWHPTVNEREFIERALQSDLRVDGRRPFDFRRLKILFGREDGSAEVQLGDTRVMGYATAQLVQPYKDRPNEGTLAIFTEFSPMADPAFEPGRPGESAIELGRVVDRGLRESRAVDMESLCVVAGKHVWSVRVDLHILDNGGNLIDAANIAALAALSTFRRPECTVGGEDGQQVTVHDPEVRDPLPLTIHHLPIAVTFAYFGEGNIMVIDPTYKEEAVMGGRMTATINSNGDVCSIQKAGGEGVMSSVIMQCLRIASVKAADITSKIKNEVNSYTSAKALQKVKRLPASALKKDNAPDVAMKESSDGALETQSTKPSSDGQQINKEPPSVVEDNKQEDVEPMLSECNPEPQSESRLTAGGSDETQEAISPKSLKDAVKPKHKIKKKQHSKS

SEQ ID NO: 28376 - protein, 917 aa, Bacillus anthracis str. Ames
MKKTTSILLSMALVFSSFGALSAHAESLQKEKQFSPQLKTTIEQWGESKIAQHVETKTTKEISVIVELQHAPLAAQSNIQHAPDLQNSHAQSYHTELKKAQEETTKKIKEKAPGAKIKEVYNTLFSGFSISVPGDQITALASLPEVKTVYPNLTYKLHETTKSATSEEAPNIGGPTIGAPEAWNLKDPSGKSLDGKGMKVAIIDSGVDYTHPDLKANYIGGYDTVDEDADPMDGNVHGTHVAGIIAGNGKIKGVAPNASILAYRVMNDGGTGTTDDIIQGIERAIQDGADVLNLSLGQDLNVPDQPVTLTLERAAKLGITAVVSNGNDGPKPWSVDAPGNASSVISVGASTVSIPFPTFQVAGSSKTYQGLSLSKSDFPIGNDSPLVYVGYGNPSDYAKQDVKGKFALVLQGTSSTLVKAEQAKQAGAIGVLFISTEKEMNSMPEYFTRENLALPVMQLSNVNGEELKNLITKRKKNIKIGQPVPTELIGNFSSRGPSQGSWLIKPDIVAPGVQITSTVPRGGYESHNGTSMAAPQVAGAVALLRQMHPDWTTQQLKASLANTAKTLKDVNENTYPIMTQGSGLINIPKAAQTDVLVKPNNVSFGLIKPNSGKVKLTQNITLQNLSSKKKSFSTRVELLDTNTKTKVKTSVPSSISIQPNSSTEKPFTITVDSSLPQGVYTGNVYVKEQGAKEETRIPFTFSIDPKDYKRIDGLEIINSTFSPNGDQILDDNLINYYLVAPVDDVTLHANLVTKERVTYQGIIHQAKNETAGYKPFKWDGTKADGTPLADGLYQIEAVASNSGGETKQTAAVFLDRTAPKLTYEIDQENLVITGKVDDILLDWMTESGWVAPGIPVRLQYEINGNGVWESAFLNPWEKNYGIYLDRTQLQEGKNTIHIVATDAAGNTSNLNVDLDVK

SEQ ID NO: 28377 - protein, 243 aa, Triticum aestivum
  misc_feature (50)..(50): Xaa can be any naturally occurring amino acid
  misc_feature (62)..(62): Xaa can be any naturally occurring amino acid
KAGWYRSGIPGISSTHASANTQTQTQTHPLPLSSLRLPPTRPKNPSPQPXARTERGGGGGNXSTGGEMVFFALLVGAELDGLTNLQPRGGCDDPSYPYYFKLRCESCGETSAKTTCVSLDEVVQLPTGKGTANLLQKCKLCSREGSVVMIPGQGTPLTAEQSQKGEMTCLMVFECRGYEPIEFAFGNGWKAESVHGTPFDIDLSEGEFDEYDEKGECPVALSKLQSTFKVVKKQGFHGKTRYV

SEQ ID NO: 28378 - protein, 121 aa, Mycobacterium sp. JLS
MTTRDLTADQFNETITDNEIVLVDFWASWCGPCRAFAPTFAASSEKHPDVVHAKVDTEAEQQLAAAADIRSIPTLMAFKKGKLVFNQAGALPPAALEDLVQQVKEFDIDAAMAQQENAQSE

SEQ ID NO: 28379 - protein, 401 aa, Triticum aestivum
  misc_feature (165)..(165): Xaa can be any naturally occurring amino acid
  misc_feature (189)..(189): Xaa can be any naturally occurring amino acid
MATKRSVGTLGEADLKGKKVFVRADLNVPLDDAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHAFTEGVTXFLMPSVAGFLMQKGLDYLVGAVAXPKKPFAAIVGGSKVSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 28380 - protein, 306 aa, Chlamydomonas reinhardtii
MLADSIQTPGTLASDVQRELDVRGGRHPAAVKQPLKPLQQPAASTQSDTARGGSDTSLVSGAVDMASTLADTALNNGAKMMESLPLDSVTGGGVHHKAGHKDVLSSRIAAGEDNKPVYGIPQYPATMEFRPPEGLDKVIPNPGMPRANKAISRERPDGDPRAPADRTVLQQHVMFWDRDNDGVIYPLDTFIGFRRLGFNLIISALAVPFIHLSFSYPTLKGWLPDPRLPIYLDQIHRTKHGSDSECVFAGLIAERLEWWVTYLLLRDHKGLVSKEKIRGVYDGTVWEVVAAEVEARKNRRSAYKCE

SEQ ID NO: 28381 - protein, 506 aa, Mycobacterium avium subsp. paratuberculosis K-10
MTTQIPHFIDGQRTAGQSTRTADVFDPSTGAVQAQVPMAGRADIDAAVASAIEAQKGWAATNPQRRARVLMRFIELVNQHNDELAELLSREHGKTLADAKGDIQRGIEVIEFCVGIPHLLKGEYSEGAGPGIDVYSLRQPLGVVAGITPFNFPAMIPLWKAGPALACGNAFVLKPSERDPSVPVRLAELFVEAGLPPGVFQVVHGDKEAVDAILNHPDIQAVGFVGSSDIAQYIYAGAAATGKRSQCFGGAKNHMIVMPDADLDQAVDALIGAGYGSAGERCMAISVAVPVGDKTADRLRARLVERINNLRVGHSLDPKADYGPLVTGAAVARVRDYIDQGVAAGAEIVVDGRERRSDDLTFGDANLEGGFFIGPTLFDHVTPDMSIYTDEIFGPVLCIVRAQNYEEALRLPSEHEYGNGVAVFTRDGDAARDFVSRVQVGMVGVNVPIPVPVAYHTFGGWKRSGFGDLNQHGPASIQFYTKVKTVTSRWPSGIKDGAEFVIPTMD

SEQ ID NO: 28382 - protein, 459 aa, Schizosaccharomyces pombe 972h-
MTETVTTTSSDKSEKKNYLFYTSPNHRPPTVVRAEGVYLYLEDGTRIMDATGGAAVACLGHGNKEVIDAMHKQSEKVCYIHSMGFSNEPADKLANLLVSEHPDVFARAYFANSGSEAVETCLKLILQYWQLVGEKQRCHIIARKQGYHGNTLFALSVGGMKPRKQPYEGVFSHTTSHVSPCFEYRYKENGETTEEYVARLAKELEDEILRVGPEKVAAFVAETVSGACTGCATPVPGYFKAMRKVCDKYGVIFYLDEVMSGIGRTGTMHAWEQEGVTPDIQSIAKCLGGGYQPISGALVGHRIMNVFEQKDAAMAGFFTYQAHPIACSAALAVQTILRRDHLVERAAEMGKYLSEKLHETFDSHPNVGNIRGRGLFWGLEIVKDKATKECFPPEYKVGSLANKIGCEHGVFVYPGMGTIDGTRGDHVLLAPPYIITREQIDELVEALSKTITSTVAALP

SEQ ID NO: 28383 - protein, 341 aa, Synechococcus sp. WH 7803
MTLRVAINGFGRIGRNVMRGWLSRGADTGLEIVGMNSTSDPKTSAHLLTYDSILGHIDRSVQIETTDDTMIVNGKEIKFFADRNPLNCPWKDWGVDLVIESTGVFNTDEKASMHLEAGASKVILTAPGKGDGVGTFVVGVNDDQYRHEDWKILSNASCTTNCLAPIVKVLDQSFGLDWGLMTTIHSYTGDQRILDNSHRDLRRARAAALNMVPTTTGAAKAVALVYPEVKGKLTGFAMRVPTPNVSAVDLTFGPSRATTVDEVKAVIKAASENGMKGIIKYSDLPLVSTDYAGTNESTIFDADLTYAMGDKAVKILAWYDNEWGYSQRVVDLAEVVARNWK

SEQ ID NO: 28384 - protein, 321 aa, Ashbya gossypii ATCC 10895
MSSWQTIENDAGVFTQLVKDLGVEGVQFEEVPLVEHLATLNSPLYGVIFLFKYERQNYAGEAPVQGEFEQACPEGLFFAQQTIPNACATQTVLNTLLSIGNDHRNSIRLGTVLSDFLQFTAGFSDPALRGETITNSVAIRNVHNSFTSPDPFEHEEPSPSAQSSEAAFHYSGFVPYNGYIYELDGLHPRPIIHRAYGANNDDPAVFAANLAALLSARMSMVADSSFSVTAIVRDKLEHLTEQLDAPDVDDGRRFWLQDLIQDELRVRDRWAKEIALRRDGLVGLVYAVFKQMLGSMSDDEFAQRRAAAAARTNERERRRTC

SEQ ID NO: 28385 - protein, 360 aa, Schizosaccharomyces pombe 972h-
MAPAEKAFVLRKKMDTAIEDRPGQTLTDDHQVKVAIKATGICGSDVHYWKEGGIGDFILKKPMILGHESAGVVVEVGKGVSSLKPGDPVAVEPGCVCRLCDYCRSGRYNLCPHMEFAATPPYDGTLRTYYITTEDFCTKLPKQISVEEGALFEPMSVAVHAMTRGNLKCGSRVLVMGCGTVGLLMMAVAKAYGAIDIVAVDASPSRVEFAQKYVGAKPFTPIAAKENESLPDYAQRYKQAIIEKYGEFDFAVDATGVGICIHTAVLALKRGGTFVQAGNGKPVIDFPINHIINYEINVLGSFRYAHGCYKQSLFLVSNGLVDVKPLITHRFAFKDALKAYETVASGEEGVLKVIIGGPDA

SEQ ID NO: 28386 - protein, 401 aa, Populus nigra
MATKKSVSSLKEADLKGKSVFVRVDLNVPLDDNFNITDDTRIRAAVPTIKYLMGHGARVILSSHLGRPKGVTPKYSLKPLVPRLSELLGVDVKMANDCIGVEVEKIVAEIPEGGVLLLENVRFYKEEEKNDPEFAKKLASLAEIYVNDAFGTAHRAHASTEGVAKYLKPAVAGFLMQKELDYLVGAVANPKKPFAAIVGGSKVSSKIGVIESLLEKVDLLFLGGGMIYTFYKAQGHSVGSSLVEEDKLDLATSLIEKAKVKGVKLLLPADVVVADKFAPDANSKVVPASEIPDGWMGLDIGPDSIKTFSEALDTTKTIIWNGPMGVFEFEKFAAGTEAIARKLAELSGKGVTTIIGGGDSVAAVEKAGLADKMSHISTGGGASLELLEGKPLPGVLALDDA

SEQ ID NO: 28387 - protein, 103 aa, Schizosaccharomyces pombe
MVKQVSDSSEFKSIVCQDKLVVVDFFATWCGPCKAIAPKFEQFSNTYSDATFIKVDVDQLSEIAAEAGVHAMPSFFLYKNGEKIEEIVGANPAKLEVRLNRSL

SEQ ID NO: 28388 - protein, 587 aa, Synechococcus sp. WH 5701
MMTFHSRSAQTVLRLERVSKIYPNGEVLRDVTWEVKAGDRVGLVGVNGAGKSTQLRLIAGLEEPSTGQVVRQGNPRIAYLRQEFDVDLERSVREELFQAFGEAADVLIRQHRVEHEMASDQAATDPHHLDELIHELGQLHSRFEALHGYELDARIDKLLPTLGFTPEGAEEPVGAYSGGWQMRIALGKILLQDPDLLLLDEPTNHLDVETIQWLEGYLLEQEVPMVVVSHDRAFLDRVCNLIVETERGISRTYLGNYSQHLEQKALEREASQAAFERQQKELASQQAYIDRFRASATRSTQAKSREKLLEKVERIEAPLEGLSGPRFQFPPAPRSGRQVAVIDDLTHSYGEKILFLGAHLEVERGDRIAFVGPNGAGKSTLLRLVMGLETPDGGQAGLGEHNVVAGYFEQNQAEALNLERSVVDTLFEAVPDWTQTQVRSLLGNFGFSNDDVFKEVGQLSGGEKARLALALMLLTPCNLLVLDEPTNHLDIPAKQMLESALQGYEGAALIVSHDRYFISQVANRIVELRDGELVLYRGDYAYYLEKKAEEAEAQRLAQQERVKQARQEANRQKQKDKTQSRRARAGS

SEQ ID NO: 28389 - protein, 164 aa, Acetabularia acetabulum
MADEIYGPVQLTASFYGFLGAAFALIFSCMGAAYGTAKSGIGIAQMGVMRPELVMKSIVPVVMAGVLGIYGLIIAVIISTNVKKTGYTLYDGYAHIGAGIACGMAGMPAGMAIGIVGDAGVRANAQQPKLFVGVILILIFAEALALYGLIVGIILASKASGGSS

SEQ ID NO: 28390 - protein, 464 aa, Malus sylvestris
FNSHGEDSSYFLGWQEYEKNPYHEVHNTNGIIQMGLAENQLCFDLLESWLAKNPEAAAFKKNGESIFAELALFQDYHGLPAFKKAMVDFMAKIRGNKVTFDPNHLVLTAGATSANETFIFCLADPGEAVLIPTPYYPGFDRDLKWRTGVEIVPIHCTSSNGFQITETALEEAYQEAEKRNLRVKGVLVTNPSNPLGTTMTRNELYLLLSFVEDKGIHLISDEIYSGTAFSSPSFISVMEVLKDRNCDENSEVWQRVHVVYSLSKDLGLPGFRVGAIYSNDDMVVAAATKMSSFGLVSSQTQHLLSAMLSDKKLTKNYIAENHKRLKQRQKKLVSGLQKSGISCLNGNAGLFCWVDMRHLLRSNTFEAEMELWKKIVYEVHLNISPGSSCHCTEPGWFRVCFANLPERTLDLAMQRLKAFVGEYYNVPEVNGGSQSSHLSHSRRQSLTKWVSRLSFDDRGPIPGR

SEQ ID NO: 28391 - protein, 401 aa, Populus nigra
MATKKSVSSLKETDLKGKRVFVRVDLNVPLDDNFNITDDTRIRAAVPTVKYLMDHGARVILCSHLGRPKGVTPKYSLKPLVPRLSELLGVEVKIANDCIGEEVEKLVAEIPGGGVVLLENVRFHKEEEKNDPEFAKKLASLAEVYVNDAFGTAHRAHASTEGVAKYLKPAVAGFLMQKELDYLVGAVANPKKPFAAIVGGSKVSSKIGVIESLLEKVDFLFLGGGMIFTFYKAQGYSVGSSLVEEDKLDLATSLIEKARVKGVKLLLPTDVVVADKFASDANSKVVPASEIADGWMGLDIGPDSIKTFSEALDTTKTIIWNGPMGVFEFEKFAAGTEAIAWKLAELSGKGVTTIIGGGDSVAAVEKVGLADKMSHISTGGGASLELLEGKPLPGVLALDDA

SEQ ID NO: 28392 - protein, 139 aa, Brassica napus
  misc_feature (15)..(15): Xaa can be any naturally occurring amino acid
  misc_feature (131)..(131): Xaa can be any naturally occurring amino acid
MEDEEGIGLILARAXELRLKITDSIDSSSPAVSGNDLSFPGEGKKDGTIGNQDKEFDSISSGDVEEEEEEEEADEQLLRIRDALESLESQLASLQNLRQRQQYEKQVALSEIDYIRKVLLEKLKDYKGKEXQVLREAST

SEQ ID NO: 28393 - protein, 176 aa, Acetabularia acetabulum
MVASDLPIAATATPTTPGTEASGNDTAPFFGFMGAASALVFACMGAAYGTAKSGVGIASMGVMRPELVMKSIVPVVMAGVLGIYGLIIAVIISTNVKRDVYKLYDGYAHLSAGLACGLAGLPAGMAIGIVGDAGVRANAQQPKLFVGMILILIFAEALALYGLIVGIILASKASAS

SEQ ID NO: 28394 - protein, 396 aa, Schizosaccharomyces pombe 972h-
MPEALNENVSDTASNGPVAKTRAPPNTSFRQQRIKSWQPLLTPKIVLPLFFVLGIIFGPLGGGLLYASSIVQELVVDYTDCETLASYDEFSAVPSKKYTASFDQSGTIGFDKESTYWKLEKILDKDLDMDVNYCIIRFTVPSVLKAPIFIYYRLTNFFQNHRRYAKSVDEKQLQGVALTADEVKGGNCFPLEVNEDDKPYYPCGLIANSLFNDTFSSLRLLDDNSVYTFSTKNIAWASDKRRFLKTNYSPDDVAPPPNWVLRYPDGYTESNMPDLSTMENLQVWMRTAGLPTFSKLAMRNDNDDIFPGTYEIKIGLFFPVKSFDGTKSLVLTTRSVLGGKNPFLGIAYIVVSAVCVVLGTVFTLRHFIRPRKLADHRYLNWDSEENNLAPHLSDRP

SEQ ID NO: 28395 - protein, 383 aa, Synechococcus sp. RS9917
MALKPSLTLAISARAQALKEAGRDICSLSAGEPDFDTPEFIVEATLKALRDGITRYGPAAGDPQLRDAIAGKLSNENRVPTDAAQVLVTNGGKQAIYNLFQVLLNPGDQVLIPAPYWLSYPEMARLAGAEPVVVPSSAATGFQLDLEALEAVLTPRSRLLVLNTPSNPTGRVMQRTELEVLAAWLRRHPDLLVMCDEIYEFLLAEDESHHSLAALAPDLAERIFIVNGFAKGWAMTGWRLGYLAGRVEVIKAAAALQSQSTSNVCSFAQRGALAALEGSRSCVSAMAASYTERRQQMIAGLQAIDGLTLVPPRGAFYAFPQLPDDTIESVEFCRLALEEEGLALVPGEPFGDRRCVRLSCAVARETIADGLERLQRLLDRLRS

SEQ ID NO: 28396 - protein, 438 aa, Sinorhizobium meliloti 1021
MSMVNAFSREDFERLDKAERALIARREKVLGPAYRLFYEKPLHLVRGEGVFLYDAAGERYLDAYNNVSSVGHCHPRVVEAITRQTAVLNTHTRYLHEGIVDYAEALTATFPEALSQAMFTCTGSEANDLAVRIARFVTGGTGIIATELAYHGLTSAVAEFSPSLGESVTLGPHVRTVSAPDSYRHSPEEIMEKFGRDVRAAIADLKRHGIKPAMLITDTIFSSDGIFDGPRGFLKPAVDAIHEAGGLFVADEVQPGFGRTGETMWGFERHGVAPDIVTIGKPMGNGYPMAGIVLRPEVIAEFGPRARYFNTFGGNPVAAAAGKAVLDTIRTEGLQQNALVVGRHIMERVKSLSAIHPAIGNVRGSGLFIGVEIVADSTIKRPDAALTTRIVNGLRERRILISASGPNANVLKIRPPLIFSRENADMLVDALGNVLKTL

SEQ ID NO: 28397 - protein, 320 aa, Oryza sativa Japonica Group
MSGRRDDSAKMAKLKELLHRSENRICADCSAPDPKWASANIGVFICLKCSGVHRSLGTHISKVLSVTLDQWSDNEIDNVIEVGGNSHANAIYETFLPQNHSKPHPDSTQEEREKFIRSKYELQEFLEPSLRIVSHQSSDSGKHAGSASHSVSSKSEVGMIEFIGILNVKVKGGTNLAIRDMSSSDPYVVLTLGQQKAQTSVIKANLNPVWNEELKLSVPQQYGPLKLQVFDHDMLSKDDLMGEAEIDLQPMINAAAAFGDPGLLGDRQIGRWLKSGDNALVRDSAVVVAGGEVRQELALKLQFTESGEVELEMQWFPLNM

SEQ ID NO: 28398 - protein, 294 aa, Triticum aestivum
  misc_feature (156)..(156): Xaa can be any naturally occurring amino acid
MEGEEEIGLVLARASDLRSRISACAAAARPPLRLGAGEEDDGGEEAEEEVEMESLVGINDALESLERQLASLQDLQHQQRYERETVLSQIDRSRTSLLNKLKEYKGEDCEAIHEAAAFAGEKIENDDGLILPPYSGHVTNSFVLDDLYPANYVSKXKCLHNGLRSDGMTEDGTGTNGVQNRIPIMSSRNSAGGIRSLIGWLAKTAVMIVGAVSIMKAAGYEPTIGRSGIKLDIAGLLGKEAAGAKEQVPPTLQCPPGKVMVLGGDGRAHCVVKERVEIPFGSSLDAPNASYGLG

SEQ ID NO: 28399 - protein, 517 aa, Mycobacterium leprae TN
MIMKSTAEKLAELRVRLELANEPGGEKAAAKRDKKNIPSARARIYALVDPGTFLEIGALTRTPGDPNALYGDGVVTGHGLINGRQVGVFSHDQTVFGGTVGEMFGRKVARLMEWCAMAGCPIVGINDSGGARIQDAVTSLAWYAELGRRHELLSGIVPQISIVLGKCAGGAVYSPIQTDLVVAVRGQGYMFVTGPDVIKDVTGEEVSLDELGGVDSQAKYGNIHQVVESEAAAFGYVRDFLSFLPPNCFDKAPIVNPGLEPEIMAHDLELDSIVPDSDNTAYDMREVLLRIFDDGHFLDVAAQAGQAIITGYARVDGRTVGVVANQPMHLSGAIDNEASDKAARFIRFCDAFNIPLVFVVDTPGFLPGVEQEKNGIIKRGGRFLYAVVEADVPKVTITIRKSYGGAYAVMGSKQLAADLNFAWPTARIAVIGADGAAQLLMKRFPDPSSPDVQAIRKTFVDNYNLNMAIPWIAAERGFIDAVVEPHQTRLLLRKSLHLLRDKQQWWRVGRKHGLIPL

SEQ ID NO: 28400 - protein, 153 aa, Streptococcus oralis
KLFIRGQYRSGKIQGKKDISYRSEPNVNPESMTETFASGAFFVDSDRFRGVPFFFRTGKRLTKKGTHVNVVFKQMDSIFGQEIAPNVLTIYIQPNEGFSLSVNGKEVGEQFQIAPISFDYVTEATATGASPEPYEKLIYDVLNNDSTNFSHWN

SEQ ID NO: 28401 - protein, 153 aa, Streptococcus oralis
EQFIRGQYRSGKVDGMKYISYRSEPNVNPESMTETFASGAFFVESDRFRGVPFFFRTGKRLTEKGTHVNIVFKQMDSIFGEPLAPNILTIYIQPTEGFSLSLNGKQVGEEFNLAPSSLDYRTDATATGASPDPYEKLIYDVLNNNSTNFSHWD

SEQ ID NO: 28402 - protein, 396 aa, Vitis vinifera
MKMMWRSQLRAMLLSPSPRPLTTLLTRSSNSSRPRLFALHKTLSFHSHPSFRSPTALNFPASSAFVVPVRCLSSIFPANTLEWNEPVSCSEVGDADGEGRSLGEEDSRTSIPVRAYFFSTSVDLRSLVEQNRPHFIPPTSRMTNYVVFRFGNLESDYNVSNASLSGSDCCYMVVFQYGSIVLFNVPDHEVDRCLKIVEKHASGLLPEMRKDEYEVREMPTLNTWMQGGLDYIMLQYLNIDGIRTIGSVLGQSIALDYYVRQVDGMVAEFTDINRGMEKTGTFTMERKKLFQLVGKANSNLADVILKLGLFERSDIAWKNAKYAQIWEYLRDEFELTQRFASLDFKLKFVEHNIRFLQEILQNRKSDFLEWLIIILIGAEILISVYDIAHKSSITSL

SEQ ID NO: 28403 - protein, 428 aa, Solanum lycopersicum
ILSKLATNEEHGENSPYFDGWKAYDSDPFHPLKNPNGVIQMGLAENQLCLDLIEDWIKRNPKGSICSEGIKSFKAIANFQDYHGLPEFRKAIAKFMEKTRGGRVRFDPERVVMAGGATGANETIIFCLADPGDAFLVPSPYYPAFNRDLRWRTGVQLIPIHCESSNNFKITSKAVKEAYENAQKSNIKVKGLILTNPSNPLGTTLDKDTLKSVLSFTNQHNIHLVCDEIYAATVFDTPQFVSIAEILDEQEMTYCNKDLVHIVYSLSKDMGLPGFRVGIIYSFNDDVVNCARKMSSFGLVSTQTQYFLAAMLSDEKFVDNFLRESAMRLGKRHKHFTNGLEVVGIKCLKNNAGLFCWMDLRPLLRESTFDSEMSLWRVIINDVKLNVSPGSSFECQEPGWFRVCFANMDDGTVDIALARIRRFVGVEK

SEQ ID NO: 28404 - protein, 474 aa, Treponema denticola ATCC 35405
MVDLFDKYTNAVSETDPIKFTGRVVRVHDKLIESEGPVASVGELCQIITDDNPDGLKAEVVGLNGTIVQLMSYTDVQGVKIGDLVIASGEILSVPVGNILLGRVVDALCKSADGKPEPYSAKRYPVVASPPDAMTRKPIRQRIVTGIRAIDSLLAVGRGQRLGIFAGTGIGKSTLLGMIARNTNADVNVIALIGERGREVLDFIEHDLGPEGLKHSVIVSATSDQSALARIRGAYTATAIAEYFRDQGKDVMLLFDSVTRFAMAQREIGLAIGEPPATRGYTPSVFSSLPKLLERSGTSEKGSITGFYTVLVEGDDMNEPISDAVRGILDGHIVLDRNLAERGQYPAVNVLKSISRLSNRVSGPNTKDASKRMRTLLKDYTESEDMINLGAYQKGSSAAIDDAIDHYPRIYDFLTQEVDDPAKLKDTLQKLSDITGIDIPPEEFDEAGLGVGAIKKYAQSSEASALYKPDREVN

SEQ ID NO: 28405 - protein, 276 aa, Oryza sativa
MSLANTHAGNRNSCSGGQNRILWVALPPDWRGRRTPLTLCFTCCLSVAKHSCSHTCLVARVVSREGKQWSSGSAMEVEASYSYGFLPSGRHQPYAPPPPHPAEEGELWEYFPCPFCYIEVEVPFICNHLQEEHCFDTRNAVCPLCADNIGRDMGAHFRVQHSHLLKRRKPSRPSSSWPTPSNNSDPYFEGPPQYMMNNRTYQDPAPDPLLSQFICSMAQTDTNSDNTNTEIAVSAVSHDQRLSQRVTLTDDASKLELKERLQRIEFVKEIIMSTIL

SEQ ID NO: 28406 - protein, 481 aa, Populus nigra
MASATAPTTLSLLKTAAASTSTSARASLLPVSTSGLRTTSLRGLGFSAADPLFSSHVVSKIRSFKSNGRAPRAVVSMAKKSVGDLTAADLKGKKVFVRADLNVPLDENQKITDDTRIRAAVPTIKYLISKGAKVILSSHLGRPKGVTPKFSLAPLVPRLSELLGIQVVKADDCIGPEVEKLVASLPEGGVLLLENVRFYKEEEKNEPEFAKKLASMADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLAVGSSLVEEDKLDLATTLLEKAKAKGVSLLLPSDVVIADKFAPDANSKTVPASAIPDGWMGLDIGPESVKTFSEALGTTQTVIWNGPMGVFEFEKFANGTEAIAKKLAELSGKGVTTIIGGGDSVAAVEKVGVADVMSHISTGGGASLELLEGKELPGVLALDEVERVAV

SEQ ID NO: 28407 - protein, 308 aa, Synechococcus sp. WH 7803
MPESLVNRCRPLPAGSKLCILGAGFSGGRLAALAAALGIPVISTRREPAPGSGHLTFDSASGQGPDPHQLEGVTHLLNTIPPDRDGNDPVLTTLGDQIKRWPLRWVGYLSTTGVYGNTDGAWVCENDPPQPSQERSRRRLACEQEWQASGLPLQILRLPGIYGPGRSPLAAVKAGTLQPVDKPGQMFCRIHVDDVAAAALHLMHCSAQGQHPEIVNVCDDEPAASVSVHRYAASLLNCELPQPKAFAEAEAGMSAMARSFWADNRRVSNRRLREDLGYELIHPTYRSGLAQCLAVETLRESGTASSQA

SEQ ID NO: 28408 - protein, 365 aa, Silicibacter pomeroyi DSS-3
MGFKMGIVGLPNVGKSTLFNALTRTAAAQAANFPFCTIEPNVGEVGVPDARLDKLAAIAKSKQIIPTRMTFVDIAGLVKGASKGEGLGNQFLANIREVDAIAHVLRCFEDGDVTHVEGRVDPVADAETIETELMLADLESIEKRRANLVRKLKGNDKDAQQQDRLLAVAQAALEDGKPARVVEVSDEDAKAWKMLQLLTTKPVLYVCNVGEAEAAEGNAHSARVAEMAAAQGNSHVIISAQIEEEISQLEDDEAAMFLEEMGLEEAGLDRLIKAGYALLHLETYFTVGPKEARAWTIRQGTAAPQAAGVIHGDFEKGFIRAETIAYDDYIACNGEQGAKEAGKMRAEGKSYVVKDGDVLHFLFNT

SEQ ID NO: 28409 - protein, 218 aa, Listeria monocytogenes str. 4b H7858
MGKIAPSILSADFANLARDIKEVENCGADYIHIDVMDGHFVPNITFGPAVVQAIRPETKLPLDVHLMIENPDTYIPEFAKAGADYITVHVEACTHLHRTLQLIRSYGVKAGAVLNPATPIDVLQHVLNELDMVLFMTVNPGFGGQKFIPEVLEKISAFKKIVDEKGLDIEIEVDGGVDHETAKLCRDAGANVFVAGSYIYGNKNRQTPIDKLRAIVGE

SEQ ID NO: 28410 - protein, 655 aa, Listeria monocytogenes str. 4b H7858
MMIGKRLSDRYKILHAIGGGGMANVYLAHDIILDRDVAVKILRIDLADESNLIRRFQREAQSATSLVHPNIVSVYDVGEENDLHYIVMEHVDGMDLKQYIHENHPISYDKAVDIMLQIVSAVAIAHQHHIIHRDLKPQNILIDHDGVVKITDFGIAMALSETSITQTNSLLGSVHYLSPEQARGGMATQKSDIYSLGIVLYELLTGKVPFDGESAVSIAIKHLQADIPSARAQNPEIPQSLENIIIKATAKDPFLRYQNAEEMEKDLQTCLNQDRLNEPKYIFPTDDGDTKAIPIIATKDTMQNLDKTIVPEGKVAAAEVAPEENKGKKKKKMSKKKKIALIVSSVIIIFIIGILLLWLLGKSPDEVAVPDVSGKTEDQAVALLQKEGFVIGKTAEKNSDEVAEGKVINTDPEAGEMKEKGTKINLFVSIGSKKITMDDYTGRSYTDTKALLEEQGFNNISSEEAYSSEVEKGLIISQTPTQGTDVVAKSTDVKFVVSKGAEPISLKDLRGYTKTAVEDYASPLGLKVSSKEENSNTVEKGQVISQSPSAGTAMNPGDTIEIVISAGPKEKQVKEVTKTFNIPYTPSDEENPQPQKIQIYIQDKDHSMTSAYREMSITQNTSVEITFQIEEGSSAGYKIISDDKVIDEGTVPYPN

SEQ ID NO: 28411 - protein, 368 aa, Elaeis guineensis
MGSSSWLSFSLCLLLLCRMSQAQFGSSQESPFQSSRRSVSTRNECRIERLNALEPTRTVRSEAGMTDYFDEDNEQFRCAGVSAIRRVIEPRGLLLPSMSNAPRLVYIVQGRGIVGLVMPGCPETFQSFQRSERYEREEGGRHRRPRDEHQKVYQFEEGDVLAVPNGFAYWCYNNGENPVVAITVLDTSNDANQLDRSHRQFLLAGRQEEGRQRYRREESMKENILRGFSTELLAAAFGVNMELARKLQCRDDTRGEMVRAENGLQVLRPSRMEEEEREESRRKNGLEETYCSMKIKQNIGDPRRADVFNPRGGRITTLNSEKLPILRFIQMSAERVVLYRNAMVSPHWNINAHSIMYCTGGRGPCRGC

SEQ ID NO: 28412 - protein, 157 aa, Triticum aestivum
MAKPHSHVRLLAFSIVDELFMRSKLFRSLLADGLDGFVPLAVGFRTNEQLPPPAASAATLRKAAIQALERWHHLFGVHYRQLRLAVDYLKSSARIQFPGLRAARAAREARTQEILTAKVEQLRSTIGSIKAEIRSTIEEIRNGLGIIRAEYEKFERY

SEQ ID NO: 28413 - protein, 273 aa, Triticum aestivum
  misc_feature (167)..(167): Xaa can be any naturally occurring amino acid
MASPSSSLCSSLGYPRAASLGGRRRVGFSSSRKLFQVKASRVDSFSKSDIIVSPSILSANFAKLGEQVKAVEVAGCDWIHVDVMDGRFVPNITIGPLIVDALRPVTDLPLDVHLMIVEPEQRIPDFIKAGADIVSVHCEQTATIHLHRTVDQIKSLGAKAGVVLNPXTPLSAIEYVLESVDLVLIMSVNPGFGGQSFIESQVKKIADLRKLCEEKGVNPWIEVDGGVSPKNAYKVIEAGANALVAGSAVFGAKDYAEAIKGIKTSKRPVAVAA

SEQ ID NO: 28414 - protein, 361 aa, Ashbya gossypii ATCC 10895
MSLYRPTGSASTSSAMATDKELSNDITINNPANDSVSDIAFSPQQDFLFSVAAWDNTVRIWDVQNGMTQGRAQYEHQAPVLTTRWSSDGTKVASGGCDNILKLYDVASGQAQQIGSHDSAVRALRFVQCGPSNQECIVTGSWDKTIKYWDMRQPQPISTVAMPERVYALDSKQKLLVVGTAERHIVVIDLNNPAQVFRTSMSPLKWQTRTVACYIEGNGFAIGSVEGRCAIQYVDEQEQRKNGFSFKCHRQQQPASGRASSESLVYPVNSIVFHPQYGTFATAGGDGSCNFWDKNQRHRLKGFPSMNASIPVCNFNRNGSVFAYALSYDWHQGYMANRPDYPNVIRLHATTDDEVKEKKKR

SEQ ID NO: 28415 - protein, 298 aa, Herminiimonas arsenicoxydans
MSSYLEANARQRIHQLLDADSFAEFLPPAQRIVSPHLAQLDTPVSFDDGVVIGSGTLLGARVLAASQEGGFMGGAVGEVHGAKLVGLLKRAIQDRVDGVVLLLETGGVRLHEANAGLIAVSEVMRAVLDTRAANIPVIVLIGGSNGCFGGMGIVACCANAILMSEEARLAMSGPEVIETTHGVEEFDSRDRALVWRTTGGKHRYLLGDCDAVLADDIDVFRHAAGAALQRCRQSSAELTLQALESEHALLSKRLKDFGQLSEPMDIWSSLGIANPAALPMLEAEAFMQQVSSFRLGER

SEQ ID NO: 28416 - protein, 626 aa, Oryza sativa
MPPHLSSSLFSSSPLPTALLSSLTRRARALLPLPLPLPAASTRRRLPLRRGPLLTRGIMASAAAEAPAPSPSPTAAANSRPRRVLEELSWDDSFVRELPGDPRSDAIPREVLHACYTKVSPSAPVDNPKLVAWSQSVADILDLDHKEFERPDFPQLFSGANPLVGSSPYAQCYGGHQFGSWAGQLGDGRAITLGEVINSRGERWELQLKGCGKTPYSRFADGLAVLRSSIREFLCSEAMHGLGIPTTRALCLVETGKSVVRDLFYDGNSKEEPGAIVCRVAPSFLRFGSYQIHATRDKEDLEIVRHLADYTIRHHYPHLENIKKSEGLSFEAAIGDSPAIDLTSNKYAAWAVEVAERTAFLIARWQGVGFTHGVLNTDNMSVLGLTIDYGPFGFLDAFDPSYTPNTTDLPGKRYCFANQPDVGLWNIAQFTSPLTAAELISKDEANYVMERYGTKFMDEYQSIMTRKLGLPKYNKQLIGKLLNNLAVDKVDYTNFFRLLSNVKADHNIPEKELLVPLKAALLDIGPERKEAWISWVQTYIEELVSSGVPDEERKAAMNSVNPKYVLRNYLCQTAIDAAEQGDYDEVRRLLKVMEHPYDEQPGMEKYARLPPAWAYRPGVCMLSCSS

SEQ ID NO: 28417 - protein, 720 aa, Opitutaceae bacterium TAV2
MTPLASALDLPPAPVFSSADQAVMSLESTRDDVVVTQLHAAIPDDGGVFYSTPLALPRWRRCCYYAPFQRHAINPALDLWPEGYNQCHPLPLRSTAELHNAKHGGMFALFQLEDGDYLALLPLVGMHSVASLRGDGQSLRLEAAHFAGTPFEGELPLLACARAASPCAASARVWELALAHPTLRGTGRLRRDKTYPEVFEYLGWCSFEEFKLAIDEPIITGVMRRLAASPVPVRWVLIDDGHVDDGSRATDRMIETQEGAPGQVSTATSARRLHSAHPHPEKFPRGWAPVRAAADADLRLRWLGLWLNYNGYWGGILADHALGSEVDRHLIRLKNTPDSPKLPGETPGDADVFYEAFLRPVQEAGFDFIKVDNQAANLRKYADSTNVQNAVTATAGCRHAFENTVAAHFSGVIGCMAHNNLCILHQPLSQVMRCSEDYKKEDAWRAKHHLHNSFGNMLWMGQTVWGDHDMFHSSDRVAGPLMARSKAISGGPVYLSDHPDHFVRELITPLHLTDGRILRPLAPAVPTPESVFIDPYEDDDAYRVIAPLPHGTAALAAYNLTHPEKTVRGAWHMDDLRHRAAMLPSQSGAGVPPAGLEITWPCFGSGQDARATPPASVLLYDTLTRTARHLTSDAPSIDFTLAPLTDAFVIFSPISHRWALIGNPDKYLPPAFVTRFEVAPDGAAVTLAGAEAGPVFVWHSVAGLIRVELPADNQPVTITP

SEQ ID NO: 28418 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAIECGIPMPCMASAITFLDGYTTERLPANLLQAQRDYFGAHTYERTDKPRGEFFHTNWTGKGGDTASTTYDI

SEQ ID NO: 28419 - protein, 381 aa, Oryza sativa Japonica Group
MAAASSPAAAITCRAAVAWAPGQALVMEEVEVAPPEAMEIRVKVVSTSICRSDVTQWQSTAQTDLFPRIFGHEASGVVESVGEGVTEFEVGDHVLTVFIGECMSCKHCVSGKSNMCQKLGLERRGVMHSDQKTRFSLRGKPVYHYCAVSSFSEYTVVHSGCAVKVGPTVPMDRICLLSCGVSAGLGAAWKVADISKGSSVVIFGLGTVGLSVAQGAKLRGASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDYINKALELMLENKCLRCVIHMPQ

SEQ ID NO: 28420 - protein, 282 aa, Glycine max
  misc_feature (132)..(132): Xaa can be any naturally occurring amino acid
THSCLQRNACVSEEEQSPEKAVQSCDASLLLDSTRRSLSEKETDRSFGLRNFRYIETIKEALERECPGVVSCADILVLSARDGIVSLGGPHIPLKTGRRDGRRSRADVVEQFLPDHNESISAVLDKFGAMGXIDTPGVVALLGAHSVGRTHCVKLVHRLYPEIDPALNPDHVPHILKKCPDAIPDPKAVQYVRNDRGTPMILDNNYYRNILDSKGLLIVDHQLANDKRTKPYVKKMAKSQDYFFKEFSRAITLLSENNPLTGTKGEVRKQCNVANKPHDQDP

SEQ ID NO: 28421 - protein, 159 aa, Mannheimia succiniciproducens MBEL55E
MIRIGHGFDVHAFGEARPLIIGGVEVPYHTGFIAHSDGDVALHALTDALLGALALGDIGKLFPDTDMQFKNIDSRILLREAFRRVQEKGYKIGNVDVTIIAQAPKMRPHIDAMRAVIAEDLQCSVEQVNVKATTTEKLGFTGRSEGITTEAVALLVKSC

SEQ ID NO: 28422 - protein, 546 aa, Rhodococcus sp. RHA1
MTKVQEPITAGTAVTPDIHTTAGKLADLRNRQAEAQHPSGEAAVEKVHAKGKLTARERITALLDEGSFVELDALARHRSVNFGLADNRPVGDGVVTGYGTVDGRDVCVFSQDATVFGGSLGEIYGEKIVKVMDLALKTGRPLIGINEGAGARIQEGVVSLGLYGEIFHRNVQASGVIPQISLIMGPAAGGHVYSPALTDFVVMVDQTSQMFVTGPDVIKTVTGEDVTMEDLGGAHTHMVKSGVAHYVASGEQDALDYVKDLLSYLPSNNQAAAPRMLPTDPITGSIDDSLTAEDLELDTLIPDSANQPYDMHEVIRRILDDDEFLEVQAERAGNIVVGFGRVDGRSVGIVANQPTVFAGCLDIDASEKAARFVRTCDAFNVPIITLVDVPGFLPGTDQEYNGIIRRGAKLLYAYGEATVGKITVITRKAYGGAYDVMGSKHMGADVNLAWPTAQIAVMGASGAVGFVYRKRLLEAARNGDDVDALRLQLQQEYEDTLVNPYVAAERGYVDAVIPPSHTRGQIVAALRLLERKMVTLPPKKHGNIPL

SEQ ID NO: 28423 - protein, 267 aa, Vitis vinifera
MASSRPLDIDLTVVSAKHLQNVNWKHGELKPYAIFWVDPDRRLATKPDESGSTCPVWNERFTVSVNLPLHDSVLTLEVFHSKPSETPKPLVGSLQVPLKDLVDSDDSNRIKTFQLRRPSGRPQGKIRVKLAIRERPSPPAPDYYLTPPVSFYYSSAPPPPAPNPVGYSHLSHTIPLPPPVPQSPSPHPYGTFCNPYPGYYGYYSRAPPPPRPFFDWSANYGGPSAPVDHSPYDQKQMGVKYEEAKIKDRAESELGARDYYKDHRFDY

SEQ ID NO: 28424 - protein, 307 aa, Bacillus anthracis str. Ames
MNVYRGVHELIGHTPIVEITRFSLPEGVRLFAKLEFYNPGGSVKDRLGRELIEDALEKGLVTEGGTIIEPTAGNTGIGLALAALQHDLRVIVCVPEKFSIEKQELMKALGATVVHTPTEQGMTGAIAKAKELVNEIPNSYSPSQFANEANPRAYFKTLGPELWSALNGEINIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 28425 - protein, 501 aa, Roseovarius nubinhibens ISM
MWATAPLGRLSFHIAGDVMTELQKNYIAGQWVAGQDAVENRNPSDLSDLVGTYAQASADQLDAALDAAAKAQAEWAGYGLERKQAVLMAIGTEMMQRAEELGTLLSREEGKPLAEGRGEVYRAGQFFTYYAHEILRQIGENADSVRPGVEVDVRREPVGTVAVISPWNFPTATASWKIAPALAYGNAVIWKPANITPASAVALTEIIARQDIPAGLFNLVMGAGRDVGQRLVESPRVDAISFTGSVPVGRGIASAAVGNFTRVQMEMGSKNALAVMDDANLDLAVSLALGGAFGGTGQKCTASSRLVVHAGIHDAFVEKLIAGAEAMKVGHALAEGTQMGPVVSQQQLDENLAYVELGRSEGAELACGGLRLERETEGYFMSPGVFLNTRNDMRINREEMFAPLTSVIRVDSYDEALATVNDTNFGLTAGIVTQSLARATHFRRNVRTGVVTVNLPTAGTDYHVPFGGRGDSSFGPREQGVHARDFYTVVKTAYIAAGEPA

SEQ ID NO: 28426 - protein, 393 aa, Oryza sativa Japonica Group
MARPLPNQTVARTSATSLRHFPGHSKPSLPLSAPALRKAAAALLLAAAVALPCAVLYRAAVLDAVQPVQVGWDRGPWWERGQPPPAVVVPEEDGDVDPAAADDLDSDDLKLEQVLQEASMDNKTIILTTLNAAWASSGSVIDLFIDSFRRGVRTSSLLRHLVIITFDWKAYKRCMKIHAYCFALATENVDFSQEKRFLTAGYLDMMWKRLDFLRLVLEKGYSFIFSDADITWFRNPFPHFYPDGDFQIACDHYVGNATDLGNIANGGFNYVRSNNQSIEFYKFWYSSRLRYPGYHDQDVFNFIKHDPYITDIGLKIKFLSTTYFGGICEPSRDLNKVCTMHANCCIGLQSKLHDLRVIMEDWRNYMSMPPSLKRFGALSWGVPQNCSLSLLNQ

SEQ ID NO: 28427 - protein, 496 aa, Mycobacterium sp. JLS
MDGGPDLYIGGSWRRAGDGGTREIVNPADGSVAATVDEASPDDARAAVAAARQAFDDGAWPATPVAERAALLDRIADLLVRDKEDLALLETRDTGKTLPESRIDIDDVTSVFRYYARLIAVQSDRVVDVGDPTVVSRVVHEPIGVCVLIAPWNYPLLQMSWKVAPALAAGCTMVMKPSEVTPLSTIAFTRLLEEAGVPAGVVNLVQGSGATLGSALTDTPDVDFISFTGGVSTGRAIAEVAARHVTKMALELGGKNPHIVFADIGTGDGWDSAVDHVVTGVFLHSGQVCSAGTRLIVEESIADDFVADLAARAAKIRVGDGMDPASETGPLVSEQHRAKVESYVALGISEGARLVCGGSRPSDPALAKGSYYLPTIFDRCDRSMRIVTEETFGPILTVERFTDESEAIRLGNDTQYGLAAGVRTSDTARGERVVRALRHGTVWLNDFGYYTAAAEWGGYGKSGNGRELGPAGLAEYQETKHIWHNVAPQKAGWFKG

SEQ ID NO: 28428 - protein, 598 aa, Vitis vinifera
MEDGNERKVSREMLDMADRGMSDEVLNCVMPYIHDPKDRDAVSLVCRRWYELDALTRKHITIALCYTTTPGRLRGRFPHLESLKLKGKPRAAMFNLIMEDWGGYVTPWVKEISDYFDCLKSLHFRRMIVKDSDLQLLAQARGRVLLVLKLDKCSGFSTDGLLHVGRSCRNLRTLFLEESQIVDKDGEWLHELAMNNTVLETLNFYMTELATVQFEDLELIARNCRSLTSMKISDFEILDLVGFFRAATALEEFAGGSFSEQSDKYSAVSFPPKLCRLGLNYMGKNEMPIVFPFASLLKKLDLLYCLLDTEDHCLLIQKCPNLEFLEARNVIGDRGLEVLAQSCKKLRRLRIERGADEQEMEDEEGVVSQRGLMALARGCLEIEYVAIYVSDITNAALECIGAHSKKLCDFRLVLLEREERITDLPLDNGVRALLRGCQKLRRFALYLRSGGLTDVGLNYIGQYSPNVRWMLLGYVGESDAGLLEFSRGCPSLQKLEMRGCCFSERALAVAAMQLTSLRYLWVQGYRASETGRDLLVMARPFWNIELIPSRGVTINAPDREPVSIEHPAHILAYYSLAGPRTDFPSTVTPLDPASFLTL

SEQ ID NO: 28429 - protein, 437 aa, Arabidopsis thaliana
HTSYLCYILLGETFLYWNGTEPRICISDPELAKTMLSNKLGFFVKSKARPEAVKLVGSKGLVFIEGADWVRHRRILNPAFSIDRLKIMTTVMVDCTLKMLEEWRKESTKEETEHPKIKKEMNEEFQRLTADIIATSAFGSSYVEGIEVFRSQMELKRCYTTSLNQVSIPGTQYLPTPSNIRVWKLERKMDNSIKRIISSRLQSKSDYGDDLLGILLKAYNTEGKERKMSIEEIIHECRTFFFGGHETTSNLLAWTTMLLSLHQDWQEKLREEIFKECGKEKTPDSETFSKLKLMNMVIMESLRLYGPVSALAREASVNIKLGDLEIPKGTTVVIPLLKMHSDKTLWGSDADKFNPMRFANGVSRAANHPNALLAFSVGPRACIGQNFVMIEAKTVLTMILQRFRFISLCDEYKHTPVDNVTIQPQYGLPVMLQPLED

SEQ ID NO: 28430 - protein, 390 aa, Burkholderia sp. 383
MNAPSDMPTTPVFPSRLPNVGTTIFTVMSALAAEKGAVNLGQGFPDFDCDPRIVDAVATAMRNGHNQYPPMAGVAPLRDAIADKIAQVYGRRYDPATEITVTAGATQALLTAIMCTVHPGDEVIVVEPTYDSYLPSIELAGGKPVFVTLEAPDYAIPFDRLAAAITPKTRMILINTPHNPTGTVWREADMRKLEEIVRGTNVLILSDEVYEHMVYDGARHESVARYPELAARSFIVSSFGKTYHVTGWKVGYVAAPAALTAEFRKVHQFNVFTVNTPMQIGLADYLRDPAPYLTLADFYQKKRDFFRAGLERTRFKLLPCTGTYFQCVDYSAISDQPEAEFSKWLTSEIGVAAIPVSAFYHEPHESGVVRFCFAKQESTLASALERLARL

SEQ ID NO: 28431 - protein, 264 aa, Vitis vinifera
MASEQRISGMSTRKAKATWTHTFHKIFVELCLEQTIKGNRPGTHFTKEGWRNIVESFHRKVGVRYDRKQLKNHWDVSKEQWKIWCKLIGTSSMKWDSASHKFGASNEDWDNYLQANPEAAHFRYKELPFTEELETIFDGTAVSGETEPPTQRRKKNDGLATAISPMNEQGIFKPDGKIRRHFDAVESRSVITVQSAQCKQNYSIGECIECLDRMEEVEEGSELYLFALDIFLKKEYREIFLQLKKPSVRIAWLQRLQSVCPPLH

SEQ ID NO: 28432 - protein, 181 aa, Brassica napus
MAVSKSFLVSSKLETLLSNPNDPSSSPAPLIRIPTCPMNNNGSRRGLIQRARCEISSPKAASVSALEQLKTSAIDRYTKERSSIVVIGLNIHTAPVEMREKLAIPEAEWPRAITELCNLNHIEEAAVLSTCNRMEIYVLALSQHRGVKEVTEWMSKTSGIPVSDLCHHRFVMYDKDVTQHL

SEQ ID NO: 28433 - protein, 167 aa, Bacillus sp. AH 1127
FKEYIDPAVGLQGFQARRIAFNINIPKELVGQAVKFMMGLYRAFIEKDCSIAEINPLVTTGDGKVMALDAKLNFDSNALYRHKDILELRDLDEEDAKEIEASKYDLNYIPLDGNIGCMVNGAGLAMATMDIIKHYHGDPANFLDVGGGATAEKVTEAFKIILSDKNV

SEQ ID NO: 28434 - protein, 329 aa, Oceanicola granulosus HTCC2516
MTTILVTGGAGYIGSHACKVLAAAGYTPVTYDNLDTGWRDSVKFGPFEQGDLLDRDRLDQVFAAYRPAAVMHFAALSQVGESMTEPGKYWRNNVCGSLSLFEAAIHAGCLDVVFSSTCATYGEQDGVVLDEDSAQQPLNSYAASKRAIEDMLDNFGASHGLRSVIFRYFNVAGADPEGEIGEFHQPETHLVPLMLDAIDGKRDALTIFGTDYDTPDGTCIRDYVHVMDLVDAHVLGVKWLEDGRGSRVFNLGTGTGFSVREVVDKSGSVTNREVPILEGARRPGDATALVSGSQRAMTELGWRPTRSTLETMIADAWRWHQNTSGHYSA

SEQ ID NO: 28435 - protein, 167 aa, Bacillus sp. AH 1131
FKEYIDPAVGLQGFQARRIAFNINIPKELVGQAVKFMMGLYRAFIEKDCSIAEINPLVTTGDGKVMALDAKLNFDSNALYRHKDILELRDLDEEDVKEIEASKYDLNYIPLDGNIGCMVNGAGLAMATMDIIKHYHGDPANFLDVGGGATAEKVTEAFKIILSDKNV

SEQ ID NO: 28436 - protein, 604 aa, Asparagus officinalis
MLKKITGEQTLKKPEVKRSAVELIKEKSNFLRYPLNEELVTEAPNINESAIQLIKFHGSYQQYNREERRTKSYSFMLRTKNPCGKVPNKLYLAMDDLADKFGIGTLRLTTRQTFQLHGVLKKNLKTVMSTIIQNMGSTLGACGDLNRNVLAPAAPYTSKEYVFAQETAENIASLLTPQSGAYYDLWVDGEKVMSAEPPEVVKARNDNSHGTNFPDSAEPIYGTQFLPRKFKIAVTVPTDNSVDILTNDIGVVVVSDSDGEPQGFNIYVGGGMGRTHRVNATFPRLGEPLGYVPKEDILYAIKAIVCTQRDNGRRDDRRYSRMKYLINEWGIDKFRSVVEQYYGKKFEAFRKLPEWEFRSYLGWHKQDNETLFCGVHVDNGRIGGQKKKTLREIIENYNLSVRITPNQNLILCDIHHSWRDSITRALDEAGLLQPNYVDPLNLTAMACPAFPLCPLAITEAERGIPDILKRVRAVFDKIGIKDNESVVVRVTGCPNGCARPYMAELGFVGDGPNSYQIWLGGTPNQTTLAECFMNKVKIQTLEKVLEPLFYSWKMNRQQGESFGQFTIRIGFSKLQEMVEKWDGHVETPSQGIFVQVAFPTFYVR

SEQ ID NO: 28437 - protein, 297 aa, Oceanicola granulosus HTCC2516
MSQRVTKAVFPVAGLGTRFLPATKALPKEIMTLVDRPLIQYAIDEARAAGISEFIFVTSRGKSALEDYFDCAPELETALKEKGKDDLYEVLQSTNMESGQIAYIRQHQALGLGHAVWCARRLVGDEPFAVILPDDVIAADKPCLQQMVEAHEETGGCMVAAMEVPREKTSSYGILDCKDDMGSLVSVKGMVEKPKAEDAPSNLAVIGRYILTPQIMKNLNEVDRGAGGEIQLTDAIAMEINSARDVYGYRFQGERFDCGSKAGFLQATVAFGLARPDLRDELSQYLDELSSTRAAAQ

SEQ ID NO: 28438 - protein, 376 aa, Synechococcus sp. WH 7803
MIPGPTPVPETVLKAMGRHPIGHRSGEFQAVVERTNAQLRWLHQTSSDVLVITGSGTAAMEAGIINTLSRGDRVLCGDNGKFGERWVKVARAYGLDVEVIKAEWGQPLDPEAFRRALEADTDKAVKAVILTHSETSTGVINDLETISSHVKAHGVALTIADCVTSLGATNVPMDAWGLDVVASGSQKGYMMPPGLSFVAMSDRAWSAYERSDLPKFYLDLGPYRKTAAKNSNPFTPAVNLYFALDAALEMMQTEGLDSIFARHARHRAAATAAMKAIGLPLFAAEGYGSPAITAVAPDGIDAEQLRKTVKERFDILLAGGQDHLKGQVFRIGHLGFVCDRDVLTAVAAIESVLQSLGLHKGTMGAGLSAASSALNS

SEQ ID NO: 28439 - protein, 539 aa, Synechococcus sp. WH 7803
MRPPVPRLTGEMSQAPNEGQRQPAIVILDFGSQYSELIARRVRETEVFSVVLGYSTTAEDLRRMAPLGIILSGGPSSVYAEHAPLCDPEIWNLGIPVLGVCYGMQLMVQQLGGRVVAATGKAEYGKAPLEVDDPTDLLTNVDNGSTMWMSHGDSVEALPDGFVRLAHTANTPEAAVANLQRRLYGVQFHPEVVHSTCGMAMIRNFVYHICGCEPDWTTAAFIEEAVKQVRSQVGDKRVLLALSGGVDSSTLAFLLKKAIGDQLTCMFIDQGFMRKGEPEFLMDFFDRKFNIHVEYINARQRFLDKLKDITDPEQKRKIIGTEFIRVFEEESRRLGPFDYLAQGTLYPDVIESAGTDVDPKTGERVAVKIKSHHNVGGLPKDLQFKLVEPLRKLFKDEVRKVGRSLGLPEEIVRRHPFPGPGLAIRILGEVTAEKLNCLRDADLIVREEVKEAGLYHEIWQAFAVLLPVRSVGVMGDKRTYAWPIVLRCVSSEDGMTADWSRLPYDLMETISNRIVNEVKGVNRVVLDITSKPPGTIEWE

SEQ ID NO: 28440 - protein, 543 aa, Schizosaccharomyces pombe 972h-
MSGGWDESKYVDNGEDEVVRQVSEPSVEEPIEASVTRYRSDEEKLDDKSSGAHVTEKEAEFDIEGGSRETSQWKHFLNVAVAGVALMSDGYCSNSIGTVITILRKLYPEETTHNKSLQDIGMIAYVGTIVGQLSFGWYSDRFGRKNGMITATIILIVSTALCTGAYGYKGSINGMLSALIAYRFFLGIGIGAEYPCGSVAASESSNELKSGLRHAAFIVVTDGAIDFGFVVGALVPYILVCIFGEHHLRIVWRLSIGLGLVIPCVLLPFRIAMKDPKTYVKHKVPLTKIPWLLVLKMYGFRLFILCLIWFVYDLSAFAFGLYSSTIVDGVLPADASTARSFGWNVLINTFYLPGALLGGVFSDLLGPKYCLITGLVLQSIFGFFMSGFYNQLVHKIAGFCVIYGIFLTLGEFGPGGNIGLLASKTSPTAIRGVYYGIAAAIGKCGAIAGVYAFGGDQVRNYFYAASAMAIFVAVLALLFVPKLKQTCIEDEDKRFIQACIDAGYGNPYNYEKNEPEQLEEPDRPPAFNPFLSATFSFHHIILC

SEQ ID NO: 28441 - protein, 386 aa, Oryza sativa Japonica Group
MVREPQDLRLGERDLLEEMSMNEEVEDGEVKPLGRVESMDETPGEVAKLRCRHGARGAAVVASAWRGSNTGEAGEQRWWGAQDRASGAGDPPGPSSPCSKTCRLITPESIIATISHRSTMNGIELSSEDKAILVETLKNKLQALAEQHVDVLESLAPSVRKRVDVLMEIQSQHDELEVKFFEEKAALEAKYQKLYGPLYSKEKGVPDFWLNAMKNNEILAEEIHESDEEALKYLKDIKWCRIDDPKGFKFEFFFYTNPFFKNQVLTKTYHMIDEDDEPILEKAIGTEIEWHPGYCLTQEVLTKESSESTKPITKTEECESFFNFFSPPQVPDDDAKIDENTAEELQNQMERDYDIAEAVQDEDYGASWVDDEEEDDNNDEYSDEEA

SEQ ID NO: 28442 - protein, 492 aa, Zea mays
  misc_feature (298)..(298): Xaa can be any naturally occurring amino acid
MMDLADSQQQRFIAGAALLVATVAFFRFLLRSRSGGKRLPPTIPGAPVVGGLVKFMRGPIPMIREQYARLGSVFTVPIISRKITFLVGPEVSAHFFKGNEAEMSQQEVYRFNVPTFGPGVVFDVDYSIRQEQFRFFTEALRANKLRSYVDQMVVEAEEYFSKWGESGTVDLKYELEHLIILTASRCLLGREVREKLFDDVSALFHDLDNGMQPISVLFPYLPIPAHKRRDRARARLAEIFATIIKSRKASGQSEEDMLQCFIDSKYKNGRPTTEGEVTGLLIAALFAGQHTSSITSFXTWTGAYMLRFKQYFAEAVEEQKDIMKRHGDKIDHDILAEMDVLYRCIKEALRLHPPLIMLLRQSHSDFTVTTKEGKVYDIPKGHIVATSPSFANRLPHIYKNPDSYDPDRFGPGREEDKAAGAFSYISFGGGRHGCLGEPFAYLQIKAIWTHLLRNFEFELVSPFPENDWNAMVVGIKGEVMVNYKRRKLVVDN

SEQ ID NO: 28443 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGRLFARTATPVEGGKQEWVEALRQALLASKIISYAQGFMLIREAGESYGWDLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 28444 - protein, 89 aa, Brassica napus
  misc_feature (7)..(7): Xaa can be any naturally occurring amino acid
  misc_feature (11)..(11): Xaa can be any naturally occurring amino acid
  misc_feature (20)..(20): Xaa can be any naturally occurring amino acid
  misc_feature (23)..(23): Xaa can be any naturally occurring amino acid
  misc_feature (39)..(40): Xaa can be any naturally occurring amino acid
  misc_feature (59)..(59): Xaa can be any naturally occurring amino acid
  misc_feature (63)..(64): Xaa can be any naturally occurring amino acid
  misc_feature (86)..(88): Xaa can be any naturally occurring amino acid
MVKICCXGAGXVGGPTMAVXALXCPSVEVAVVDISVPRXXAWNSDQLPIYEPGLDDVVXQCRXXNLFFSTDVEKHVREADIVFVSXXXP

SEQ ID NO: 28445 - protein, 1708 aa, Oryza sativa Japonica Group
MAIAVRSAAAVARHSLRPPLAAPGSIRGASLLPPQRARGVGPCRARARAASSSATGGGGHLPPLFSVAPMMDWTDNHYRTLARLISKHAWLYTEMVVAETIVHQKDNLDRFLAFPAEQHPIVLQIGGSNLDNLAKATELANAYSYDEINLNCGCPSGKVAGHGCFGARLMFDPEFVGDAMSAIAANCNVPVSVKCRIGVDDRDSYEELCEFVDKVVSKSPTRHFIIHARKALLSGLSPAENRNVPPLKKPENCPISSAILFSMRVTIEVLTSGSLRSWQEEGHGNGQSGGGGPRDRAPADGNPDGRGRAGGSPEPARGPRRQRGSPSPDRCHGHHGVQTVVRDFGLGGGWPTLTKTNYIERAAVMRVRLQVRHMWEAVRYGDVDYDEDRRALDALIAAVPLEMQFSLSHKWTAKEAWDAIAVARIGSDRARKSTLQALRKEWENLAFKPGEDVDDFALRLNTLLQKMVQYGDDTYDEERAVEKLFRCVPEKYRQIARSIESLLDLSTMSIEEALGRLKVVDGDEPQPLSGPITIGGKLHLTREQWEASQGDGRKGESSPSTGGRKPCKARGGVQLRWARRRAEGGARRGAQGGAAGNHKPARDDACRNCGKLGHWAKDCRQPRRGIELSPAAPAATAFLHLDEPKVHAFLGNSSSNDKADGWYLDTGATHHMTGRREFFTELDSSVRGSIKFGDASGMEIKGVGSVTFTAKSGEHRLLTGVYYIPVLRNSIISVGQLDENGSRVLVEHGVMTIWDRRRRLLAKVTRGTNRLYILSAQVAQPVCLAARRDDEAWQWHERFGHLHFEALKWLSAKEMVRGLPCLDHVEQLCDVCVLTKQRRLPFPQQTSFRAKEQLELVHGDLCGPVTPATPGGRRYFLLLVDDLSRYMWVMVLGSKAEAADAIRRAQAAAEVECGRKLRVLRTDNGGEFTAAEFASYCADEGIQRQYTAPYSPQQNGVKRRNQTVVGMARALLKQRGMPAIFWGEVVVTAVYILNRSPTKALDGRTPYEAWHERKPGVSHLRVFGCLAFVKELGHIGKLDDRSTPGVFIGYAEGSKAYRILNSETQRVRTARDVVFDEGRGWVWDKAVDDGSTPKYDDFTVEYVHFEGAGGVGNSSSPSVSTPVPEPPPTPTPTHSRATTSTTTSSSPTPPQPVTPRAPAPTATPPSTSTPTPASVERNPVEFATPLSHDGERIDAYHDGEQLRYRTMEDLLGDQPVPGLVPPDLEAQLHLACDDGEPRSFAEAEKHVAWRAAMQSEMDAVQENRTWELADLPRGHRAITLKWVFKLKRDEAGAIVKHKARLVARGRLGVHHMDVKSAFLNGDLKEEVYVHQPPGFVIPGKEGKVLRLHKALYGLRQAPRAWNAKLDSTLKGMGFEQSPHEAAIYRRGNGGNALLVGVYVDDLVITGTKDAEVAAFREEMKATFHMSDQGPLSFYLGIEVHQDDSGITLRQTAYAKRVVELARLTDCNPALTPMEERLKLSRDSTTEEVDATQYRRLVGSLRYLTHTAGLGLLRRLRQSAVKRIIRYVAGTLDHGLYYPRCPGKAHFVEYSNSNHAGDIDTSKSTSGILFFLGECLVSWQSVKQQVVALSSCEAEYMAASAASTQALWLARLLSDLLGRDTGAVELRVDSKSALALAKNPVFHEWSKHIWVRYHFIRSYLEEGSIKASYINTKDQLADLLTKPLGRIKFLELCFRIGMAQLPHKTTHKT

SEQ ID NO: 28446 - protein, 375 aa, Methanocaldococcus jannaschii DSM 2661
MISSRCKNIKPSAIREIFNLATSDCINLGIGEPDFDTPKHIIEAAKRALDEGKTHYSPNNGIPELREEISNKLKDDYNLDVDKDNIIVTCGASEALMLSIMTLIDRGDEVLIPNPSFVSYFSLTEFAEGKIKNIDLDENFNIDLEKVKESITKKTKLIIFNSPSNPTGKVYDKETIKGLAEIAEDYNLIIVSDEVYDKIIYDKKHYSPMQFTDRCILINGFSKTYAMTGWRIGYLAVSDELNKELDLINNMIKIHQYSFACATTFAQYGALAALRGSQKCVEDMVREFKMRRDLIYNGLKDIFKVNKPDGAFYIFPDVSEYGDGVEVAKKLIENKVLCVPGVAFGENGANYIRFSYATKYEDIEKALGIIKEIFE

SEQ ID NO: 28447 - protein, 762 aa, Oryza sativa
MAAAIAVVYLSLLLLLLHGAAPAVLGYTRGDFPEDFVFGSATSSYQYEGGFDEDGRSPSNWDIFTHQGKMPGRSTADVAADGYHKYKDDLKLMVDTNLEAYRLSISWSRIIPNGRGDVNPKGLQYYNDIIDGLVKNGIQVHIMLYQLDLPQVLEDEYDGWLSPRILEDFKAYADVCFKEFGDRVAHWITIDEPNVASIGSYDSGQLAPGRCSDPFGIRKCTVGNSSVEPYIAVHNMLLAHASVTKLYREKYQSCGALSRVLRPLVFGDYPQVMKNIVGSRLPSFTKAQSEDVKGSLDFIGMNHYYSLYVNDRPLGKGTRDFVADISIYYRGSKTDPPPGYGSSNDTVHDNDRVDYLKSYIGSILTALRNGANVKGYFVWSFVDVFEYLTGYGQSYGLYRVDFADESRPRQARLSARWYSGFLKNREMDVDQSKFKKNQTEFLTKFDQIFSGIWAGRPASACNLHTTTYTLMHPQETNVDESIYALHRSPYPPRGFHLPPTPPNKHYSLRFTMRAIVEELAGFGVRVHTCSRHDADLQDCLRRWNAADGGGLGGGAAAPVTASVCDVSVRGDREALVAAARAALGGRLDILVNNVGQTLFGAAAACAAEDYARIMATNLESCFHLAQLAHPLLLGAGGAAASVVNISSVAGFIAYPALSVYSATKGAMNQLTRSLAAEWARDGIRVNCVAPGGVRTDIAGSSGVALEPGAARAMEEREAARVVMGRIGEPEEVASLVAFLCMPAAPYITGQVICVDGGRTITA

SEQ ID NO: 28448 - protein, 336 aa, Mycobacterium leprae TN
MHAIVAESANQMVWREVPDVTAGPGEVLIEVAASGVNRADVLQVAGKYPHPPGASAIIGMEVAGVVAAVSSGVTEWSVGQEVCALLAGGGYAEYVAVPASQVMPIPKGVNVVDSAGIPEVACTVWSNLVMAAHLSAGQLLLLHGGTSGIGSHGIQVARALGAKVAVTAGSEEKLEFCRALGAQITINYRDEDFVARLQQQNGGADVILDIMGAAYLDRNIDALAIDGQLIVIGLQGGVKGELNLGKVLSKRARIIGSTLRARPVNGPNSKSEIVAAVTASIWPMIADGSVRPIIGARMAVQQAADAHQLLLSGKVSGKIVLTVAGSGTETLLSRHH

SEQ ID NO: 28449 - protein, 170 aa, Oryza sativa Japonica Group
MATLARVSLPSVLLTLRHGATTQGFAAARPAAVVAKRLLGSVRCGGAAEALGADMAVPRSVPVRVAHELQQAGHRYLDVRTEGEFAGGHPVGAVNIPYMYKTGSGLTKNTHFLEKVSTTFGKEDEIIVGCQSGKRSLMAASELCSAGFTAVTDIAGGFSAWKENELPTNK

SEQ ID NO: 28450 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGRLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 28451 - protein, 148 aa, Glycine max
  misc_feature (62)..(62): Xaa can be any naturally occurring amino acid
  misc_feature (67)..(67): Xaa can be any naturally occurring amino acid
GPQIRVIVEYATLQRVPRQWYKKDLCDGTIYKESEDLECIELLAKPVENITRAVIQLVNREXITNWXEKDMPIITPLMCFVRPSRTAMGHMRPLSNGKGNITAGASLYGGPSYATSRRGLGKKRVIATMYVARDPMKSCTVRDEPSYT

SEQ ID NO: 28452 - protein, 212 aa, Bacillus anthracis str. Ames
MGTNKPVVIGIAGGSGSGKTSVTKAIFDHFKGHSILILEQDYYYKDQSHLPMEERLKTNYDHPLAFDNDLLIEHLQQLLAYKQVDKPVYDYTLHTRSEEIIPVEPKDVIILEGILILEDPRLCELMDIKLFVDTDADLRILRRMQRDIKERGRTMDSVIDQYVNVVRPMHNQFIEPSKKFADIIIPEGGQNHVAIDSMVTKIATILEQKVNL

SEQ ID NO: 28453 - protein, 398 aa, Rhodococcus sp. RHA1
MSIVSEFTTPQKVELTDEEIFAGHLGGKLSVELTARLDTQRDLSIAYTPGVAQVSRAIHVDETLADRYTWTSRLVVVVSDGSAVLGLGDIGPRASLPVMEGKSALFKNFAGLNSIPLVLDTKDPDEIVETLIRLRPSFGAVNLEDISAPRCFEIEKRVIEALDCPVMHDDQHGTAIVVLAALKGAVTVQDRDIHQLRVVISGAGAAGVACANILLAAGIADVTVLDSKGIVSKDRQDLNEVKVDLAARTNPAGRRGGIVEALDGADVFLGVSAGTVPEELIATMAEGSIVFALSNPDPEIHPDIARKHAAIVATGRSDFPNQINNVLAFPGVFRGALDAGARRITEGMKLAAAEAILSVVGDELAVDKIVPSPLDPRVAPAVAEAVAAAARAEGVTDR

SEQ ID NO: 28454 - protein, 331 aa, Chlamydomonas reinhardtii
MATLPGAAAAAPGANAEVGVPEPSLEPQDALQQRIALAEGLLALNEADAMQAWQQLPREALLEQVAKYRGAVRDMASALRSSTLPGGVPPHCVPIHANVTTFDWPSLYSHAQFDVIMMDPPWQLATANPTRGVALGYSQLNDDHISRLPVPQLQRQGGYLFVWVINAKYKWTLDLFDRWGYRLVDEVVWVKMTVNRRLAKSHGYYLQHAKEVCLVAKRGNPPVPPGCEGGVGSDIIFSERRGQSQKPEEIYHLIEQLVPNGRYLEIFARKNNLRNYWVSIGNEVTGTGLPDEDMQALRDLHHIPGAVYGKNAPHLVSKLFLYAPNSSREEG

SEQ ID NO: 28455 - protein, 908 aa, Ostreococcus tauri
MRTYTRSSEGPRPFHESAPSPVRASPVRRAVHIADASAGAVTSDHYRRARSNGAARAVRGADETSSSGFDSTEASLESVDDALESDLQRRRRPGGAPELRLPGGHAGVRERAADDKHWRSTHARIANGAVVPQQLIGGTPMIDLSEFSANPKVKIYGKCEYMNPSGSIKDRIAQEILTRALETGELKPGMTVVAATSGNTGAAIAMACAIRGFDYIVITNKKTSKEKIDAMKAYGGQVIVAESGVPADHPDHYQNIETTMCAQNPNYYGVNQYDNPYNADAYEKTLGPEIWSQTKGAVTHFIAGGSTGGTITGTGRYLKSVDPTIKIMLADPKGSVLWDYFVNDVPEEDLVAKSWEVEGVGKDSIPGVLQTEYIDGAVKGCDASSFRICRMVAESSGILLGGSSGLNLHAARVLSSQIKEGVIVTVLCDSGVKYLSKIFNDEWLESKNLNQPLSDVKNFQVAWKKDQSEASDDEDADHGLWSRDDEEKELRFLDEIATHMVEYYRNSARAADPVSTYNSPLALHEKFKEVGIPLAIGTGEEPVSMSLLTTAMNTVIQNSARTSHPMLGGTRGGRDGGRMRRMGELSWELGAAGEEEEEEEQGQEGEEISREEVLALSVELIESIASGKEPLDAARLGSLLWTLSNALLEDLTDRDDLRVPGNSLETFPVELVRNVMGAVETLVVALTFEPEDAVTQRSGHAIPAIGTHRVAAAEIIAVLLQIGCQDIDERIAKLKLPNDGQFVLVSLVRMFFKYSWSSALHATVVRLILAALVSPHEPLWAPMFEGGDESLQGSLAASMKTALATKPISTRDGNVGSVIILANALHELETCDDVERQSVRTTLQEDATWRAAIDGEDSPLANLNNEQAGGLCGPKPQKSPVFMDSGMGANVISSQELLRMLQHISLGQ

SEQ ID NO: 28456 - protein, 250 aa, Treponema denticola ATCC 35405
MKKFYIAANWKMNMNRAEAKQLATEMKAGLKDGKNKYMIAPSFTLLQDVASVLKGSNILLGAQNMGLEEKGAHTGEVSVLQLLDVGVQAVILGHSERRHIYKETDDLINKKVKLALKHGLEVILCVGELLEEREAGHAEAVCERQIKKGLAEVSAKDLDKVTIAYEPVWAIGTGKNASPEDADAIHSSIRKTLAALYGEKAAKNMIIQYGGSMKPENAAGLLKKHNIDGGLIGGAGLKTETFLPIALFSE

SEQ ID NO: 28457 - protein, 167 aa, Bacillus cereus ATCC 14579
FKEYIDPAVGLQGFQARRIAFNINIPKELVGQAVKFMMGLYRAFIEKDCSIAEINPLVTTGEGKVMALDAKLNFDSNALYRHKDILELRDLDEEDSKEIEASKYDLNYIPLDGNIGCMVNGAGLAMATMDIIKHYHGDPANFLDVGGGATAEKVTEAFKIILSDKNV

SEQ ID NO: 28458 - protein, 584 aa, Bordetella petrii
MRVLRWAGAWCAALLCGAAAGQPAAPAAHESLNPEAASGYVAKQAVTARRFMVATANPLASEAGYRILREGGSAVDAAIAAQLVLGLTEPQSSGIGGGGFMLHYAAGTHELRVYDARETAPAAARPDRFMRDGKPLPFRQAVNNGMSVGTPGLLRGLELAHRQQGRLPWRSLFEPAIALATQGFEVSPRLHALLADARAELAAQPAAARYFYAPDGQPWPVGHVLKNPDYAQVLRRVADKGADAFYHGDIAHDIVAAVRAHAVPGDLSVADLAGYRARVRDAVCADYRAYRLCGPPPPSSGPLAVMQMLGILQRFPMDKLGPQSVEAVHYFAEAGRLAFADRGFYVADPAFADVPVAAMLQPAYLARRAALIRPDRSMGTALPGDPAGLLVRRARDDALEVPSTSHVVVADAQGNVVSMTNSIESAFGSKIFVRGFLLNNELTDFSLSFQDPEGRLVANRVQPGKRPRSSMAPLIVFRDDKPYMAVGSPGGSAIINYVAKTLVGVLDWNLDIQQAIALPNMGSRNQATELERGTALENMMPALRGMGHEVKAVEFPSGIQGIVMQDGRLMGGADPRREGLVLGE

SEQ ID NO: 28459 - protein, 167 aa, Bacillus cereus
FKEYIDPAVGLQGFQARRIAFNINIPKELVGQAVKFMMGLYRAFIEKDCSIAEINPLVTTGDGKVMALDAKLNFDSNALYRHKDILELRDLDEEDAKEIEASKYDLNYIPLDGNIGCMVNGAGLAMATMDIIKHYHGDPANFLDVGGGATAEKVTEAFKIILSDRNV

SEQ ID NO: 28460 - protein, 378 aa, Arabidopsis thaliana
MSYSSPAQSKIMEELGLSVADYSFFTSVMTLGGMITAVFSGKISALVGRRQVISYYCWTGSGLSFEFFWIFYDDTMWISDVCCIFGWLAVAFAHDIIMLNTGRLFLGFGVGLISYVVPVYIAEITPKTFRGGFSYSNQLLQCLGISLMFFTGNFFHWRTLALLSAIPSAFQVICLFFIPESPRWLAMYGQDQELEVSLKKLRGENSDILKEAAEIRIGLGLMLLQQFCGSAAISAYAARIFDKAGFPSDIGTTILAVILIPQSIVVMLTVDRWGRRPLLMGYVSSFGIGLGGLPWVIMSEIFPVNVKITAGSLVTMSNWFFNWIIIYSFNFMIQWSASGTYFIFSGVSLVTIVFIWTLVPETKGRTLEEIQTSLVRLS

SEQ ID NO: 28461 - protein, 331 aa, Bacillus cereus ATCC 14579
MNLAKFPRKKYTESYTPIEKLNNFSEALGGPTIYFKRDDLLGLTAGGNKTRKLEFLVADAQENGADTLITAGGIQSNHCRLTLAAAVKEKMKCILVLEEGLETEEKRDFNGNYFLYHLLGAENVIVVPNGADLMEEMHKVAKEVSEKGNTPYVIPVGGSNPTGAMGYVACAQEIMAQSFEQGIDFSSVVCVSGSGGMHAGLITGFSGTQSHIPVIGINVSRGKAEQEEKVAKLVDETSAHVGIPNFISRDAVTCFDEYVGPGYALPTPEMVEAVQLLAKTEGILLDPVYTGKAVAGLIDLIRKGNFNKEDNILFVHSGGSPALYANTSLFV

SEQ ID NO: 28462 - protein, 229 aa, Candida albicans SC5314
MSVSAPEDIRPSTSNGDQSNRDTNTPATSTSASTTALPPPQQQQQPSSSTTTTDNNNNNNNNNQTSQQPQEKKEKIIPRDVRLLHLIFATHAVHNYQDHVPLQLMDFAHRYTKSVLKDALVYNDHSKPINANTNLNSNTNATVNTDDIRLAIAARSNYQFKPVPPKELLLELAQERNSRPLPPVIPRWGLNLPPEKYCLTAKDWDSIYDEPDEDNNQSSQQKNKKLKTK

SEQ ID NO: 28463 - protein, 752 aa, Schizosaccharomyces pombe 972h-
MANSATITSKKGVKSHQKDWKIPLKVLILICIAVASVSSRLFSVIRYESIIHEFDPWFNFRASKILVEQGFYNFLNWFDERSWYPLGRVAGGTLYPGLMVTSGIIFKVLHLLRINVNIRDVCVLLAPAFSGITAIATYYLARELKSDACGLLAAAFMGIAPGYTSRSVAGSYDNEAIAITLLMSTFALWIKAVKSGSSFWGACTGLLYFYMVTAWGGYVFITNMIPLHVFVLLLMGRYTSKLYIAYTTYYVIGTLASMQVPFVGFQPVSTSEHMSALGVFGLLQLFAFYNYVKGLVSSKQFQILIRFALVCLVGLATVVLFALSSTGVIAPWTGRFYSLWDTNYAKIHIPIIASVSEHQPPTWSSLFFDLQFLIWLLPVGVYLCFKELRNEHVFIIIYSVLGTYFCGVMVRLVLTLTPCVCIAAAVAISTLLDTYMGPEVEEDKVSEEAASAKSKNKKGIFSILSFFTSGSKNIGIYSLLSRVLVISSTAYFLIMFVYHSSWVTSNAYSSPTVVLSTVLNDGSLMYIDDFREAYDWLRRNTPYDTKVMSWWDYGYQIAGMADRITLVDNNTWNNTHIATVGKAMSSPEEKAYPILRKHDVDYILIIYGGTLGYSSDDMNKFLWMIRISQGLWPDEIVERNFFTPNGEYRTDDAATPTMRESLLYKMSYHGAWKLFPPNQGYDRARNQKLPSKDPQLFTIEEAFTTVHHLVRLYKVKKPDTLGRDLKQVTLFEEGKRKKLRRPAKTNEIPLRV

SEQ ID NO: 28464 - protein, 490 aa, Arabidopsis thaliana
MESGSMKTPLVNNQEEARSSSSITCGLLLSTSVAVTGSFVYGCACSSWISTNMPQIGIFIFLIKICFEFVDVNLWPNFVHYHNLKMSYSSPAQSKIMEELGLSVADYSFFTSVMTLGGMITAAFSGKIAAVIGRRQTMWIADVFCIFGWLAVAFAHYFLIKLTFHLLWFIFKDKMLLNIGRGFLGFGVGLISYVVPVYIAEITPKAFRGGFSFSNQLLQSFGISLMFFTGNFFHWRTLALLSAIPCGIQMICLFFIPESPRWLVIHTLKAMYGRERELEVTLKRLRGENGDILEEAAEIRIGLGLMLLQQFCGSSAISAYAARIFDTAGTAIYYCHVCRRPMWTPTTFDELFYRSVHMFIFNWPLLLSSGLVILTILFFGYVLSFGIGLGGLPWVIMSEVFPVNVKITAGSLVTVSNWFFSWIIIFSFNFMMQWSAFEYYTSNTKMLYFDRTYFIFAGVSLMSFVFVWTLVPETKGRTLEDIQQSLGQLS

SEQ ID NO: 28465 - protein, 422 aa, Robiginitalea biformata HTCC2501
MTFEQLELAEPILRALKKENYSRPTDIQAQAIPHVLNRRDVMGSAQTGTGKTAAFAIPILQHLERDRRYGGKRGVVNALIVTPTRELAIQIGESLTAYGHYTGIRNTVIFGGVKQGKQVEALRRGVDILVATPGRLLDLMDQGIISLSKVEYFVLDEADRMLDMGFIHDIRKIIARLPAERQSLFFSATMPDDIVSLSRKILSDPVKVAVSPVSSTAETIRQYLYYTNKSDKNDLLLHILKDPDMDQVLLFARTKHGADRIVKNLGKKKISAAAIHGNKSQNQRQKALGQFKDGKVRVLVATDIAARGIDIDQLRYVVNFDIPNVAETYVHRIGRSGRAGEEGVSISLCEPEENAYIRDIEKLIDLKIERVEDHPFPQTERPMTAAEKQEFEKEKQRRKQEYFASRKRGGGGQGRQNRGRRR

SEQ ID NO: 28466 - protein, 363 aa, Listeria monocytogenes str. 4b H7858
MTKRILMLEDGNYFIGDAIGSEKETIGEVVFNTGMTGYQETITDPSYYGQIITFTYPLVGNYGVNRDDFESINPAVKGVVVREAAEFPSNWRNQITLDDFLKEKGIPGIAGIDTRKLTKLIRKEGTLKGILAAETANKEELLHHLRSVRLPVDQVHEVSSAKAFASPGDGKRVVLVDYGVKSSILRELNKRNCYVTVVPYNTTAEEILAMHPDGVMLSNGPGDPKDVPEALEMIRGIQGKLPLFGICLGHQLFALANGADTFKLKFGHRGANHPVKELATGRVDFTAQNHGYAVEKDSLIGTDLKVTHIELNDETVEGLAHKEYPAYTVQYHPEANPGPSDVNYLFDEFMEMMNGKEEGELHA

SEQ ID NO: 28467 - protein, 609 aa, Phaseolus vulgaris
MESSVNGVDSLSEVQNSVSGVHHHDPLPSGTPQPSRPPLRASRNYDGGHQTKAIHHHNSHVINQKHSHQEGKTLKQEGLPTKLSSKQPPLDDSKGCEPNGVLESEKKRVVDNHGKNYSQPDATFCASPQNSFYSATVYSEAKESFTNTEVSECASVDKSCESEVANSSDFNESRKTSICRASTGSDASDESSTSSLSSVLYKPHKANDIRWEAIQAVRTRDGMLEMRHFRLLKKLGCGDIGSVYLAELSGTRTSFAMKVMNKTELANRKKLLRAQTEREILQSLDHPFLPTLYTHFETEIFSCLVMEFCPGGDLHALRQRQPGKYFSEHAVRFYVAEVLLSLEYLHMLGIIYRDLKPENVLVREDGHIMLSDFDLSLRCSVSPTLVKSSNNLQTKSSGYCVQPSCIEPTCVMQPDCIKPSCFTPRFLSGKSKKDKKSKPKNDMHNQVTPLPELIAEPTNARSMSFVGTHEYLAPEIIKGEGHGSAVDWWTFGIFLYELLFGRTPFKGSANRATLFNVIGQPLRFPESPTVSFAARDLIRGLLVKEPQHRLAYRRGATEIKQHPFFQNVNWALIRCATPPEVPRQVINLPQTEKDLGVKPSGNYLDIDFF

SEQ ID NO: 28468 - protein, 872 aa, Oryza sativa
  misc_feature (588)..(588): Xaa can be any naturally occurring amino acid
MELLALVVVLLVLESGVLAVDQPAGFLSIDCGLEADDSYPDDLTGITYVPDGHYTDAGENHKVTTVYRNAWWGPDTRTLYTVRSFPSAEGQRNCYSLPNDVRSKYLVRLKFLYGNYDGLDSSSLKFNLTLGVKHWDTVSIDTTDGNDGYNVHEAVFVAWASWAPVCLINIGQGTPFMSMVELRPLGILPYPAVMGNVSLSLYVRSNVGSSPDDDKLVRYPDDQYDRFWFTDAYTEADPSTTNISTQSTIQPSTEFAVPSPVLQKAVVPSGNSTKLVFFSDQLDALLHDHFVIPHFADFQNKKSREFTVSIDNGVQSSPYSTPYLKVLSVTGGWSSNSEGKYNFTIAATATSALPPILNAYEVYGRIIHDNPTTFSQDFDAIMAIKYEYGIKKNWMGDPCFPPEYVWDGVKCSDPGDKIMRIISIDLSNSELNGSISNSFTLFTALKYLNLSCNQLNGTIPDSLLKNNGSIDFSYESDGNMCKTHATPSLSRNRAVTLAVSVVAPVLVLAILVLAYLIWRAKRKLNTSSTDLAMVPELMGAPGHITNHWDHLQKPENRRFTYQELEKFTENFKHLIGHGGFGHVYYGCXEDSTEVAVKMRSELSSHGLNEFLAEVQSLTKVHHRNLVCLVGYCWEKEHLALVYEYMSRGNLCDYLRGKTGTGEILNWKTRVRVALEAAQGLDYLHKGCNLPIIHGDVKTNNILLGQNFKAKIADFGLSKTYHSDSQTHISATAAGSMGYIDPEYYTTGRLTESSDVYSFGVVLLEITTGEPPIIPENGHIVQRVKQKIVSGNISSVADAHLGGAYNVSSIWKVVNIAMMCTIDIATQRPKMGDVVVQLKESLDLVEVHGDRGDMENLASDTMSSMSTFGPSAR

SEQ ID NO: 28469 - protein, 370 aa, Bacillus halodurans C-125
MSKRDYYEVLGVDRNASADEVKKAYRKLARKYHPDVNKAPDAEDKFKEVKEAFDTLSDPQKKAHYDQFGHTDPNQGFGGGGAGDFGGFSDIFDMFFGGGGGRRNPNAPRQGADLQYTMTLEFKEAVFGKETTIEIPREETCHTCSGSGAKPGTKPESCPHCGGSGQLNIEQNTPFGRVVNRRVCHHCEGTGKYIKHKCATCGGKGKVRKRKKINVKVPAGIDHGQQIRLSGQGEAGVNGGPAGDLYIVFNVKPHEFFERDGDDIYCEMPLTFVQVALGDEIEVPTLNGKVKLKIPAGTQTGTSFRLRGKGVPNVHGRGQGDQHVQVRVITPKQLSEKEKELLREFAQMSGGRPDEQDDSFFAKVKRAFKG

SEQ ID NO: 28470 - protein, 335 aa, Zea mays
MAPLGDGGAVAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 28471 - protein, 100 aa, Arabidopsis thaliana
  misc_feature (62)..(62): Xaa can be any naturally occurring amino acid
EKQHEEGKDQSMFSTTDVVTYPAQATMVTPFTGSKRYGYLPVTRKVNNHITCITSNIGRVKXIESWTPIKKNKVETLYNLPDLNDGELAKEECFVTGNKW

SEQ ID NO: 28472 - protein, 337 aa, Aeropyrum pernix K1
MKFLRCKEIPPSTGKTVSIIGAGPAGLGAAGFLRCRGHEVVVYDMMPEPGGMMMFGIPDDRIPKDNIRKSVRELVEGGARIILNNKVGRDISLEDIIKASDAVLIATGTWKPRRLGAPGEDLPWVLPAADWLVEVHMARYGYLPWAKVPKVGGRILVVGGGLTAADAVHVPLTYPEFKDGVEKVVLSYRRTRDYAPMRKNEFERLIKMGAEAWELTQPIAFYEEGGRKVVKFVRMELKASDSGRPKPVPIEGSEFEAEFDWALLAIGEVPTPPFNNGCCGIELNPDGTIKTDENFMTTRKGVFASGDVRHGPSLIGKALKSGLDAAQKVHLYLTGQL

SEQ ID NO: 28473 - protein, 358 aa, Arabidopsis thaliana
MSSFTSKFADELIANAAYIGTPGKGILAADESTGTIGKRLASINVENVESNRRALRELLFTTPGALPCLSGVILFEETLYQKSSDGTPFVDMLKSAGVLPGIKVDKGTVELAGTNGETTTQGLDGLGDRCKKYYEAGARFAKWRAVLKIGVNEPSQLAIHENAYGLARYAVICQENGLVPIVEPEILVDGSHDIQKCAAVTERVLAACYKALSDHHVLLEGTLLKPNMVTPGSESAKVAPEVIAEHTVRALQRTVPAAVPAIVFLSGGQSEEEATRNLNAMNQLKTKKPWSLSFSFGRALQQSTLKTWGGKEENVKKAQEAFLVRCKANSEATLGAYKGDAKLGEGAAESLHVKDYKY

SEQ ID NO: 28474 - protein, 399 aa, Candida albicans SC5314
MATSNNSAVAGSQTTPKYNINSEENQLMIKNLNLIAARDSSLNALMRTVALGQASMQQIDVFKEYIKRAKAMGPPPHDDSVWEEVFRTPVWGSAINNESQSSQESKPSSSENKKDKDSVESKVKEEAGKTTQSNDKEKLPKETSSKNEEKAEEAEGQSKDLESTEKKELNPKDNVNVNKNENEKPGLKDKVETNEKESKPKEKEEIKDKEEQTKKNSQELKKDKVEIDGKEEKETDKSKIEKNEESEKNKAEEPKKDKSEESTKSNEESKKDEESKKDEESKKDEESKKDEESKKDEETSKKKDEDKTQANEDSTKGKKVEIDVKKEDTNEKEIPPETKSDKDLKDLPSKEKKKSFEKPPKVKKEKPPKQSKHSKAEIPDDQKLTAFQERYLEDAIIFV

SEQ ID NO: 28475 - protein, 175 aa, Zea mays
MSSPSKRREMDLMKLMMSDYKVEMVNDGMQEFFVEFKGPAESIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKVKEYCEKYAKPEDAGITPEDKSSDEELSEAILGNPDP

SEQ ID NO: 28476 - protein, 169 aa, Saccharomyces cerevisiae
MAVKGLGKPDQVYDGSKIRVGIIHARWNRVIIDALVKGAIERMASLGVEENNIIIETVPGSYELPWGTKRFVDRQAKLGKPLDVVIPIGVLIKGSTMHFEYISDSTTHALMNLQEKVDMPVIFGLLTCMTEEQALARAGIDEAHSMHNHGEDWGAAAVEMAVKFGKNAF

SEQ ID NO: 28477 - protein, 166 aa, Glycine max
MVNFMLMISADLENLTNLQPQGGCDDPNFSYLFKLKCGRCGELSQKETCVVLNDTVPLPVGKGTTHLIQKGKFCGRDGTVTMIEGKGKPLTQEISESGKYAPLMLFDCRGYEPVDFVFGDGWKVESLEGTKFENVDLSSGEYAEYDEKGECPVMISNLRATFEVTK

SEQ ID NO: 28478 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNTSPGYYDGRYWTMWKLPMFGCTDATQVINEVEEVKKEYPDAYVRIIGFDNMRQVQCVSFIAFKPPGCEESGKA

SEQ ID NO: 28479 - protein, 482 aa, Neisseria gonorrhoeae
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWDLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 28480 - protein, 884 aa, Arabidopsis thaliana
MESHRVFVATFMLILHLVQAQDQPGFINVDCGLLPRDSPYNALGTGLVYTSDVGLVSSGKTGKIAKEFEENNSTPNLTLRYFPDGARNCYNLNVSRDTNYMIKATFVYGNYDGHKDEPNFDLYLGPNLWATVSRSETVEEIIHVTKSDSLQVCLAKTGDFIPFINILELRPLKKNVYVTESGSLKLLFRKYFSDSGQTIRYPDDIYDRVWHASFLENNWAQVSTTLGVNVTDNYDLSQDVMATGATPLNDSETLNITWNVEPPTTKVYSYMHFAELETLRANDTREFNVMLNGNDLFGPYSPIPLKTETETNLKPEECEDGACILQLVKTSKSTLPPLLNAIEAFTVIDFLQVETDEDDAAAIKNVQNAYGLINRSSWQGDPCVPKQYSWDGLKCSYSDSTPPIINFLDLSASGLTGIIAPAIQNLTHLEILALSNNNLTGEVPEFLADLKSIMVIDLRGNNLSGPVPASLLQKKGLMLHLDDNPHILCTTGSCMHKGEGEKKSIIVPVVASIVSLAVIIGALILFLVFRKKKASKVEGTLPSYMQASDGRSPRSSEPAIVTKNKRFTYSQVVIMTNNFQRILGKGGFGIVYHGFVNGVEQVAVKILSHSSSQGYKQFKAEVELLLRVHHKNLVGLVGYCDEGENMALIYEYMANGDLKEHMSGTRNRFILNWETRLKIVIDSAQGLEYLHNGCKPLMVHRDVKTTNILLNEHFEAKLADFGLSRSFPIGGETHVSTVVAGTPGYLDPEYYKTNRLTEKSDVYSFGIVLLEMITNRPVIDQSREKPYISEWVGIMLTKGDIISIMDPSLNGDYDSGSVWKAVELAMSCLNPSSTRRPTMSQVLIALNECLVSENSRGGASRDMDSKSSLEVSLTFDTDVSPMAR

SEQ ID NO: 28481 - protein, 507 aa, Medicago sativa
MARGFWFILVVASVLLMLLDCCYGSFVGICYGRNADDLLPPDKVSQLVQDHKIKYVRIYDSNIQVLKSFANTGVELMIGIPNLDLLPFSQFQTNADTWLRNSILPYYPATKITYITVGAEVTESPENISALVVPAMTNVLAALKKAGLHKKIKVSSTHSLGVLSRSFPPSAGAFNSKHAHFLKPLLEFLAENQSPFMIDLYPYYAYRDSPTKVSLDYALFESSSEVIDPNTGLLYTNMFDAQIDAIYFALTALNFRTIKVMVTETGWPSKGSPKETAATPDNAQTYNTNLIRHVINETGTPAKPGEELDVYIFSLFNENRKPGLESERNWGIVYPDLTNVYSLDFTGRGPVDMTADANATSSTSNGTKWCIASSNATQLDLQNAINWACGTSGNVDCTAIQPSQPCFEPDNLVSHASYAFNSYYQQNGASDVACSFGGTGVLVDKDPTYDNCIYMKTGTNQTLASNNTTATSISSPPSSSSKGVYSSISTSALLLIFLLFLLDIGQA

SEQ ID NO: 28482 - protein, 240 aa, Oryza sativa Japonica Group
MAGAGRDELKLLGMWASPYVSRAKLALQLKGVSYEYIEEDLGNKSDLFLRSNPVHKTVPVLIHNGNPICESSIIVQYIDESFPSSAASLLPADPYDRAVARFWAAYIDDKLAAPWRMVYRVKTEEERDELMKQTLAAVDVLEGGLKECSKGKGCFFGGDSVGYVDVVLGGLVSWVHASDKLSGAKLFDAAKAPLLAAWLGRFGELDAAKAVLQDVDKVVEYAKKFQPRDSGTAADRQAVN

SEQ ID NO: 28483 - protein, 507 aa, Medicago sativa
MARGFWFILVVASVLLMLLDCCNGSFVGICYGRNADDLPPLDKVSQLVQDHKIKYVRIYDSNIQVLKSFANTGVELMIGIPNLDLLPFSQFQTNADTWLRNSILPYYPATKITYITVGAEVTESPENISALVVPAMTNVLAALKKAGLHKKIKVSSTHSLGVLSRSFPPSAGAFNSKHAHFLKPLLEFLAENQSPFMIDLYPYYAYRDSPTKVSLDYALFESSSEVIDPNTGLLYTNMFDAQIDAIYFALTALNFRTIKVMVTETGWPSKGSPKETAATPDNAQTYNTNLIRHVINETGTPAKPGEELDVYIFSLFNENRKPGLESERNWGIVYPDLTNVYSLDFTGRGPVDMTADANATSSTSNGTKWCIASSNATQLDLQNAINWACGTSGNVDCTAIQPSQPCFEPDNLVSHASYAFNSYYQQNGASDVACSFGGTGVLVDKDPTYDNCIYMKTGTNQTLASNNTTATSISSPPSSSSKEVYSSISTSALLLIFLLFLLDIGQA

SEQ ID NO: 28484 - protein, 515 aa, Oryza sativa Japonica Group
AAATSPARAAAWTFAAATCVKLLLVPTYRSTDFDVHRYWLALTHALPARRWYTDASSQWTLDYPPFFAYFSRLLALPAPLVDASLVSLPVPDAPPSFAYLLYLRLTVAFSDLLLLLSSVLLLATDALTRRRRRPFLSLALVLWSPALLAVDHVHFQYNGFLMGLLLLSLHFLEQGRDLAGGVVFAALLCSKHLFLVAAPVYFVYLFRHYCCGRGVVRGLGRLVLMGAGVAAVFAAAFVPFLYYGQMQQLFNRLFPFGRGLCHAYWAPNFWVFYILLDKIFAFLLRRLGFNIQIPEASFTGGLVGNSSPFAVLPKVTPITTFLLVILAMSPCLMKAFSKPQPRHIIRWVSYATTCGFMFGWHVHEKASLHFTIPLALIAMDSLEDAKHYFVLSIVSCYSLFPLLFENQEYPIKVMLLLTYATLMWVGFSSHFAAKSPQEGKKVNESGSVVRKNSFIGWISFSYLLGIVAIELWSQVFHHYVFGSRFPFLPLIMVSLYCGVGMMYSWMWQLAWIVRH

SEQ ID NO: 28485 - protein, 463 aa, Methanococcoides burtonii DSM 6242
MSFDNLNLIFPLQRALTEEGYTSPTPIQELSIPHLLDNRDMIGIAQTGTGKTAAFILPILQNMSAIHKKATPKKPRVLVLAPTRELAAQIGESFATYGKYTRYKHTVVFGGVGQTPQVRALSRGVDCLVATPGRLLDLIQQGHIKLSNVEYFVLDEADRMLDMGFLNDVNKIVDMLPKKRQSLFFSATMSPEISTLARKMLSNPAQVEVTPQATTVERIEQFIFFVDSDNKNELLLHLLRGEHLDCVLVFTRTKHRANKVTEMLNKSNINAGAIHGSKSQTHRTKTLQNFKSGQLRVLVATDIAARGIDIEDISHVINYDLPNIPESYVHRIGRTARAGAEGTAYSFCAADERDFLRDIEKLTDMEIEVAEHNYHSEKAKNATGDAAKPAPKQQRGRTGSTGPKRGRGKKGEGKGGRSSSANKDSKNKDGRSENTNRGQAKSTSKKNSGRNSGRGAGKPKSSQ

SEQ ID NO: 28486 - protein, 167 aa, Bacillus sp. AH 407
FKEYIDPAVGLQGFQARRIAFNINIPKELVGQAVKFMMGLYSAFIEKDCSIAEINPLVTTGDGKVMALDAKLNFDSNALYRNKDILELRDLEEEDSKEIEASKYDLNYIPLDGNIGCMVNGAGLAMATMDIIKHYHGDPANFLDVGGGATAEKVTEAFKIILSDKNV

SEQ ID NO: 28487 - protein, 131 aa, Streptococcus pneumoniae
RFAKFEMIELSDEKTPDKASESENQKILEIEGQRILSKIADRDFVIVLAIEGKTFFSEEFSKQLEETSIKGFSTLTFIIGGSLGLSSSVKNRANLSVSFGRLTLPHQLMRLVLVEQIYRAFTIQQGFPYHK

SEQ ID NO: 28488 - protein, 1146 aa, Arabidopsis thaliana
MTTVIDATMAYRFLEEATDSSSSSSSSKLESSPVDAVLFVGMSLVLGIASRHLLRGTRVPYTVALLVIGIALGSLEYGAKHNLGKIGHGIRIWNEIDPELLLAVFLPALLFESSFSMEVHQIKRCLGQMVLLAVPGVLISTACLGSLVKVTFPYEWDWKTSLLLGGLLSATDPVAVVALLKELGASKKLSTIIEGESLMNDGTAIVVFQLFLKMAMGQNSDWSSIIKFLLKVALGAVGIGLAFGIASVIWLKFIFNDTVIEITLTIAVSYFAYYTAQEWAGASGVLTVMTLGMFYAAFARTAFKGDSQKSLHHFWEMVAYIANTLIFILSGVVIAEGILDSDKIAYQGNSWRFLFLLYVYIQLSRVVVVGVLYPLLCRFGYGLDWKESIILVWSGLRGAVALALSLSVKQSSGNSHISKETGTLFLFFTGGIVFLTLIVNGSTTQFVLRLLRMDILPAPKKRILEYTKYEMLNKALRAFQDLGDDEELGPADWPTVESYISSLKGSEGELVHHPHNGSKIGSLDPKSLKDIRMRFLNGVQATYWEMLDEGRISEVTANILMQSVDEALDQVSTTLCDWRGLKPHVNFPNYYNFLHSKVVPRKLVTYFAVERLESACYISAAFLRAHTIARQQLYDFLGESNIGSIVINESEKEGEEAKKFLEKVRSSFPQVLRVVKTKQVTYSVLNHLLGYIENLEKVGLLEEKEIAHLHDAVQTGLKKLLRNPPIVKLPKLSDMITSHPLSVALPPAFCEPLKHSKKEPMKLRGVTLYKEGSKPTGVWLIFDGIVKWKSKILSNNHSLHPTFSHGSTLGLYEVLTGKPYLCDLITDSMVLCFFIDSEKILSLQSDSTIDDFLWQESALVLLKLLRPQIFESVAMQELRALVSTESSKLTTYVTGESIEIDCNSIGLLLEGFVKPVGIKEELISSPAALSPSNGNQSFHNSSEASGIMRVSFSQQATQYIVETRARAIIFNIGAFGADRTLHRRPSSLTPPRSSSSDQLQRSFRKEHRGLMSWPENIYAKQQQEINKTTLSLSERAMQLSIFGSMVNVYRRSVSFGGIYNNKLQDNLLYKKLPLNPAQGLVSAKSESSIVTKKQLETRKHACQLPLKGESSTRQNTMVESSDEEDEDEGIVVRIDSPSKIVFRNDL

SEQ ID NO: 28489 - protein, 290 aa, Rhodobacter sphaeroides
MSKKHPIISVTGSSGAGTSTVKHTFDQIFRREGVKAVSIEGDAFHRFNRADMKAELDRRYAAGDATFSHFSYEANELKELERVFREYGETGQGRTRTYVHDDAEAARTGVAPGNFTDWRDFDSDSHLLFYEGLHGAVVNSEVNIAGLADLKIGVVPVINLEWIQKIHRDRATRGYTTEAVTDVILRRMHAYVHCIVPQFSQTDINFQRVPVVDTSNPFIARWIPTADESVVVIRFRNPRGIDFPYLTSMIHGSWMSRANSIVVPGNKLDLAMQLILTPLIDRVVRESKVA

SEQ ID NO: 28490 - protein, 223 aa, Triticum aestivum
VEPREAELSTMAEGVVRRNYTTWDDEMDGALLEVLVDHHNNGDHSQNGWKPHVYCAAIRNVKEKCNKNITKDNILGRLRTFDRYYEVITKILSQSGFGWDWVNHKLSMDSDDVWIKYVEANKKEKGLASYKTKVVKHWESISIIYSKDHANGEGAMTGAETTADPEAEPIEISPEVAPKRQRTGESIMCMIGEMRATFKDALKTTDPLPLPKATTPAAILAAL

SEQ ID NO: 28491 - protein, 452 aa, Ostreococcus tauri
MAEVNERTTRLDSHMERTCVKGTTSPVCSSFHILNSSYQLLLSRDWRGEITCACLRRLIQRLAYNLDNGVSVPIVFDPQSHVCMLFVTHNDILIACTAETGTDYMATFIFLHKLIDVFSAYFDCFIEESIRDNFVIIYELLDEVVDNGYPQLTDSAVLGEFIKVLAHRFETPHLLSAATTATSWRKHGIFYKKNEVFLDVIESCSLFVDAHGRETRSLLTGTLTLRSQLSGMPKCHLSLNERAIRAAGVHSAAIGTGTLEDVNFHPSVDLSAFRSRGLICFTPPDGTFDLLTYRTLHPAKPLLDIHASTTTTGLSTVEYTVNLSTLFKEQNMASNVRIEIPVAADATSPEIQCSHGSVVYQPEDDVLTWTLKNVKGKREFKLQAKLHLPSTGVKQTRRKTSVPVRVSFEVPYTTASGLQVKYLKVIEKEGYTALPWVRYITRSDDYAFRFRE

SEQ ID NO: 28492 - protein, 763 aa, Bacteroides thetaiotaomicron VPI-5482
MNKIISKERFSEKVFKLEIEAPLIAKSRKAGHFVIVRVGDKGERMPLTIAGSDLKKGTITLVIQEVGLSSTRLCELNEGDYITDVVGPLGQATHIENFGTVVCAGGGVGVAPMLPIVQALKAAGNRVITVLAGRNKDLIILEKEMRESSDEVIIMTDDGSYGRKGLVTEGVEEVIKREKVDKCFAIGPAIMMKFVCLLTKKYEIPTDVSLNTIMVDGTGMCGACRITVGGKTKFVCVDGPEFDGHQVDFDEMLKRMGAFKKIEREEMNKLQPECEATKEIDEKSRNAAWRQELRKSMKPKERTAIPRVEMNELDAEYRSHSRKEEVNQGLTAEQAVTEAKRCLDCANPGCMEGCPVGIDIPRFIKNIERGEFLEAAKTLKETSALPAVCGRVCPQEKQCESKCIHLKMNEKPVAIGYLERFAADFERESGQISVPVIAEKNGIKVAVIGSGPAGLSFAGDMAKYGYDVTVFEALHEIGGVLKYGIPEFRLPNKIVDVEIDNLVKMGVTFIKDCIVGKTISVEDLKEEGFKGIFVASGAGLPNFMNIPGENSINIMSSNEYLTRVNLMDAASEDSDTPVAFGKNVAVIGGGNTAMDSVRTAKRLGAERAMIIYRRSEEEMPARIEEVKHAKEEGVEFLTLHNPIEYIADEQGCVKQVILQKMELGEPDASGRRSPVAIPGATETIDIDLAIVSVGVSPNPIVPSSIKGLELGRKGTIAVDDNMESSIPMIYAGGDIVRGGATVILAMGDGRKAAAAMNEQLQSK

SEQ ID NO: 28493 - protein, 517 aa, Oryza sativa Japonica Group
MAFLFPSLLLPWLPWLLGSLLSVYLLDLLAHSRRRLPPGPRPLPFIGSLHLLGDQPHRSLAALAMAYGPLMSLRLGAVTTVVASSPAVAREILHRHDAAFASRSSPDSTGDHARSSVAWLPSSAPRWRALRRIMATELFAPHRLDAAAPRPLRREKVRELVAHVARLAAGEGGKPAVVDVGRVAFATSLNLLSRTIFSRDLTSLDDHGGSKGFQEAVARIMEAGGRPNVSDFFPVLAAADLQGWRRRLARLFARLHRVFDAEVDARLREHDAGEARKGDFLDVLLGIAARRDDAAELDRDTLRSLFTDLFCAGSDTSSSTVEWAMAELMQNPKSMSRVCDELSQVIGLGRNIKESEIGQLPYLQAVVKETFRLHPPAPLLLPRQAEMTMKIAGYTIPKGTRIFVNVWAMGRDKDIWPEPEKFIPERFLGSKIDFKGVHFELIPFGAGRRICPGMPLANRMVHLILGSLLNQFKWNLPVKVERNGIDMSEKFGLTLAKATPLCALVTPISVKPADHQE

SEQ ID NO: 28494 - protein, 251 aa, Burkholderia sp. 383
MSKQRTKRVIGNWKMHGRLAGNQALLNEVVQGAGAVAAETSIGVCVPFPYLAQVQAQLDGGRVAWGAQDVSAHEQGAFTGEVAAAMVAEFGARYAIVGHSERRAYHGERNETVAAKTQRALAAGLTPVVCVGETLDERESGATEQVVGAQLDAVLAVLTADEATRIVVAYEPVWAIGTGKSATSAQAQDVHAFLRARLAAKGAADVSVLYGGSVKPDNAEELFAQPDIDGGLIGGASLKAEDFLAICRAAR

SEQ ID NO: 28495 - protein, 207 aa, Geobacillus stearothermophilus
ATTLYLTRHGETKWNVERRMQGWQDSPLTEKGRQDAMRLGKRLEAVELAAIYTSTSGRALETAEIVRGGRLIPIYQDERLREIHLGDWEGKTHDEIRQMDPIAFDHFWQAPHLYAPQRGERFCDVQQRALEAVQSIVDRHEGETVLIVTHGVVLKTLMAAFKDTPLDHLWSPPYMYGTSVTIIEVDGGTFHVAVEGDVSHIEEVKEV

SEQ ID NO: 28496 - protein, 423 aa, Saccharomyces cerevisiae
MFKRYLSSTSSRRFTSILEEKAFQVTTYSRPEDLCITRGKNAKLYDDVNGKEYIDFTAGIAVTALGHANPKVAEILHHQANKLVHSSNLYFTKECLDLSEKIVEKTKQFGGQHDASRVFLCNSGTEANEAALKFAKKHGIMKNPSKQGIVAFENSFHGRTMGALSVTWNSKYRTPFGDLVPHVSFLNLNDEMTKLQSYIETKKDEIAGLIVEPIQGEGGVFPVEVEKLTGLKKICQDNDVIVIHDEIQCGLGRSGKLWAHAYLPSEAHPDIFTSAKALGNGFPIAATIVNEKVNNALRVGDHGTTYGGNPLACSVSNYVLDTIADEAFLKQVSKKSDILQKRLREIQAKYPNQIKTIRGKGLMLGAEFVEPPTEVIKKARELGLLIITAGKSTVRFVPALTIEDELIEEGMDAFEKAIEAVYA

SEQ ID NO: 28497 - protein, 463 aa, Mycobacterium avium subsp. paratuberculosis K-10
MPQHPSLPAHAIAPAYTGRLFTAPVPALRMPDESMDPDAAYRFIHDELMLDGSSRLNLATFVTTWMDPEAGRLMAETFDKNMIDKDEYPATAAIEQRCVCMVADLFHAEGLNDADPYSACGVSTIGSSEAVMLGGLAMKWRWRAKTKDWKKRTPNLVMGSNVQVVWEKFCRYFDVEPRYLPMEEGRYVITPEQVVDAVDEDTIGVVAILGTTYTGELEPVADICGALDKLALKPASAGGVDVPVHVDAASGGFVVPFLHPELKWDFRLPRVVSINVSGHKYGLTYPGVGFVVWRSKEYLPDELVFRVNYLGGDMPTFTLNFSRPGNQVVGQYYNFLRLGREGYTKVMQTLSGTARWLGEQLRVSEHCELISDGSAIPVVAFRLAKNRGYTEFDVSHELRTYGWQVPAYTMPDNATDVSVLRIVVREGLSADLARALHDDAVSALTSLDKVKPGGHYDAQHFAH

SEQ ID NO: 28498 - protein, 313 aa, Neisseria lactamica
MTKHIAILRGDGIGPEIVAETVRVLDKLIEQGLDAGYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEREGYNTMKYSESEIRRIAHVAFQSAQKRSKKVCSVGKANVLETTELWREIFEEIGKEYPDVELSHMYVDNAAMQLVRAPKQFDVIATGNIFGDILSDEASMLTGSLGMLPSASLDENGKGLYEPSHGSAPDIAGQNKANPLATILSLAMLLRYSLNDEA

SEQ ID NO: 28499 - protein, 251 aa, Saccharophagus degradans 2-40
MGVKSKIVIGNWKMNGSAELVESFTRTMLDNQAAYAGIRVVLCPPFTLLQAMADALEGGPILLGAQNVSEFEQGAHTGEISAPMLASMGTKMVIIGHSERRASRGENDRIIAAKVKQALSVGMLPVLCVGETAEEKARGDSGAVVWQQLSVVLHAIGSELFGQLIVAYEPIWAIGSGSTASTDDILTITTAIHAKLAQLGIQLPLLYGGSVNAGNAAQISSLPTISGLLVGGASLQAGQFLLLCSNTAKGA

SEQ ID NO: 28500 - protein, 397 aa, Mesembryanthemum crystallinum
MAVSAYTVPTTSHLGFNQKKQLFFCNKSAYKRVSFSSRPCVITCLAGDSQTIVIGLAADSGCGKSTFMRRLTSVFGGAAEPPRGGNPDSNTLISDTTTVICLDDYHSLDRTGRKEKGVTALDPRANDFDLMYEQVKALKEGKAVEKPIYNHVTGLLDAPELIKPPKILVIEGLHPMFDSRVRDLLDFSIYLDISNEVKFAWKIQRDMAERGHSLESIKASIEARKPDFDAYIDPQKQYADAVIEVLPTQLIPGDNEGKVLRVRLIQKEGVQYFSPVYLFDEGSSITWIPCGRKLTCSYPGIKFFYGPDTYFGNEVTVLEMDGQFDRLDELIYVESHLSNLSTKFYGEVTQQMLKHQDFPGSNNGTGLFQTIVGLKIRDLFEQLIASKTAAPAAATKA

SEQ ID NO: 28501 - protein, 332 aa, Ostreococcus tauri
MDVDRALDDDDDADDLEWSLGFLERPIDVEALRRHHFPSKAGGAPAWLDPVRVPYEEELRTARGERMDFLLQVYAPVDEEHSAFHRTIYVFVSPHGGETHEAGGARAFRGQLPRANAYYDWNPTPNGGEVNGLSAALEATRRRRCDWWDVSASECEATMRAPTRAFEEYELVVETEERADENEEELLANATEVGADMSAEDLEAIEQEVVDKDMEQLATFHVMLHKDPEQVLRYCPEPGAKPTWPSVTHAPNTDNIPSCARCGAPRKFEFQILPTLVSQLGVDSESDYALDFGSMAVYTCSKSCPPIECDELGRRTGAYAEEYIVVHPPLNQ

SEQ ID NO: 28502 - protein, 404 aa, Schizosaccharomyces pombe 972h-
MNFRPEQQYILEKPGILLSFEQLRINFKHILRHLEHESHVINSTLTTLISQENASMDEKIEKIDSLLSRVSTVKKKMKHLHDCEALFIKQTKSRLLFMNRLQGIRDMESADFLDWSRVRLNRLVADYMMANGYHGAAALLCKDSQLENLVDLGIYKRYQLIHDSILQQELKEVLSWCSEHRAILKKNNSTLELEVRLQRFIELIKSKKLCQAIAFAKAHFGTWANEHPARLQLAAALLAFPEFTNGSPYSLLLSDDRWEYLASLFTSNFTAVHNIPSVPLLHALLAAGLSSLKTPLCYLDANDDNPLALQSQTVKQCPVCTPCLNDLGKALPYAHITQSAIVDSLTGEGLDSDNCPVAFPNGRVYGIQSLISWNEANGTREGFLRDPYSGKEFPFQLLRKVYVV

SEQ ID NO: 28503 - protein, 164 aa, Triticum aestivum
  misc_feature (31)..(31): Xaa can be any naturally occurring amino acid
  misc_feature (54)..(54): Xaa can be any naturally occurring amino acid
  misc_feature (79)..(79): Xaa can be any naturally occurring amino acid
  misc_feature (101)..(101): Xaa can be any naturally occurring amino acid
  misc_feature (107)..(107): Xaa can be any naturally occurring amino acid
SRIRRCLVDRVRASTLFVESVANTQKGINLXEPRSVEQGWNFNTTEALKIWKGXCINWAKVFDRIKKALDRNPELDQLXLRHDSQEISGRVQNRRWRWFGXAIEAAXTPGMFASLSYFDTYRCNRLPANLIQAQRDLFGAKTYERIDRPGSFHTEWNKLAREGK

SEQ ID NO: 28504 - protein, 341 aa, Neisseria gonorrhoeae
MGIKVAINGYGRIGRQVLRSIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 28505 - protein, 415 aa, Physcomitrella patens subsp. patens
MSKRALLVGCNYPGTKVQLHGCANDVRRMKALLIDRFGFDERDILVMLDTDPALPQPTGANIRKCLDKLIENTQPGDCLVFHYSGHGTQVPAESGQEDDTGAEEAIVPTDMNLLTDDDFRELVNKIPVGVTFTFLSDSCHSGGLIDSTKEQIGHTVKDVEEGEEKRGFRGFLSKAKAKYDSHKGKRKEEERPDTQNFDFESQYMEETGHQVKNKNLDINSLTEILSQRTGHEVQVGNIRTTLFDMFGDDASPKVKTFVSVILNQLQSGAGEGGFMGMVSGMAGQFLKSKLESDSPDHISSLMAAAGSAHPSNPRSAYAGVRPSASHRVREDAGILVSGCQHNETSADATPGGDHSQSYGAFSNALIGVLAKHDGPITNRDLVLQIRESLAKSGFKQHPCLFCTDQNADAHFICVD

SEQ ID NO: 28506 - protein, 582 aa, Lotus japonicus
MSSSFSIRFLAPPFPSTSRPKSCLSAATPAVAPTDAAVSRLEPRVEERNGYWVLKEEHRGGINPQEKVKLEKEPMALFMEGGIDELAKVSIEELDSSKLTKDDVDVRLKWLGLFHRRKHQYGRFMMRLKLPNGVTTSAQTRYLASVIRKYGKDGCADVTTRQNWQIRGVVLPDVPEILKGLAEVGLTSLQSGMDNVRNPVGNPLAGIDPDEIVDTRPYTNLLSHFITANSRGNPTVSNLPRKWNVCVVGSHDLFEHPHINDLAYMPANKDGRFGFNLLVGGFFSPKRCAEAIPLDAWVSAEDVIPVCKAILEMYRDLGTRGNRQKTRMMWLIDELGIEVFRSEVEKRMPLGQQLERASQEDLVQKQWERRDYFGANPQKQEGLSYVGIHIPVGRIQADEMDELARLADEYGTGELRLTVEQNIIIPNVENSKLSALLNEPLLKEKFSPEPSLLMKTLVACTGSQFCGQAIIETKARALKVTEEVERLVAVTRPVRMHWTGCPNTCGQVQVADIGFMGCMARDENGKPGEGVDIFLGGRIGSDSHLAEVYKKAVPCKDLVPIVADILVKHFGAVQRNREEGDD

SEQ ID NO: 28507 - protein, 341 aa, Neisseria gonorrhoeae
MGIKVAINGYGRIGRQVLRSIYDYQIQDQLQIVAVNASGSLETNAHLTKFDTVHGRFEADVSHDGGNLIVNGDKIPFFSTRNPTELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 28508 - protein, 538 aa, Arabidopsis thaliana
MAARRVSSLLSRSFSASSPLLFRSQGRNCYNGGILRRFGTSSAAAEEIINPSVQVSHTQLLINGNFVDSASGKTFPTLDPRTGEVIAHVAEGDAEDINRAVKAARTAFDEGPWPKMSAYERSRVLLRFADLVEKHSEELASLETWDNGKPYQQSLTAEIPMFARLFRYYAGWADKIHGLTIPADGNYQVHTLHEPIGVAGQIIPWNFPLLMFAWKVGPALACGNTIVLKTAEQTPLTAFYAGKLFLEAGLPPGVLNIVSGFGATAGAALASHMDVDKLAFTGSTDTGKVILGLAANSNLKPVTLELGGKSPFIVFEDADIDKAVELAHFALFFNQGQCCCAGSRTFVHEKVYDEFVEKSKARALKRVVGDPFRKGIEQGPQIDLKQFEKVMKYIKSGIESNATLECGGDQIGDKGYFIQPTVFSNVKDDMLIAQDEIFGPVQSILKFSDVDEVIKRANETKYGLAAGVFTKNLDTANRVSRALKAGTVWVNCFDVFDAAIPFGGYKMSGNGREKGIYSLNNYLQIKAVVTALNKPAWI

SEQ ID NO: 28509 - protein, 506 aa, Ostreococcus tauri
MDVRGGALGRAGALIDNAWTTTRRSLPVVNPHDGAVVGAIARGSVADVDDAVRSARKGFVTWSTRNGRERAKTLRAVADGLRRRRETLARLETTDCGKPLDESAWDVDDAIGCFEYYADRCERVFGERAYAEEVVELPDEDFAGRVRREPLGVIGLITPWNYPLLMATWKVAPALASGCAVVLKPSEEASLTCQVLGDVCVEAGLPPGALCVVTGRGDEAGAALCAHRGVDKISFTGSFRTGQTIMRACAQDVKPVSLELGGKSALVIFDDCDLEKAVEWAMFGCFWTNGQICSATSRVLVHENIRERFLARLKEASEAIPVGDPLAEGCRLGPLASAAQYKKVTSMVNRIKRTKIHLLTGGNRPRARGCEKGFYIEPTVFVDPPLDSEAWREEIFGPVMCVRSFRTEEEVIAITNDSEYALAAAVITDDVARRERMASAFDVGIVWIQCSQPAFTQLPWGGRRRSGFGRDLGVNGMDKYMHQKQIVEYTSGAQFEWYPMFKKSKL

SEQ ID NO: 28510 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 28511 - protein, 273 aa, Brassica napus
MSNDKDNLNMSGLTAALNEEDRAGLVNALKDKLQNLAGQHSDVLENLTPAVRKRVEVLREIQNQHDEIEAKFFEERAALEAKYQTLYQPFYTKRCEIVTGVVEVEGVPEEVKTEQGADKAAQEKGVPDFWLIALKNNEITAEEITERDEGALKYLKDITGDRVEEPKGFKLEFFFDENPYFKNTVLSKTYHMIDENEPILEKAMGTEIEWYPGKCLTQKILKKKPKKGSKNTKPITKTEECESFFNFFSPPQVPDDEEDLDDDMVWPSPPTRP

SEQ ID NO: 28512 - protein, 2116 aa, Mycobacterium leprae TN
METSVTPIAVIGMGCRLPGGINSPDKLWESLLRGDNLVTEVPPDRWDVDDFYDPEPGVPGRSVSRWGGFLDDVAGFDAEFFGISEREATSIDPQQRLLLETSWEAIEQGGLDPASLAGSSTAVFTGLTHEDYLVLTTAAGGLASPYVVTGLNNSVASGRISHTLGLHGPAMTFDTACSSGLMAVHLACRSLHDGESDLALAGGCAVLLEPHASVAASAQGMLSSTGRCKSFAADADGFVRSEGCAMVLLKRLPDALRDGNRIFAMILGTATNQDGGTETLMMPSEDAQVAVYQAALAVAGVEPETIGVVEAHGTGTPIGDPIEYRSLARVYGAGTPCALGSAKSNMGHSTASAGTVGLIKAILSLRNGLVPPLLHFDRLSDDLTEIETGLFVPQEVTPWPVGGYNTPKRVAVSSFGMSGTNVHVIVEEAPSEACAPDVPETSPGTGDATVGRQLFMLSSTSIAALRETARQLATWVEEHQDSVVLSDLAYTLARGRAHRPVRTAVVAADLPELVEGLCEIADGDALYDAVVGHGDRGPVWVFSGQGSQWASMGVQLLANEPVFAATITKLEPVIAAESSFSVTEAITAPETVTGIDKVQPSVFAVQVALATTMEQTYGVRPGAVIGHSMGESAAAVVAGALSLEDAARVICRRSKLMNRVAGSGAMGSVELPAKQVNSELMARGIDDVVISVVASPQSTVIGGATETVRDLIAQWEQRDVMAREVAVDVASHSSQVDPILDDLAAALADIAPMTPKVPYYSATLFDPRELPVCNGAYWVDNLRNTVQFAAAVQAAMEDGYRVFAELSPHPLLTHAVEQTARNLDMSVAALAGMRREQSMPYGLRGLLADLHSAGAALDFAALYPAGRLLDAPLPVWTHPRLFIDTDGQEQRAQGACTVTVHPLLGSHVRLLEEPERHIWQGDVGTAALSWLADHQVHNVAALPGAAYCEMALAAAVEVFGEAAEVRAIAFEQMLLLAAETPIDAIASVDAPGVINFVVQANQDGEKMRNATATLHAAEDDCPPPAYDIAALLEAHPNSVNGTDLRESFAERGVQLGAAFAGLATAHTAEAESGTVLAEVALPASIRFQQSSYQIHPALLDACFQSVGAGVDATKVGSRAGLLLPLGVRSLRVYRPTRNARYCYTRLTKIEPRGGEADLDVLDEHGAVLLAVRGLHMGTGTTERGELDRQLSERLLTIGWQQRTLPESVHVEPGSWLLIDTFNASAIPDMWASTLTDALKSYGTQGTECTNLSWLIQDDPVVSRERLGRQLRGRDGVVILCGPRAGAPDEQSLLAAREQVRHLVRIIRELAELEGELPRLFVVTRQAQIVQSGDAANLEQAGLRGLLRVISSEHPMLRTTLVDVDEHTDVERVAQQLLSGSEEDETAWRNGDWYVARLNPSPLSHEDRRTVVLNPEHDGLRVHVRKPGDLQSLELVASDRVPPGPGQLEVAVSMSSINFADVLIAFGRFPIIDDRDPQLGMDFVGVVTAVGEGVTGHQIGDRVGGFSEGGCWRTFLTCDANLAVTLPSGLTDEQAITAATAHATAWYGLNDLAGIKVGDKVLIHSATGGVGQAAISIARAKGAEIFATAGNPTKRAMLHDLGIEHVYDSRSVEFAEQIRRDTDGYGVDIVLNSLTGAAQRAGLELLTFGGRFVEIGKADVYGNTRLGLFPFRRGLTFYYLDLALMSVTQPDRVRELLATVFNLTADGVLTAPECTHYPLTDAANAIRAMSNAEHTGKLVLDIPRTGSRSVAVPPEQAPVYRRDGSYIITGGLGGLGLFFASKLAEAGCGRIVLTARSQPNPKARQTIERLCAAGADIVVECGNIAEPYTADRLVNAATATGLPLRGVLHSAAVVEDATLTNITDELIDRDWSPKVYGSWNLHCATIGQPLDWFCLFSSGAALLGSPGQGAYAAANSWVDLFAHWRRAQGLPVSAIAWGAWGEVGRATFLAEGGEIMITPDEGAYAFEMLVRYDRPYSGYIPILGAPWLPDLVRRSPWAEMFSSAGQGSRGPSKFRMELLALPQDEWSGRLRRLLVEQASVILRRTIDADRSFIEYGLDSLGMLEMRTHIESETGIRLTPKVIATNNTARALAQYLADTLAEEEGVAAPAAMVSPETP

SEQ ID NO: 28513 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGILGYNTLPLVSMDFNHTTEASHFDATLTKVVDGNMVKVFAWYDNEWGFSCQMLNTARRMFGLEVRP

SEQ ID NO: 28514 - protein, 163 aa, Physcomitrella patens subsp. patens
MAPIAVGDTIPDVTLSYLDDDNQSQKLSTHQDLKGKKVMLVAVPGAFTPTCSQEHVPGFIDNAKEIKSKGVSDIIVVSVNDPFVMKAWERSYDGAEHLKFVADGSLEFTKALGLELDLTDKGLGVRSRRFCLLVDDLVVKVANIEEGGAFTVSGAEEILKALV

SEQ ID NO: 28515 - protein, 347 aa, Sinorhizobium meliloti 1021
MKSYSIALIPGDGIGQDVTDAAWQVLSTVARHSGFTLTGTSFPWSCAFYKETGAMMPADGIEALRPFDAILLGSVGWPAEVPDSISLHGLLLPIRKAFVQYANIRPHRLLSGVEGPLKASDFDILCVRENTEGEYSGAGGRVHQGTADEVAVETSIFTRAGVERILRFAFEQARQRRGKLASVTKSNAQKHSMVFWDEVTRQLADEYPDVEVTSYHIDAMAARVVMAPESLDVVVASNLFGDILTDLGAAIQGGLGFAASANINPDRSAPSMFEPVHGSAPDIAHLGIANPIAAIWSGAMMLEHLGEREAAGMIMAALERTTIRGIGTVPGKDRTRSITAAVLAALD

SEQ ID NO: 28516 - protein, 554 aa, Mycobacterium leprae TN
MTSMQAIPDITATPAWDALRRHHDEIGATHLRQFFADNPNRGRELVITVGDLYIDYSKHRITHDTVQLLVDLARAANLEQRRDQMLAGVHVNTSENRSVLHTALRLPRDTELIVDGQNVVQDVHAVLDVMGDFTDRLRSGEWTGATGKRINTVVNIGIGGSDLGPVMVYQALRHYADAGISARFVSNIDPADLTAKLSDLEPGTTLFIVASKTFSTLETLTNATAARRWLTDALGEAAVSKHFVAVSTNKRLVKDFGINTANMFGFWEWVGGRYSVDSAIGLSLMAVVGRESFADFLSGFHIVDQHFQNAPLESNAPVLLGLIGLWYSDFLGAQSRAVLPYSNDLARFAAYLQQLTMESNGKSTRADGTPVTTNTGEIYWGETGTNGQHAFYQLLHQGTRLVPADFIGFSQPIDDLPTVDGIGSMHDLLMSNFFAQTQVLAFGKTAEEIAAEGTPAEVVPHKVMPGNRPTTSILANRLTPSVLGQLIALYEHQVFTEGVIWGIDSFDQWGVELGKKQAEALLPVITGNASPAQQLDSSTDTLVRRYRTERGRTS

SEQ ID NO: 28517 - protein, 341 aa, Neisseria gonorrhoeae
MGIKVAINGYGRIGRQVLRAIYDYQIQDQLQIVAVNASGSLETNAHLTKFDTIHGRFEADVSHDGGNLIVNGDKIPFFSTRNPAELPWKELGVDLVMECTGSFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 28518 - protein, 343 aa, Mycobacterium sp. MCS
MRAAIYHGREDVRIEELPDPSPRAGEVVIEVARAGICGTDLHEYIAGPMHAAPGVVIGHEYSGTVVGVGSGVREFTEGDRVCGVGVFGCGECGFCKQGAEALCGAVGFIGFAVNGALARYASLPTKALFRIPDEISLAEAAVVEPIASAYHAVRRSGLAAGGTVFIAGAGPIGLALVQFSLAKGATQVIVNEVSATRRVAAHRVGATRVIDPLAEDAVEVVRTLTNGNGVDISFDAAGVQPALDAALGVLRPRGRLMVVAIWEAPAGIDINRSVMREADIGFSFCYEAQRQVPAILDLLATGAINLGELITDEIPLDAVVSQGLEELRVNRDAHVKILIDPSA

SEQ ID NO: 28519 - protein, 339 aa, Triticum aestivum
  misc_feature (273)..(273): Xaa can be any naturally occurring amino acid
TSLYKKAGWYRSGIPGISSTHASENGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSTEKGWGLNLGELARIWKGGCIIRASFLDRIKKAYDRNGELANLLIDPEFAQEIMDRQAAWRRVVCLAINNGVSTPGMSASLAYFDSLPXRDRLPANLVQAQRDYFGAHTYERVDMPGSFHTEWVQDRQLEDLSCCSTKRRPIRFRLLGILCCCKS

SEQ ID NO: 28520 - protein, 393 aa, Mycobacterium leprae TN
MDLFEYQAKELFAKHGVPGIQGRVTDSAEGAKTIAMEIGRPVMVKAQVKTGGRGKAGGVKYAATPEEAYQQAKNILGLDIKGHIVKKLLVVEASDIAEEYYLSFLLDRANRTYLAMCSVEGGMEIEEVAATKPERLAKVSVDAVKGVDLACARSIAQQGHLPAEVLDAAAATIAKLWELFVAEDATLVEVNPLVRTPSRGYGSSGKILALDGKVTLDANARFRQPGHAEFEDRAATDPLEWKAKQHNLNYIKLDGEVGIIGNGAGLTMSTFDVVAYAGEQHGGVKPANFLDIGGGASAEVMAASLDVVLGDVQVKSVFVNIFGGITTCDTVATGIVKALEILGDEANKPLVVRLDGNNVGEGRRILAEANHPLVMLVPTMDEAANKAAELART

SEQ ID NO: 28521 - protein, 197 aa, Oryza sativa Indica Group
MDSEHWISRLAAAKRFYAAQLGHADRAGMEEVDMDEEVRPEFACPYCYEDHDVVSLCAHLEEEHPFEPHAAPCPICSDKIAKDMLNHITVQHGYLFKVLLGGGGHRSNNSSNTTNISADPLLSSFGLSFPTSDTEETSKPPISIPDDASVVKETPAQPWDSSIDSSLTREEREQKRKQASVRATFVQDLLLTTLFGD

SEQ ID NO: 28522 - protein, 197 aa, Bacillus subtilis subsp. subtilis str. 168
MNLIPTVIEQTNRGERAYDIYSRLLKDRIIMLGSAIDDNVANSIVSQLLFLAAEDPEKEISLYINSPGGSITAGMAIYDTMQFIKPKVSTICIGMAASMGAFLLAAGEKGKRYALPNSEVMIHQPLGGAQGQATEIEIAAKRILLLRDKLNKVLAERTGQPLEVIERDTDRDNFKSAEEALEYGLIDKILTHTEDKK

SEQ ID NO: 28523 - protein, 107 aa, Apium graveolens var. dulce
FDFVLFMGAVTRPPNLSIITEYLPRGSLYRLIHRPHSQIDEKRRIKMALDVAKGMHCLHASRPTIVHRDLKSPNLLVDKNWNVKVGDFGLSRLKHNTFLSSKSTAGT

SEQ ID NO: 28524 - protein, 170 aa, Bacillus anthracis str. Ames
MDFKQHIAIVPDYPKEGIVFKDITPLMNDGKAYKAATDAIVEYAKERDIDLVVGPEARGFIIGCPVSYALEVGFAPVRKLGKLPREVITVDYGKEYGKDVLTIHKDAIKPGQRVLITDDLLATGGTIEATIKLVEELGGVVAGIAFLVELTYLDGRKMLDGYDVLVLEKY

SEQ ID NO: 28525 - protein, 492 aa, Pinus pinaster
MMSASFKCPVSLSGVENICNGDKAIPGINSRTLFTGSSFLQRHHSANKIFFRTCGKKGSCCLFNIRAMAETDSGNGVPQLDISLSPRVAALKPSKTMAITDLATALKQAGVPVIGLAAGEPDFNTPDAVAEAGIKAIQDGYTRYTPNAGTMEIRTAICHKLKEENGLSYTPDQILVSNGAKQCIMAAAVLAVCSPGDEVIIPAPFWVSYTEMARLADATPVIIPTLLSDDFLLNPEVFSSKLNENSRLLILCSPSNPTGSVYPRELLEEIAKIVAKHPKLLVLSDEIYEHIMYPPAKHTSFASLPGMWERTLTVNGFSKAFAMTGWRLGYLAGPKHFVTACGRIQSQSTSGASSISQKAGVAALALGYAGSEAVSTMVKAYRERRDFLVQRLQAMEGVKLPVPQGAFYLFPDFSSYYGTEVEDFGVINGSEALCRFFLEKAQVALVPGDAFGNDDCIRISYAASLDTLRTAINNIEKSLLLLRPAAAASKAS

SEQ ID NO: 28526 - protein, 291 aa, Xanthobacter flavus
MSIKHPIIVVTGSSGAGTTSVKRTFEQIFYREKVKAAFVEGDSFHRYDRYEMRELMAAEAAKGNKHFSHFSPETNRLDDLAQLFKDYGATGSGRFRHYVHDAGEAKLYNTEPGRFTDWEDLEQGTDILFYEGLHGAVVTDELNLAQHADLKIGVVPVINLEWIQKIHRDKATRGYTTEDVTDTIMRRMPDYVRYICPQFTETDINFQRVPTVDTSNPFVARWIPTPDESMVVIRFRDPHGIDFPYLLSMIHNSFMSRANSIVIPGNKQDLAMQLLLTPLIMKLMDRKRRAG

SEQ ID NO: 28527 - protein, 312 aa, Saccharophagus degradans 2-40
MNNSVAVIGESMLELMRAESDSSCRSMPAMLSYGGDTLNSSVYMSRLGAKVEYITAVGKDKNSEWLVKQWQSEGVGTRFVRTDEKKVPGLYMVTNDESGERYFTYWRNDSAARYIIDSEEKKQALYADLEGFDWIVISGISIAILDEASKKRMYELLQQCKARGAKIAFDGNYRPALWESKEQTRQAYQTVTAFADIILPTIDDEFQLYGEEPKDEVIDRLLSYGAKEIVLKMGGEGCYTVADNERTLVPGRKVVVVDTNSAGDSFNAGYLTGRMQGMSVEESALRGHLLASTVVQYRGAIIPKTAMPKMVG

SEQ ID NO: 28528 - protein, 103 aa, Triticum aestivum
TLSGVLAGALVSGVQIAISASNTGGAWDNAKKYIEAGASEHARTLGPKGSDPHKAAVIGDTIGDPLKDTSGPSLNILIKLMAVESLVFAPFFAAHGGILFKWL

SEQ ID NO: 28529 - protein, 458 aa, Borrelia burgdorferi B31
MKKQNPWIYLNEEEKNQILNFSESYKKFISKFKTEREVTAYALDKAKKLGFINAEEKKNLMPGDKIFYTCREKSVAFAIIGKNPIEDGMNFIVSHTDSPRLDAKPSPISEENELTFIKTNYYGGIKKYQWLSTPLSIRGVVFLKNGEKVEINIGDNENDPVFVIPDILPHLDRKIQRNKKSDEIVEGENLKILIGSLPIETKEKNKVKLATLQLIKEKYKIEEEDFVSSEIEIVPAGTAKDVGFDKALIGAYGQDDKICVFTSLESIFDLEETPNKTAICFLVDKEEIGSTGSTGLDSRYLEYFVSDMIFKIKKSEYNNLHVQKALWNSKSISADVCAAINPLFSSVHDEQNAPQLGYGIPIMKYTGHGGKSMASDADAELVSYIRQLLNKNNIAWQVATLGKVEEGGGGTVAKFLAGYGIRTIDMGPAVISMHSPMEITSKFDLYNAYLAYKAFYRE

SEQ ID NO: 28530 - protein, 363 aa, Borrelia burgdorferi B31
MSFYKVIGGVFMKISVIGAGAWGTAISKSLADKFDFNIFLWVFEEDVKNDINNDNVNTKYLKGIKLPKNLVASSDLFEVVTMSDYIFIATPSLFTVDILKKLDQFLHFLEIKPKLAILTKGFITFDGKTQTVIEAAERIMKGYKDEITYIVGPSHAEEVGLGVITGLVAASNNRENAYLFINLFSKTPISLFYSNDVFGVQIAAALKNVFAIAFGILDAYKLNYPNLIGNNTESFLFSISLNNIKDIAMELGGRNIETFLFLSGSGDLDVTCRSMFGRNRRFGNEIVSKNILESFLSIDDLISNIEKIGYLPEGVLAAKSIFFFFKQLNRDLNPNSLLSVIYKILNKELEPKSVIEYMRDVRQ

SEQ ID NO: 28531 - protein, 482 aa, Schizosaccharomyces pombe 972h-
MTTRRLTRQHLLANTLGNNDENHPSNHIARAKSSLHSSENSLVNGKKATVSSTNVPKKRHALDDVSNFHNKEGVPLASKNTNVRHTTASVSTRRALEEKSIIPATDDEPASKKRRQPSVFNSSVPSLPQHLSTKSHSVSTHGVDAFHKDQATIPKKLKKDVDERVVSKDIPKLHRDSVESPESQDWDDLDAEDWADPLMVSEYVVDIFEYLNELEIETMPSPTYMDRQKELAWKMRGILTDWLIEVHSRFRLLPETLFLAVNIIDRFLSLRVCSLNKLQLVGIAALFIASKYEEVMCPSVQNFVYMADGGYDEEEILQAERYILRVLEFNLAYPNPMNFLRRISKADFYDIQTRTVAKYLVEIGLLDHKLLPYPPSQQCAAAMYLAREMLGRGPWNRNLVHYSGYEEYQLISVVKKMINYLQKPVQHEAFFKKYASKKFMKASLFVRDWIKKNSIPLGDDADEDYTFHKQKRIQHDMKDEEW

SEQ ID NO: 28532 - protein, 351 aa, Listeria monocytogenes str. 4b H7858
MFILTMGLNHHTAPIDIREKLVFKESEEEMALVTLQQEKSILENVIISTCNRTEIVAVVDQIHTGRYYLKRFMANWFQMDMEKIEPYLFFHEESDAVNHLYKVTAGLDSLVLGETQILGQVKHAFEIAKQTATTGTLLNKLFREVVTFAKKVHHHTKINENAVSVSYAAVEVAKKLYGSLDNKKIVLVGAGEMSELALQNLAGSGIADITIINRTKSNAELLANQFQAKVGAYENMNEHLMLADIVLVSTSAAEPIIKQAAMQDLMEQKASSMLVIDIGLPRNVEHDCSYIPNFHLYDIDDLAGVVSANSLERQRIVLELEKTIEAEVRNFFEWEKQLGVVPVIRALREKR

SEQ ID NO: 28533 - protein, 236 aa, Ostreococcus tauri
MSDDDGGWDDDDFEVPDVTKLTLARDAPVRDKFADEDAETAEERAGREHREREIAALRAKTTAAKKVKEIKSAVSYEDDDDALSDPAAEKARRQRLVEEADLRAARELFGGGDVELETFEPKGKGDFEKLGSAVAHKYLSRHEGGAHYVHAIKALLRVATRELTAADVKEVEVAVVAARTDKVKKEKAEAEAAKKAAANSKKGKFLNAGGGKTGAGGGLDDFKYAVDSVDDEYDFM

SEQ ID NO: 28534 - protein, 484 aa, Sinorhizobium meliloti 1021
MRLKDRELFRQLGLIGGEWIAGASGVVVDVIDPANQAVLGTVPDMGTAETRAAIEAANAAFGPWKKKTHAERAAVLERWHALMIENLEDLAVLVTMEQGKPLEEARGEIRYGAAFVKWFAEESRRIGGHTIPSPTSDRRIVVLKEAVGVCAIVTPWNFPNAMITRKVAPALAAGCTVVIKPSEFTPFSALALGVLAERAGIPAGVVNIVTGMPTAIGNEFMTNETVRKISFTGSTRVGSLLMRGAADSVKRLSLELGGNAPFIVFDDANLDLAVEGAIASKFRNGGQTCVCANRILVQAGVYDAFAEKLGARVNAMKVGPGTEPGIAIGPMINEAAIDKIDRHVEDAIAKGAKLAARGRSVPEGRQYTAPIVLTGATTDMLLASEETFGPVAPLFRFETEDEAIAIANGTPFGLAAYFYTEGLKRSWRVAEALEFGMIGLNTGAISTEVAPFGGVKQSGLGREGAQVGIEEYLEMKSFHIGGLD

SEQ ID NO: 28535 - protein, 430 aa, Haemophilus influenzae R2846
MMDEQSLLAFDTQHIWHPYSSVSSDMPLYAVERADGVMITLKDGRRLIDGMSSWWAALHGYNHPRLNAAAQNQLAKMSHIMFGGFTHDPAVELAQLLVQILPNGLDKIFFADSGSVAVEVAMKMAIQYQHAKGEVQRQKFATIRSGYHGDTWNAMSVCDPTTGMHHLFHHSLPVQYFLPQPNIPFNESWNDCAIEPLADLLKKKGSEIAALILEPVVQGAGGMYFYSPTYLVKAQALCKQYGVLLIFDEIATGFGRTGKLFAAEHAGISPDIMCIGKALTGGYLTLSATITTTEIAQIICRGEAKCFMHGPTFMANPLACAIAAESIRLLLESPWQQNIQRIEHSLTQQLSPLAEKDYVKEVRALGAIGVVEMKSAVNMKTLVPRFVEQGVWIRPFGKLVYVMPPFVIKNDELQKLTEGMILALTQEYEH

SEQ ID NO: 28536 - protein, 308 aa, Synechococcus sp. WH 5701
MTWTTASIPDQSGRIALITGANSGLGLESARALASHGATVVLACRSRRRGEEARAELLPAAVAGLEVLELDLADLASVRAGARWMQEQYGRLDLLLNNAGVMGPPRQLTRDGFELQFGTNHLGHFALTTALLPLMEGRADARVVTVTSGAQYFGKLAFDDLQSERRYDRWAAYSQSKLANVTFALELQQRLAAAGSTVSSLAAHPGLARTNLQPASVASSGSRFESLAYRLMDPLFQSAAMGALPQLYAATAPEARGGEHYGPDQWGGMRGGPTQVRIAPAALDPQIRQRLWEVSEQLVGQAAPAEAA

SEQ ID NO: 28537 - protein, 534 aa, Saccharomyces cerevisiae
MSSDEEDFNDIYGDDKPTTTEEVKKEEEQNKAGSGTSQLDQLAALQALSSSLNKLNNPNSNNSSSNNSNQDTSSSKQDGTANDKEGSNEDTKNEKKQESATSANANANASSAGPSGLPWEQLQQTMSQFQQPSSQSPPQQQVTQTKEERSKADLSKESCKMFIGGLNWDTTEDNLREYFGKYGTVTDLKIMKDPATGRSRGFGFLSFEKPSSVDEVVKTQHILDGKVIDPKRAIPRDEQDKTGKIFVGGIGPDVRPKEFEEFFSQWGTIIDAQLMLDKDTGQSRGFGFVTYDSADAVDRVCQNKFIDFKDRKIEIKRAEPRHMQQKSSNNGGNNGGNNMNRRGGNFGNQGDFNQMYQNPMMGGYNPMMNPQAMTDYYQKMQEYYQQMQKQTGMDYTQMYQQQMQQMAMMMPGFAMPPNAMTLNQPQQDSNATQGSPAPSDSDNNKSNDVQTIGNTSNTDSGSPPLNLPNGPKGPSQYNDDHNSGYGYNRDRGDRDRNDRDRDYNHRSGGNHRRNGRGGRGGYNRRNNGYHPYNR

SEQ ID NO: 28538 - protein, 458 aa, Sinorhizobium meliloti 1021
MYSNSLIELDRAHLIHPVASYRGHEKLGVRVLASAKGATVTDASGRQLIDGFAGLWCVNAGYGQETIVEAAAKQMRELSYATAYFGLGSEPAIRLASELAERAPGNLNHVYFTLGGSDAVDSTIRFIRYYWTARGEPQRDQFISVEQGYHGSSTVGAGLTALPAFHTGFGIPFDWQHKIPSHYAYRNPVGDDPQAIIAASLTALRRKVEEIGPERVAAFYAEPIQGSGGVLVPPRGWMKAMRELCRDLGILFVADEVITGFGRTGPLFASTENEIVPDFITTAKGLTSGYVPMGAVFMADHIYQTIADGAGASAVGHGYTYSAHPVSAAVGLEVLRLYENGLLENGVKAGARLMEGLGSLRDHPLVGDVRGRGMLAAIELVVDKAQKTPLPAAAEPARRIFDRAWENGLVIRAFANGVLGYAPPLCCSETEIDAIIERTRQSLDETLEDPDVRRALKT

SEQ ID NO: 28539 - protein, 250 aa, Glycine max
MPIRNIAVGRPEEATHPDTLKAALAEFISTFIFVFAGSGSGIAYNKLTDNGAATPAGLISASIAHAFALFVAVSVGANISGGHVNPAVTFGAFVGGNITFLRGIVYVIAQLLGSIVASLLLAFVTASTVPAFGLSAGVGVGNALVLEIVMTFGLVYTVYATAIDPKKGNLGIIAPIAIGFIVGANILLGGAFSGAAMNPAVTFGPAVVSWTWTNHWIYWAGPLIGGGIAGLVYEVVFISHTHEQLPTADY

SEQ ID NO: 28540 - protein, 304 aa, Physcomitrella patens subsp. patens
MIARGTFGTVHKGVYKGQDVAVKLLEWGEENTMKKTEVQYYRNQFRQEVAVWHKLDHPNVTKFIGASMGNSDLRIPSAVDGDDGFHHVPNNACCVVVEYLAGGTLKDHLIRSRRKKLSYKVVVQLALDVSRGLAYLHSQKIAHRDVKTENMLLDKQMRVKIADFGVARVEASNPKDMTGDTGTPGYMAPEILDGKPYNKKCDVYSFGICLWEVYCCDMPYLDLSFADMTSAVVHQNLRPEVPKCCPQGLADIMRQCWDANPEKRPAMADVVQMLEALDTSKGGGMIPTDAQPHGCLCFGRFKGP

SEQ ID NO: 28541 - protein, 445 aa, Escherichia coli O157:H7
MGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPATTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTPLAIASSLILVASTFVWAPIPGLICAVIVIATGLPAYAFWAKRSRQLNALS

SEQ ID NO: 28542 - protein, 143 aa, Clostridium perfringens SM101
MRLEKSLVLIKPDAVERNLIGKILEVYEGAGLKIKAMEMKQINKDFAEKHYEEHRDKQFFNSLIKYITRSPLVALILEGEDAIDKIRSLNGATNPEKAEFGTIRRRFALSGTENSVHASDSIESAEKEIKLWFPKVFYEEICG

SEQ ID NO: 28543 - protein, 401 aa, Cryptococcus neoformans var. neoformans JEC21
MSTSTRRHVLEDKLANHKADPNAAANAGQVQERTTKGSSSSAPRKVRFNVGNNYHVVDVIGEGAYGVVASAVHRPSGTKVAIKKIAPFDHSMFALRTLRELKLLKYFAEEGVSENIISVLDIIKPPSYDTFKEVYLVQELLETDLHRVIRTQDLSDDHCQYFLYQTCRALKALHSAEIIHRDLKPSNLLLNANCDLKVCDFGLARSTQTAFPAEGNNQGFMTEYVATRWYRAPEVMLSFRMYTKSIDVWSVGCILAEMLSGKPLFPGKDYHNQLALILDVLGTPTIDEFHAITSKRSKDYIRSLPFRKKRTFESIYPSANPLAIDFLRKTLTFDPRKRYTVEQCLAHPYLDAYHDPEDEPSAKPLPPSFFEFDMMKDDISREELKRLLYEEIMGFRPVLEG

SEQ ID NO: 28544 - protein, 530 aa, Bacillus subtilis subsp. subtilis str. 168
MRFSGRFKGYNLQKFQKDLIAGIVVGVVAIPLGMAFAIASGVEPEYGLYTVVIAGICISLFGGSKYQIGGPTGAFVPILFGIIMQYGLENLLIAGFMAGVMLVLFGLFKLGKIMKFVPKPVIVGFTAGIAVLIFTEQIANFLGLRNVEKHENFHHNMFEIVQQLGTFNVYAILTAVIGLVILLVSAKVMPKVPGALLALLISTVVAVVFFPDRMATIGSTYGEIPRHLPEFQFPELTLDKMVMLFPAALVIALLGGLESILSAMVADNMKGSKHDSNKELVGQGIANMAAPLFGGIPATGAIARTATNIKNGAVSPVSGVVHGVVVLLVLLVFAPYASHVPLASMAPILMVVAWNMSERKEVANMLRLKNADSFILAATFALTVLFDLIIGVATGLLLAFVFFIRRMSEATRIHNQETHPVLAKREDPSVSMYAIEGPLFFGSIDSLESSLLEHVQKKPKTLILLMNKVHYMDTSAEAVLGNIMNRIKRHNGKLMIVGLQSQPKELLHKTGLFHKIGKQHFFDHHDEITG

SEQ ID NO: 28545 - protein, 163 aa, Burkholderia sp. 383
MRHIISVLLENEPGALSRVVGLFSARGYNIETLTVAPTEDQSLSRLTIVSIGSDDVIEQITKHLNRLIEVVKVVDLTDGAHIERELMLIKVRAVGKEREEMKRMADIFRGRIIDVTEKTYTIELTGASDKLDAFIQGLDAGAILETVRTGSSGIGRGERILKV

SEQ ID NO: 28546 - protein, 459 aa, Bordetella pertussis Tohama I
MNDLATINDLHSVVEDDRNAIWHHMLQHDALQATAPWVVVEGKGTRIRDASGKEYLDATAGGFWTVNVGYGRERIANAMRDQMLKLNYFAQSAGNVPGALFARQLVSKMPGMSRVYFSNSGSEANEKVFKMVRQISARHHAGRKYKILFRERDYHGSSIATLAAAGQPERAAQYGPFPDGFVQVPHCLEYRKQWDVANYGERAADAIEEVILREGPETVGLLCLEPITAGGGIIVPPEGYWRRVQEICRRYDVLLHIDEVVCGLGRTGKWFGYQHFDIEPDFVTLAKGTASGYAAIACTVTHERIFEQFKDEPDDPLSFFRDVSTFGGCAGSAAAALENLRILEEEGLVEHAAQVGDYLQACLRQLADKHAVIGDVRGKGLLQGVELVSDRAAKTPVSEADAKRVVAQCKAQGVLIGVITRALPGLNTTLCLAPPLILTRDEVDELCGAIDRALATVFG

SEQ ID NO: 28547 - protein, 289 aa, Bordetella petrii
MAISPVPESSISASLCEIDAERRFGGLARLYGPDAPARLREAHVAVAGLGGVGSWAAEALARCGVGALTLIDLDHIAESNINRQVHALTPTLGQSKVDAMAERIMAINPECVLTRVDDFVEPGNVGEVLPGYYTALADCTDQAAAKIAMVLHARQRGIPLLLCGGAGGKTDPLALRAGDLSQAQNDALLAKLRNTLRRQHGFPKASDARGKPLKRVPRMGVRALWFDQPAILPAAWARAAEAGDDLGAAAQAAAPQGLSCAGYGSVVMVTAAMGMAVANEAVRLALQGT

SEQ ID NO: 28548 - protein, 392 aa, Bacteroides thetaiotaomicron VPI-5482
MHKVYLKPGKEESLKRFHPWIFSGAIARFDGEPEEGEVVEVYTSKKEFIAEGHFQIGSIAVRVLSFRQEPIDHDFWKRKLQIAYDMRCGIGIAVNPTNDTYRLVHGEGDNLPGLVIDIYARTAVMQAHSAGMHVDRMTIAEALSEVMGDKIENIYYKSETTLPFKADLFPENGFLKGGSSDNIAREYGLKFHVDWLKGQKTGFFVDQRENRSLLEHYSKDRSVLNMFCYTGGFSFYAMRGGAKLVHSVDSSAKAIDLTNKNVELNFPGDARHEAFAEDAFKYLDRMGDQYDLIILDPPAFAKHKDALRNALQGYRKLNAKAFEKIKPGGILFTFSCSQVVTKDNFRTAVFTAAAMSGRSVRILHQLTQPADHPVNIYHPEGEYLKGLVLYVE

SEQ ID NO: 28549 - protein, 175 aa, Triticum aestivum
  misc_feature (27)..(27): Xaa can be any naturally occurring amino acid
  misc_feature (123)..(123): Xaa can be any naturally occurring amino acid
MGPTVMASSATSVAPFQGLKSTAGLPXSRRSNGASLGSVSNGGRIRCMQVWPIEGIKKFETLSYLPPLSTEALLKQVDYLIRSKWVPCLEFSKVGFIFREHNASPGLLRRTLLDNVEAAYVRXTDATQVINEVEEVKKEYPDAYVRIIGFDNMRQVQCVSFIAFKPPGCEESGKA

SEQ ID NO: 28550 - protein, 575 aa, Saccharomyces cerevisiae
MVNVGPSHAAVAVDASEARKRNISEEVFELRDKKDSTVVIEGEAPVRTFTSSSSNHEREDTYVSKRQVMRDIFAKYLKFIGPGLMVSVAYIDPGNYSTAVDAGASNQFSLLCIILLSNFIAIFLQCLCIKLGSVTGLDLSRACREYLPRWLNWTLYFFAECAVIATDIAEVIGTAIALNILIKVPLPAGVAITVVDVFLIMFTYKPGASSIRFIRIFECFVAVLVVGVCICFAIELAYIPKSTSVKQVFRGFVPSAQMFDHNGIYTAISILGATVMPHSLFLGSALVQPRLLDYDVKHGNYTVSEEQDKVKKSKSTEEIMEEKYFNYRPTNAAIKYCMKYSMVELSITLFTLALFVNCAILVVAGSTLYNSPEADGADLFTIHELLSRNLAPAAGTIFMLALLLSGQSAGVVCTMSGQIVSEGHINWKLQPWQRRLATRCISIIPCLVISICIGREALSKALNASQVVLSIVLPFLVAPLIFFTCKKSIMKTEITVDHTEEDSHNHQNNNDRSAGSVIEQDGSSGMEIENGKDVKIVYMANNWIITVIAIIVWLFLSLLNVYAIVQLGMSHGDIS

SEQ ID NO: 28551 - protein, 950 aa, Oryza sativa
MPHHHRASSLRQSNKAFKSKHATKTSLREASKGRSASDVSSTSRLSSHKASPLSAAGNEVGSRQHRRNHAKQAQRSKRNALVQSNRIFSSAASREGKDGLSKGFAGAGAGAPCICAVVDLAEDGDSWEAVRRIQEEGLDGGVQPVPGRSVDDALRTGLPYCELEATRFRQTIQFLPLPYGALYPILDACKCADFVLLVLSASTAIDPGSWGELCLRTLQAQGLPTVVVAVPTLHPDGATGVGGSKKAGAALKAANEVRKSLLSFAQYFSPDVDKVHALDDRAERGALLRTLATATPKRVAWRDFRAWMVSEDAEWETAPNPDATNANDGANGIASLNGHDQERGTLKVTGWIRGAPMSADRLIHLPDFGDFEVDRIAYAPPPNARTKHTKASATTAASTDADDAAMTDADTAATVADAPLAAGDVLQTRDDEFADDLVSENEPDDMGNEQTWPTEEEMQAAEQFAKQRADGEMPPPPALPGTTPKTIIKGSGNAKDNAKYRAAWIIESDEDEDDDDDDDADSMMAEEADEDMDTGDVEVNEAIDDYERMKAAAIAQQHAQPSESMSEMAFEDVDDAQAEAEYRAYQEQRKREREERDDAEFPDEVDTPLEIAARQRFARYRGLKSFRTSPWDPYEDLPRDYARIFQFEDFHKTRRRDEGAALLDGVQPGFRVTVWVKDVPRAAAVRARASNIELPKVDVAVPFVLFGLLRHEHKKSVINFTVTRNTEYDAPVRSKDPLVLCLGPRRFRVNPIFSQHSRGGGKGVNNVHKFERFLRPGVSASVATVYAPITFGGSTAPAVLLRERSIDGESGYDQRGVSAAQMPHLVGFGNLIDAGPTRINAKRILLSGHPYKVHKKTATIRFMFFNPEDVYWFKPITLHTKLGRTGHITESLGTHGYFKAHFDGPISQMDTVLMNLYKRVYPKWAHPFGSAYDELPLPRSEVYKQDDMQT

SEQ ID NO: 28552 - protein, 596 aa, Silicibacter pomeroyi DSS-3
MRFTTRPEIAGTFAVATSTHWIASAVGMGVLERGGNAFDAAAAMGFVLQVVEPHLNGPLGDMPMLIKPAGDVVPTMVCGQGTAPAGATIAHYRSEGLTRIPGSGLLATVIPGAFDAWMLMLRDYGTLPLRDILEPAIHYARAGHPALPRVAATIAGLAEFFRAEWPSSHETWLPGGSAPRAGALMKNPALADTWTRLLAESETVSGREAQIEAARAAFYRGFVAESIDRYLRHACVMDAAGGRRKGVLSGEDMACWQASYEAPISTRYKDWTVWKGGPWTQGPALLQSLHLLDGFDLDAIDLNGAEFVHLVSEAMKLSFADREAYYGDPEHSDIPMSALLSARYGEARRGLIGERASTEQRPGLVEGYESWVAAALRHAREDYASAGGTGAGEPTMAHLSQRKGDTVHLDVIDRWGNMVSATPSGGWLQSAPVVPGLGMPLNSRAQMFWLEEGLPTSLAPGRRPRTTLSPSMARGPDGTELAFGTPGGDQQDQWQLIYFLRLVHGGLNLQEAIDAPLFHTNHFQSSFYPREVQPGHLMVEPALGEAAIAELRARGHRVEVAEPWSVGRLTAASRLSDGTLRAAATPRLMQAYAIGR

SEQ ID NO: 28553 - protein, 422 aa, Oryza sativa Japonica Group
MEAVSGVQSGTVVDDGVQRPWKLSDARLVLEDGSVWKAKSFGASGTQVGEVVFNTSLTGYQEILTDPSYAGQFVLMTNPHIGNTGVNPDDEESNRCFLAGLIIRNLSICTSNWRCTETLEEYLMKRNIMGIYDVDTRAITRRLREDGSLIGVLSTDQSRTDDELLEMAKNWKIVGVDLISGVTCDAPYEWSDKTDSEWEFKKGQSTESFHVVAYDFGIKHNILRRLTSYGCKITVVPANWPASEVLNLKPDGVFFSNGPGDPAAVPYAVKTVQEIIGKVPVFGICMGHQLIGQALGGKTFKMKFGHHGGNHPVCDLRSGRVDISAQAFRITGVGRGAGLLAVTLPDENLELLRNHNYAVDPESLPEGVKVTHINLNDNSCAGLQYPKMKLLSLQYHPESSPGPHDSDLAFGEFIEMMKNNRL

SEQ ID NO: 28554 - protein, 186 aa, uncultured bacterium
MNNLVFNFKSKKIKKIKNPKFILGGKGANLAQMGKLGLPVPPGFTISTGVCEIFYKNNKKLNSKLIKSIKQELKQIEKECGKKFGDLDNPLLVSVRSGARVSMPGMMDTILNLGLNDETVKALAKKTSNMRFAKDSYRRFIQMYSNVVLGVESYNFEELIENYKLTKGVFKTAFHMSSAYKVAFLK

SEQ ID NO: 28555 - protein, 315 aa, Aspergillus nidulans FGSC A4
MDCPIPQTELDEIYAFATDLARKAGQLLLERVNDRNSEQVYAEKENAVDLVTQTDEAHKFLGEESYAKGQSREYLIDEQPTWCVDPLDGTVNFTHAFPMFCVSIGFIVNHYPVIGVIYAPMLNQLFSSCLNRGAWLNEMQQLPLIRKPSIPPLPATAPSKCIFACEWGKDRRDIPDGTLQRKIESFVNMAAERGSRGGKGGMVHGVRSLGSATMDLAYTAMGSVDIWWEGGCWEWDVAAGIAILLEAGGLVTAANPPEDIEGPIEPVKLGSRLYLAIRPAGPSETETGRETQERTVREVWRRVRQLDYERPTRQS

SEQ ID NO: 28556 - protein, 727 aa, Arabidopsis thaliana
LFSMSQSLDYQNSCQDSFKVNVPTSFVPEEKEMNLTHLESALRKGFEVKLVIDEIPCQECSSSRGICGFNSTTQICCNVTSLSGGVTCVPQHQPSADELRRRCSERFSCGNQRNLYYPFWIPGREYCGHPDFKLDCSGGFAELNIASVNFRILNMSYDSSNKRLARSDYLNDLCPPNPLNDEPLIETVLQFSADTELLTLYYDCQLNSSATSPFPSSYFGELGCDEGRSYYVTRNLSSPLLDRFRGVLNNLREMCKRKVSVPASGPALNTLQTNPNSNNLKMALEHGFELQDNSNCSMCVLSGGSCGYNQNSSLFVCYCKDGPQDNQCDINLDVAIIIGIFVALCTIGGFIAFLVLLCPCCKVRIFRNRKTSDDRRQEKLKALIPLKHYTYAQVKRMTKSFAEVVGRGGFGIVYRGTLCDGRMVAVKVLKESKGNNSEDFINEVSSMSQTSHVNIVSLLGFCSEGSRRAIIYEFLENGSLDKFISEKTSVILDLTALYGIALGVARGLEYLHYGCKTRIVHFDIKPQNVLLDDNLSPKVSDFGLAKLCEKKESVMSLMDTRGTIGYIAPEMISRVYGSVSHKSDVYSYGMLVFEMIGARKKERFGQNSANGSSMYFPEWIYKDLEKADNGDLEHIEIGISSEEEEIAKKMTLVGLWCIQSSPSDRPPMNKVVEMMEGSLDALEVPPRPVLQQIHVGPLLESSWITEESSSISEIENRNLQVCEKILS

SEQ ID NO: 28557 - protein, 269 aa, Thermomyces lanuginosus [sequence omitted]

SEQ ID NO: 28558 - protein, 1246 aa, Arabidopsis thaliana
MRASVYSLILLFFSCLLHLSKSQPFLGVNYGLTADNLPPPSASAKLLQSTTFQKVRLYGSDPAVIKALANTGIEIVIGASNGDVPGLASDPSFARSWVETNVVPYYPASKIVLIAVGNEITSFGDNSLMSQLLPAMKNVQTALEAASLGGGKIKVSTVHIMSVLAGSDPPSTAVFKPEHADILKGLLEFNSETGSPFAVNPYPFFAYQDDRRPETLAYCLFQANPGRVDPNSNLKYMNMFDAQVDAVYSALNSMGFKDVEIMVAETGWPYKGDPEEAGATVENARAYNKNLIAHLKSGSGTPLMPGRVIDTYLFALYDENLKPGKGSERAFGLFRPDLTMTYDIGLTKTTNYNQTSMAPLSPTRPRLPPAAAPTRQTLPSPPQMILPSPVTPSDKNSGQTDVHNSTPRSASLAHICRSLSISASMFFVSVLCVYVAVSHWVIGKPNTRWNLLKAFGISRCYLSHLFNIQGHHLRGSIAGLHSPSLLFLIDPSKEKPSWRILNVPGKPPKLAWGHSTCVVGGTRVLVLGGHNGEEWILNELHELCLASWQDSDLKSSTAPSSAPESDTRSEKNSNADEGSTSQNDVAAVNKGKGILGHSPNKPNVNLTEKPNKSSSSSQRSKPPMQENKARVTTEKRSVCQQNLPSTRVIPSALTRFFPIGNFLSSSFLLLTIPESSSSPHLRRPSVMASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTFTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 28559 - protein, 1111 aa, Arabidopsis thaliana
MLQQSSTHLLCGVVLLQLFAAQVDAQRSTSPWQTLSGDAPLVIARGGFSGLFPDSSLAAYQFAMVVSVADVVLWCDVQLTKDGHGICFPDLNLANASNSEEVYPNRQKSYPVNGVTTKGWFPIDFSLTELQKVLFSLIRGILSRSGKFDENGYSISTVQNVATQMKPALFWLNVQHDEFYEQHNLSMSSFLLSTSRTVSIDFISSPEVNFFRKIAGGFGNNGPSFVFQFMGKEDFEPTTNRTYGSILSNLSFVKTFASGILVPKSYILPLDDKQYLLPHTSLVQDAHKAGLKLYASGFANDVDIAYNYSWDPVSEYLSFVDNGNFSVDGMLSDFPLTASASVDCFSHIGRNATKQEQKHYHLPMVRASVDFLVISKNGASGEYPGCTKLAYEKAIKDGSDVIDCPVQMSSDGIPFCSSSIDLVNSTTVGQTHLRNRSIIVPEISSVAGIFTFSLTWHEIQSLTPAISNPFRENGMSRNPNERNSGNLISLYEFLNLAKNSTSLSGILISLENVVYLREKKGLDVVKVVLNRLTETGYIVGTLKVMIQSTTRLVLVDFKNQSTYKTVYKIKETIGNITDSAIEDIKKFANAVVINKASVFPNSDSFLTGQTTNVLERLQKFQLPVYVELFQNEFVSQPFDFFADETVEINAYIFGAGINGTITEFPYTAARYKRNRCLGREEVPPYMLPVNPGGVLTLISTSSLPPAQDPNPIFTHDDVTEPPLPPVIAKSPTSTLGTPSTIAKPLISWSVAGVVLFLVLLTLVFCFHRKRETRLRQQKLKALIPLEHYTYAQVKRITKSFAEVVGRGGFGIVYKGTLSDGRVVAVKVLKDTKGNGEDFINEVATMSRTSHLNIVSLLGFCSEGSKRAIIYEFLENGSLDKFILGKTSVNMDWTALYRIALGVAHGLEYLHHSCKTRIVHFDIKPQNVLLDDSFCPKVSDFGLAKLCEKKESILSMLDTRGTIGYIAPEMISRVYGNVSHKSDVYSYGMLVLEIIGARNKEKANQACASNTSSMYFPEWVYRDLESCKSGRHIEDGINSEEDELAKKMTLVGLWCIQPSPVDRPAMNRVVEMMEGSLEALEVPPRPVLQQIPISNLHESSILSEDVSVYTEG

SEQ ID NO: 28560 - protein, 490 aa, Schizosaccharomyces pombe 972h-
MSPKQEEYEVERIVDEKLDRNGAVKLYRIRWLNYSSRSDTWEPPENLSGCSAVLAEWKRRKRRLKGSNSDSDSPHHASNPHPNSRQKHQHQTSKSVPRSQRFSRELNVKKENKKVFSSQTTKRQSRKQSTALTTNDTSIILDDSLHTNSKKLGKTRNEVKEESQKRELVSNSIKEATSPKTSSILTKPRNPSKLDSYTHLSFYEKRELFRKKLREIEGPEVTLVNEVDDEPCPSLDFQFISQYRLTQGVIPPDPNFQSGCNCSSLGGCDLNNPSRCECLDDLDEPTHFAYDAQGRVRADTGAVIYECNSFCSCSMECPNRVVQRGRTLPLEIFKTKEKGWGVRSLRFAPAGTFITCYLGEVITSAEAAKRDKNYDDDGITYLFDLDMFDDASEYTVDAQNYGDVSRFFNHSCSPNIAIYSAVRNHGFRTIYDLAFFAIKDIQPLEELTFDYAGAKDFSPVQSQKSQQNRISKLRRQCKCGSANCRGWLFG

SEQ ID NO: 28561 - protein, 601 aa, Streptomyces lincolnensis
MLPSKPELSGTIGAVSATHWLASNAGMRILENGGNAFDAAVAAGFVLQVVEPHFNGPGGDVSIGRTARRAQDAAEICGQGPMPRAATPQAFSDLGLEHIPGSGLLPACVPGAFGGWLRLLAEFGTLRLADVLAPAITYAEEGYPLLPETAHAADVLAPLFRTEWTGSGQIYLANGAAPKAGSRFRNPARAQTYRQLLKEAEAASADREAQIEAAHQAFYQGFCAEAVQRFLDGGPRLDATGAGHSALLTADDLAAWTPSVTTATSRPYGAYRVHKPGPWSQGPVFLQQLALLEGFDLAGMRPDSADYLHTVVECAKLAFADRDAWYGDPAFTDIPLADLLSDDYTRERRRLVGPEAVNELQPGTPGGRSSWLPGAAPEPEPDLSGHTDEWMGQLRNGLPTILKATTAKGDTCCVTVTDRHGNTVAATASGGWLKSSPAIAELGFPLGTRGQTMYLAEGHPNSLAGGKRPRTTLSPTVVQRDGQPHLAFGTPGGDRQDQWTLQFFLGVTAFGLDLQAATETLAFHTDQVPASFTPHQSRPGVVVVEENCAAATVAELTRRGHRVERVPAYSLGRVCATGLGTDGLVRAAACPRGRQPYAICG

SEQ ID NO: 28562 - protein, 227 aa, Mannheimia succiniciproducens MBEL55E
MELVFIRHGLSEWNALNLFTGWRDVNLSEKGVEEAKEAGRKLKAAGFEFDIAFTSVLTRAIKTCNLVLEESNQLWVPQIKTWRLNERHYGGLQGLNKAEAAAEHGDEQVRIWRRSYDVLPPVLDPKDPNSAHNDRRYAHLPADVVPDCENLKVTLERVLPFWEDQIAPAIKAGKRVLVAAHGNSLRALAKHIEGISDADIMDLEIPTGQPLVYTLDDNLKVVSKRYL

SEQ ID NO: 28563 - protein, 225 aa, Zea mays
GADDLKVLGLWTSPFVIRVRIVLNLKGLAYEYVEDDLGNKSALLLSSNPVHKTVPVLLHAGRPVNESQIILQYIDEVWAGTGPAVLPRDPYERAAARFWAAYIDDKVKSAWLGMLFECRDEGERAEAVARAGEALGTLEGALRGKPFFGGDGVGFVDAVLGGYLGWFGAVGRIIGRRLIDPTKTPLLAAWEDRFRAADVAKGVVPDDVDKMLAFLETLLANYYSK

SEQ ID NO: 28564 - protein, 298 aa, Oryza sativa Indica Group
MAEHLASIFGTEKDRVNCPFYFKIGACRHGDRCSRLHNRPTVSPTIVLANMYQRPDMITPGVDAQGQPIDPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPRHRRGNRDRDDFRRERDGYRGGGDGYRGGGGGGGGDGYRGGDSYRGGGGGGRRGGGSRILDSIYIVFRLTCKPPFVFKYAILDLLSVYYPVNALRNL

SEQ ID NO: 28565 - protein, 306 aa, Mycobacterium leprae TN
MSLLLSAQVPIPFTAIVPAAGLGTRFLPATKTVPKELLPVVDTPGIELVAAEAAAAGAERLVIVTSEGKDGVVAHFVQDLVLEGTLLARGNKAMLAKVRRAPELIKVESVVQAEPLGLGHAIGCAEPTLAPDEDAVSVLLPDDLVLPTGVLETMSKVRASRGGTVLCAIEVASEEISSYGVFDVEPVPGGDNPNVLKVIGMVEKPKAEDAPSTFAAAGRYVLDRAIFDALRRVSRGTGGEVQITDAIALLIKEGHPVHVVVHRGSRHDLGNPGGYLKAAVDFALDRDDYGPDLRRWLVERLGLIEQ

SEQ ID NO: 28566 - protein, 157 aa, Shewanella sp. MR-4
MIAQGQTLPAATLSQLTKDGMVNHQVTELFAGKKVVLFAVPGAFTPTCSEAHLPGYVVLADQFKAKGVDLIACVSVNDAFVMKAWGEAQNASELLMLADGDASFTKALGLEMDTAGFGGVRSQRYAMIIDNGVVTLLNVEAPKSFEVSKAEVVLAAL

SEQ ID NO: 28567 - protein, 1564 aa, Staphylococcus xylosus
MAKKKNTYKVPSIIALTLAGTALTTHHAQAADKTQDQSTNKNILNDDKALNQSEQIKSEISKPTANISGTQVYKDPTQIKQASTDNNLNYDAQIDELNNQTSDQMTTQNTYNQNGQDQEAQQKDDSTVKTNQENVENEITSDEATNNVNTSDNVEKQATEAVQNDSVVTDKDDVTSNDSQDVAKDINKFDDTSVEQDNNAVQNDSVVTDKDDVTSNDSQDVTKDSDKSDAASSEQGNNAVQNDSVVTDKDDVTSNDSQDVTKDSDKSDATSNEQDSNAVQQDNSASDKDDVTSDDSQDVAKDSVKSDAASNEQDSNAVQNGSAVTDKDDVISDDSQDVAKDSVKSDAASNEQDSNAVQKDDSTSDIDDVTSDDSQDVAKDSVKSDATSSEQDSNAVQKDDSTSDKDDVTSDDSQDVAKDSVKSDDASNEQDSNAVQKDDIASDKDDVTSDDSQDVAKDSDKSDATSTKQDSNTVQQDDSTSDKDDVTSDDSQDVAKDSDKSDAASSEQDTEALQQDDSTSDKDDVTSDDSQDVTKDSDKSDAASTKQDSNTVQKDGAETTKAVNTTFYSAQAAPKLRVARSADSTVATRSALTKETTTRSTLPKYSPKVSSSINNYIRKNNFKAPNYEQDIASYLLKYNYRYGKPEGIVMHDTANDNSTITGEINFMKNNYQNAFVHAYVDGNRIIETANTDYLAWGGGAAANERFIHVELVHTHDYDSFARSINNYADYAATNLQYYGLVPDSAEYDGVGTVWTHQAVSTFLGGTDHTDPHGYLAAHNYSYNELYDLIYEKYLIKTGQAAAWGTPSSGSTSGTGSNNTGSSNTGTTAPTKTGTVKVTANNGVGRINTTNDGLYTTVYDQNGKKTDRTNQTLKVTKSATLGNENFYLVSDFNKGTLIGWVHQGDVNYNTAKVATSINKAYKIKPGETLYTVPWGTSSQKAGTVSGKSTQTFKATKQQQIGKTNYVYGTVNNLSGWVSLSKLSSTSNTATSPTTNSGKLTVSTLTNQQGTVAKNNHGVYTTVYDKQGVQKSYVNGKTYKLSKKATLGNNAFYLITDNKTNTNIGWMQTGDIKVKEAATKATSNQTQNISKIGQLNTKNSGIKATVYDQQGKDATKLAGKTYNVTKQRTEGNKTYVLIQNVNQNTPIGWINTKDINTRNLSQASAKNGQYTVKATNNGLYAVPWGTKSQQLDTLNNLKNNQFNASKSVYVDKDEYVYGIVNNKTGWIAANDLNKLQPANNTNASSSQNITKSAVTPYKYDYVIFNKNGSYYLDPTSTTAAGSLKDFYESIFTVYETQVINGTTWYHGKLSNGKVVWIKETDLRKELVKYYDSGLTLDQAVAIQKGLTAKPQIQHTPGKWEDATAREIKNAMDSSKLVKDETQKYQFLRLDKTQNIGSADLDKLLVGKGILEGQGAAFSEAAKTYDINEVYLISHALLETGNGTSKLADGGDVVNNKVVTDGPNKYYNMFGIGAVDSDAVKQGFITAKNNGWNTVKKAIVGGAKFISESYIDKGQNTLYKMRWNPENPGVHQYATDVAWASHNATRIKGFYDSMDKLGKYFDVDTYK

SEQ ID NO: 28568 - protein, 210 aa, Brassica napus
  misc_feature (99)..(99): Xaa can be any naturally occurring amino acid
MSLKATIVVLLGLVWSFQAALGIRFVIDREECFSHKAEYEGDTLHVSFVVIKSDSQWHFNEDGVDLVIHGPTGEQVHDFREQISAKHDFVVQKKGVYRXFCFTNKSPYHETIDFDVQLGHFAYYDQHAKDEHFTPLMEQISKLEEALYNIQFEQHWLEAQTDRQAIVNENMSKRAVHKALFESFALIGASVLQVYLLRRLFERKLGMSRV

SEQ ID NO: 28569 - protein, 78 aa, Zea mays
MGFQISKAVIPAAGLGTRFLPATKAMPKEMLPVVDKPAIQYVVEEAVGAGLTDVLMITGRNKNALENHFDHVSELEET

SEQ ID NO: 28570 - protein, 440 aa, Thermotoga sp. RQ2
MVDQKTKEVETVYVEIVDVRAREVLDSRGNPTVEAEVVLEDGTMGRAIVPSGASTGKFEALEIRDKDKKRYLGKGVLKAVENVNETIAPALIGMNAFDQPLVDKTLIELDGTENKSKLGANAILAVSMAVARAAANYLGLPLYKYLGGVNAKVLPVPLMNVINGGQHADNNLDLQEFMIVPAGFDSFREALRAGAEIFHTLKKILHEAGHVTAVGDEGGFAPNLSSNEEAIKVLIEAIEKAGYKPGEEVFIALDCAASSFYDEEKGVYYVDGEEKSSEVLMGYYEELVAKYPIISIEDPFAEEDWDAFVEFTKRVGNKVQIVGDDLYVTNVKRLSKGIELKATNSILIKLNQIGTVTETLDAVEMAQKNNMTAIISHRSGESEDTFIADLAVATNAGFIKTGSLSRSERTAKYNQLLRIEEELGKVAEFRGLKSFYSIKR

SEQ ID NO: 28571 - protein, 218 aa, Oryza sativa
  misc_feature (194)..(194): Xaa can be any naturally occurring amino acid
MMHTSKIFTQFLYRIKPKTRFRAYKLKKSASFWYNNEVDLILLPYDIFCSSYSLTILVYSPQACPVCSARISKDLLDHITLQHSYLFRLQRHHRLRRVAVPSNHALSLGGRDLQETYLKVLLGNSSRSSGTNAASSVTDSLLSSLVLNLSSSEAEDTAKFSALAVVENNWFKRTLPSKTWKASSDYNLSQEERXRMRRRAAVRSSFVQHLLVSTLFDD

SEQ ID NO: 28572 - protein, 317 aa, Triticum aestivum
MPAGQQPPAREPDGGDSNHHPHPPPPTPALPSEVVPAYPPPESEDDESWVWTQIKAEARRDADAEPALASFLYATVLSHPSLPRSLSFHLANKLCSSTLLSTLLYDLFLASLTAHPSLRAAVVADLLAARARDPACVGFSHCLLNYKGFLAIQAHRVAHVLWAQNRRPLALALQSRVADVFAVDIHPAAVVGKAILLDHATGVVIGETAVVGDNVSILHHVTLGGTGKAVGDRHPKIGDGVLIGAGATILGNVMIGAGAKIGAGSVVLIDVPARSTAVGNPARLIGGRKGESDKDEDMPGESMDHTSFIRQWSDYTI

SEQ ID NO: 28573 - protein, 184 aa, Burkholderia pseudomallei K96243
MSSSYFIATRASKFLSYVLRHRPDSIGVTLDAQGWADVSELLTKAAAAGMALTLDELKQVVAENDKKRFVLNDDATRIRAAQGHSVDVDLQLPVKAPPPVLYHGTVGKSMADIRKQGLTPMNRHDVHLSPDRETATRVATRRGKPVILVIETYPLLRDGYQFRVSDNGVWLVPEVPAKYIKFPG

SEQ ID NO: 28574 - protein, 312 aa, Bordetella petrii
MADFDIVGLGEPLIEFNQTRAGDPHYLQGFGGDTSNAVIAAARQGARCAYLTRVGADAFGDQLLQLLRGEQVDTAGVRVDPDAHTGVYFVQHGPDGHVFSYLRRDSAASRMQPSDLDGAPLSRCRYLHVSGISLAISASACDTVFEAIGRTRQAGGQVSLDSNLRLRLWPVARARAILREALAMADLFLPSLDDLRHLTGHDDPQRTLDWIRAAGAPGVVVLKLGKDGALVDDGQARTPVPGLAVKAVDATGAGDCFAGNLLARRCAGDDWLAAVRYANAAAALSTTGYGAVEPLPRPDAVRALLADGGAAG

SEQ ID NO: 28575 - protein, 351 aa, Arabidopsis thaliana
MDAFRRQASKLRDQVAKQQLAVIKQFSGTGYESSDVMVIDELEMQRHHQLDKLYRSTRSAKEFQRDIVKAAEAFTTIGLRHIEAGTKLSEDCCRYGNEIVRNIDENILAKAAAIYGDARKHVDKEQEDFNKLLASQVLDPLRAMVAGSPLEDARHLAQRYSRMRQEAETHATEVSRRQARVREAPIPENVAKLQLAEAKMQELKANMAVLGKEATAALAAVESQQHRLTFQRLVAMVEGEKNYHLRIAAILSDIEAEMVTEKQHKESALPAIPTENGSEKTSYFLAEVIHPFSAVSEKELDLDKGDYIVVRKVSQTGWAEGECKGKAGWFPMAYIEKRQRLPTTNFAAEVY

SEQ ID NO: 28576 - protein, 568 aa, Solanum tuberosum
  misc_feature (471)..(471): Xaa can be any naturally occurring amino acid
MASSALISDTESWKDLRAHVEEINKTHLRDLMNNTNRCQSMMVEFDGILIDYSRQRATFDTLNKLFSLAEAARVKEKIIRMFNGEHINSTENRSVLHVALRAPRDAVINSDGKNVVPEVWHVLDKIRDFSERVRSGAWVGATGKTLKDVVAVGIGGSFLGPLFVHTALQTEAEASECARGRQLRFLANVDPIDVARNITGLNPETTLVVVVSKTFTTAETMLNARTMREWISSALGPQAVAKHMVAVSTNLKLVEQFGIDPNNAFAFWDWVGGRYSVCSAVGVLPLSLQYGFSIVEKFLKGASSVDQHFLSAPFEKNIPVLLGLLSVWNVSFLGYPARAILPYSQALEKLAPHIQQVSMESNGKGVSIDGVPLPYQTGEIDFGEPGTNGQHSFYQLIHQGRVIPCDFIGVVKSQQPIYLKDEVVNNHDELMSNFFAQPDALAYGKTPEQLQKENIPEHLVSHKTFSGNRPXLSILLPSLNAYNIGQLLAIYEHRVAVQGFVWCINSFDQWGVELGKSLATQVRKQLHASRKKGESVEGFNFSTKTLITRYLEASADVPSDPSTLLPNI

SEQ ID NO: 28577 - protein, 327 aa, Silicibacter pomeroyi DSS-3
MKLAINGFGRIGRTILRQLLAAPRATDIDLVLINDIAPLDTCAYLFEYDSTFGPWRGDVATGADSLIVDGLAIPVTHSADLARVDLSDVDVLLDCTGIARSSDVAARGLSAGAGKVLISGPSPAAEITVVLGANEALLGNARIVSNASCTTNGLAPLARMIDDIAGITSAHMTTIHCYTNSQPMVDAPRGDLARSRAGALSMVPTTSSATHLIDEVLPHLAGRISGAAVRVPTASVSAVDLVVQLDRAMTPEQFDAALRAAVEASPVLGWTDKPLVSSDLRARPESLVIAGPETRMVGDKQVRVFGWYDNEWGFSARMLDIARLMAV

SEQ ID NO: 28578 - protein, 355 aa, Secale cereale
MPSSQAQADLWRHTLYYLTSMGLRCAVKLGIPTAIHNLGGVSSLPDLAAALSIPASKQPFLGRLMRALVTSGVFANGKERLLGGLFRLNPLSRILVEGVVAEEHHSQTSFVLAGTSRHYMEAALGMADWFKKDATGPVPTVFEDVHSASLFDESTAALDPELDALVTEGLAAHDNLGIGTIIREFHDLFKGLVSLTDFCCGDGTTSRAITKAHPHVKFTVLDLPKVIDKTPSDGIVNYFAGDLFHTVPKAQAVMLKLVLHHLSYEDCFKILTQCKDAIPSREEGGKVIVIDIVVAPSLGQVMFKEQTLMDILMLVFTRGRQRSENNWHELFTKAGFSDYKIVKKLGARGVIEVYK

SEQ ID NO: 28579 - protein, 617 aa, Solanum lycopersicum
  misc_feature (84)..(84): Xaa can be any naturally occurring amino acid
  misc_feature (189)..(189): Xaa can be any naturally occurring amino acid
MASSSLSSIYSPSSSFKSEVKSIHKITSSQLGSIYLPNKSRFHVHAVAREVSASLSAGNNDVVHKLKKENVGLEKNPNALWKRXVEWLYQHKELGLYLDISRVGFSDGFLEEMEPRLQKAFKDMVDLEKGAIANPDEGRMVGHYWLRSPHLAPNSFLRLQIENTLEAVCEFANDVVSGKVKTPSGGRFXQILSVGIGGSALGPQFVAEALAPDNPPLKIRFIDNTDPAGIDHQIAQLGPELASTLVIVISKSGGTPETRNGLLEVQKAFREAGLIFAKQGVAITQENSLLDNTARIEGWLARFPMFDWVGGRTSEMSAVGLLPAALQGIDIREMLAGAALMDEANRTTVVRDNPAALLALCWYWATDGVGSKDMVVLPYKDSLLLFSRYLQQLVMESLGKEFDLDGNRVNQGISVYGNKGSTDQHAYIQQLREGVHNFFATFIEVLRDRPPGHDWELEPGVTCGDYLFGMLQGTRSALYSNDRESITVTVQEVTPRSVGALVALYERAVGIYASLVNINAYHQPGVEAGKKAAGEVLALQKRVLQVLNEASCKQPVEPLTLDEIAERCHCEDDIEMIYKIIAHMAANDRALIAEGNCGTPHSIKVYLGECNVDDLYA

SEQ ID NO: 28580 - protein, 478 aa, uncultured bacterium
MSDKKKFYINGKWVSPKSIKSIEVINPATEDVCAVISLGSKEDVNDAVLSAKEAFKTWAFSSKKERLEPLEKLYELYKKRWSDIAETITTEMGAPKDFSTKLQAGTGAAHIKTFIRYLKEFDFEKPLGEHAKNQRLIYEPKGVCALITPWNWPMNQTCLKVMPALASGCTMILKPSEVAPLSAMILTELIDEAGFPPGVFNLVNGDGATTGDALTSHPDINMISFTGSTRAGALISQNAAKDFKRVSLELGGKGANIIFKDADPEAIERGALRCFRNSGQSCNAPTRMLVEKNMYDEAVERVKKFANNMKVGDPKKEGEHIGPVVSEVQYEKIQSLIQKGIDEGAKLVAGGVGKPDGINKGYFVKPTAFADVNNQMEIARTEIFGPVLSIIPFENEEEAISIANDTDYGLTNYIQTKDKEKANRVARRLRSGMVDVNGAGIAVDAPFGGFKHSGIGREAGKEGLLEFLEVKSVGGWAN

SEQ ID NO: 28581 - protein, 480 aa, Arabidopsis thaliana
MVKICCIGAGYIGGPTMAVIALKCPDVEVAVVDISVPRINAWNSDTLPIYEPGLDDVVKQCRGKNLFFSTDVEKHVREADIVFVSVNTPTKTRGLGAGKAADLTYWESAARMIADVSVSDKIVVEKSTVPVKTAEAIEKILTHNSKGIKFQILSNPEFLAEGTAIKDLFNPDRVLIGRRETPEGFKAVQTLKNVYAHWVPEGQIITTNLWSAELSKLAANAFLAQRISSVNAMSALCEATGADVTQVSYAVGTDSRIGPKFLNSSVGFGGSCFQKDILNLVYICECNGLPEVAEYWKQVIKINDYQKSRFVNRVVSSMFNSVSNKKIAVLGFAFKKDTGDTRETPAIDVCKGLLEDKARLSIYDPQVTEDQIQRDLSMNKFDWDHPLHLQPMSPTTVKQVTVTWDAYEATKDAHGICIMTEWDEFKNLDFQKIFDNMQKPAFVFDGRNIMNLQKLREIGFIVYSIGKPLDDWLKDMPAVA

SEQ ID NO: 28582 - protein, 311 aa, Staphylococcus aureus subsp. aureus Mu50
MKRKIIMDCDPGHDDAIALILAGAIDSPLEILAVTTVAGNQSVDKNTTNALNVLDIMGRQDIAVAKGADRPLIKPAAFASEIHGESGLDGPKLPSTPSRQAVAMPASDVIINKVMTSDTPVTIVATGPLTNVATALIREPRIAEHIESITLMGGGTFGNWTPTAEFNIWVDAEAAKRVFESGITINVFGLDVTHQVLADNHVIERFESINNPVAQFVVELLQFFKKTYKTHFNMDGGPIHDACTILYLLQPELFTMVPVNIDIEHQSPLTYGTMAVDLNHVTGKPANAYFATAVDVEEVWNLIDHKLRTYE

SEQ ID NO: 28583 - protein, 250 aa, Sphingomonas paucimobilis
MSDLSGKTIIVTGGGSGIGRATVELLVASGANVPVADINDEAGEAVVATSGGKAAYFRCDIAQEEDVKALVAQTLAAFGGLDGSFNNAAIPQAGLPLAEVSLERFRQSMDINVTGTFLCMKYQILAMIERGTKGSIVNTASAAGVVGVPMHGEYVGAKHAVVGLTRVAAADYGKHGIRVNALVPGAVRTPMLQRAMDNDAGLEPYLNSIHPIGRFSEPHEQAQAAVWLLSDAASFVTGSCLAADGGFTAI

SEQ ID NO: 28584 - protein, 418 aa, Synechococcus sp. WH 5701
MTDLARYAADHGLRHFLFSFSDLFGVQRAKLVPASAVNQLARDGAGFAGFAAWLAMTPADPDVLGLPDPASLAVLPWQRSVAWVATDLQVEGRPLEQSPRWVLRRQLERATQLGYSFRTGVEAEFFLLQPGGTAIADVHDTQSKPCYDQLALMRQFELIGGLLEAMEELGWGPYQADHEDANGQFEINWTFADALVTADRHALFRVMAQSMAEPLGARVSFGPKPFPQLTGSGAHLHHSLWDDSGRNLFHDPRGELGLSRLAYHFLGGLLEHAPALCAITNPTAESYARLGGQTTNSGATWSPGWISYGGNNRSHMVRIPDDQRLELRLADSAANPYLLPAAVLAAGLDGLERQLDPGPRNDANLYTDPPAPGTATPLPATLKEALAAFAADTVLREALGESFCQAYESLRARHSASL

SEQ ID NO: 28585 - protein, 250 aa, Sphingomonas paucimobilis
MANRLAGKVALITGGASGLGAAQAKRFAEEGAKVVIGDLNEEMAKGVVAEIRAAGGDALFIRLDVTDAASWNNAIAAAVDGFGGLTTLSNTAGIIHPGGFEEESIEGWNKMVAVNQTAIFLGIKAAIPELVKSGNGSIINISSLIGMFPTAGNASYCATKAAVRIMSKAAALEFVDRGVRVNTIVPGGMNTPITANVPPDVLKQQTSQIPMGKLGDPIDIANGALFLASDEAKYITGVDLPIDGGWSVGV

SEQ ID NO: 28586 - protein, 535 aa, Vitis vinifera
MTPEPSQQEPPNGDGKDEEANRLLPSKSPSSLSPSSDEEEVAYESREKISIVDLEGETLESLDASATPPFSWKKLWLFTGPGFLMSIAFLDPGNLEGDLQAGAIAGYSLLWLLMWATVMGLLIQLLSARVGVATGRHLAELCREEYPTWAGRLLWFMAELALIGADIQEVIGSAIAIKILSRGFLPLWAGVVITASDCFIFLFLENYGVRKLEAVFAVFIATMGLSFAWMFGDAKPSGRELLIGVLVPKLSSKTIRQAVGVVGCVIMPHNVFLHSALVQSRKIDPHRKGRVQEALNYYSIESTVALLISFMINLFVTTVFAKGFYGTKQADGIGLVNAGQYLEEKYGGGVFPILYVWGIGLLAAGQSSTITGTYAGQFIMGGFLNLRLKKWLRALITRSFAIVPTMIVALVFNRSEASLDVLNEWLNVLQSMQIPFALIPLLTLVSKEQVMGVFKVGPLLERVAWTVAALVIVINGYLLLDFFMAEVDGVLFGFLVCAGTALYVAFIFYLVSHGGVLSSTWFSLVTSKRFPFIGS

SEQ ID NO: 28587 - protein, 494 aa, Schizosaccharomyces pombe 972h-
MSAPAGRLQPQRFAALPNPVTAENKFWRSFKVPVVAKEYSAITSIHFSAESPYDFAVTSGARVQIYGASSRSVKKTIARFKDTAYSGNIRKDGKLLLAGDATGLVQIFDLSTRSILRALDAHQFPVHVTQFCPYANTTFLSGSDDKTVKVWDLSTGAVQYDLSGHEDYVRTASWMSATRLVSGGYDGTIRLWDTRIADPEVMSFSHGEAIDVVLPMQSGSTVISAGGPSIKVWDLVAGRQTPTKKLSNHQKSITCLAMNSENTRLLSGGLDGHVKIYNISDWKVVHGMKYSGPILSMGLSPDSCNLVVGMSNGTLSQRTRRITKQTSSKTPFLGGVGSAFGVVGKKKQIYKGENDEFYVEEARRKRLRPFDKALKSFCYSDALDMVLENGSPVLIITMLIELLHVGGLRIALSNRDDLSLTPLINFLRKYIRDPRFSETLCIVTSTILDIYGAALGGSVMVENAISKLREKVEQEVAVTQRANELVGMLQMLSA

SEQ ID NO: 28588 - protein, 351 aa, Vitis vinifera
MGAPLAPVHVSSTDPLPHLSIKNTPIETSSAQYILQQYTAASGGQKLQSSIHNAYAMGKVKMLAAEFETANKVIKTRNSSKAAEGGFVLWQMNPDMWYVELALGGSKVHAGSNGNLVWRHTPWLGAHAAKGPVRPLRRALQGLDPRTTASMFTNARCIGEKRINGDDCFILKLCADPVTLKARSEGPAEIIRHVLLGYFSQKTGLLVHLEDSHLTRIQTNGGDAAYWETTINSFLDDYRPVEGIMIAHSGRSVVTLFRFGETAMSHTKTKMEEAWSIEEVAFNVPGLSLDCFIPPAELRFGSVSESCEFPQGERVKTAVAAAAAAAYRAKVAALEKSHESNVNKIIWKMDV

SEQ ID NO: 28589 - protein, 111 aa, Streptococcus pyogenes SSI-1
MKERYFFCDVVGKCLEEYVDRGIFDKEPFQTFDQKGIGRLFSTAVSLARSVKPDLKLGICGEHGGDPTSIAFCHSQGLTYVSCSPFRVPLTRLAAAQAAIKASGHSLTQDK

SEQ ID NO: 28590 - protein, 224 aa, Mannheimia succiniciproducens MBEL55E
MKSYLIAPSILSADLARLGEDVENVLKAGADVIHFDVMDNHYVPNLTFGPAVCKALRDYGITAPIDVHLMVKPVDRLIPDFAKAGADYITFHPEASEHIDRSLQLIRNSGCKAGLVFNPATSLSYLDYVMDKIDVILLMSVNPGFGGQSFIPATMQKLQEARRRIDESGFDIRLEVDGGVKINNIAEIAAAGADMFVAGSAIFDQPDYRKVINEMRQELAKVQK

SEQ ID NO: 28591 - protein, 353 aa, Magnaporthe grisea 70-15
MGCGMSTEEKEGKARNEEIENQLKRDRLQQRNEIKMLLLGAGESGKSTILKQMKLIHEGGYSRDERESFKEIIFSNTVQSMRVILEAMESLELPLEDQRMEYHVQTIFMQPAQIEGDVLPPEVGNAIEALWKDRGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPISPMKNYFPDYEGGDDYAAACDYILNRFVSLNQHETKQIYTHFTCATDTTQIRFVMAAVNDIIIQENLRLCGLI

SEQ ID NO: 28592 - protein, 605 aa, Arabidopsis thaliana
MAHSQVAYLIPLKADLKEDNSSPRITLSEGPNIIGRGNVSIVDKRLSRKHITIIVSTSGSASLSVDGTNPVVIRSSGDGERKKVKPSEEVSVCNDDLIELIPGHHFFKLVLLNGRAAKKARKAEDDVEAIRRFCPPNEKLPSTFRLLSVDALPDWANTSCVSINDVIEGDVVAAILSNYMVDIDWLMSACPKLANIPQVMVIHGEGDGRQEYIQRKKPANWILHKPRLPISFGTHHSKAIFLVYPRGVRVVVHTANLIHVDWNNKSQGLWMQDFPWKDDDKDPPKGCGFEGDLIDYLNVLKWPEFTANLPGRGNVKINAAFFKKFDYSDATVRLIASVPGYHTGFNLNKWGHMKLRTILQECIFDREFRRSPLIYQFSSLGSLDEKWLAEFGNSLSSGITEDKTPLGPGDSLIIWPTVEDVRCSLEGYAAGNAIPSPLKNVEEPFLKKYWARWKADHSARGRAMPHIKTFTRYNDQKIAWFLLTSSNLSKAAWGALQKNNSQLMIRSYELGVLFLPSPIKTQGCVFSCTESNPSVMKAKQETKDEVEKRSKLVTMTWQGDRDLPEIISLPVPYQLPPKPYSPEDVPWSWDRGYSKKDVYGQVWPR

SEQ ID NO: 28593 - protein, 473 aa, Bacillus subtilis subsp. subtilis str. 168
MRKSLITLGLASVIGTSSFLIPFTSKTASAETLDEKKQKIESKQSEVASSIEAKEKELTELQENQSKIEKELKDINDKALDTSNKIEDKKEENDKTKEEIKKLKKEIKETEARIEKRNEILKKRVRSLQESGGSQGYIDVLLGSTSFGDFISRATAVSSIVDADKDLIKQQEQDKAKLEDSEADLNDKLKEVQAALAKLETMQKDLDKQLNEKDKLFDEAKASQKKTAKAISELKSEASELANQKANTEAEQARIKKEQEAAAALIKKQEEAQKASDETQTDDSQTATTESSKASSSDDSSDNSSDNSSNGSSNSSSNGSSSKKSSGSNSNSGGTVISNSGGIEGAISVGSSIVGQSPYKFGGGRTQSDINNRIFDCSSFVRWAYASAGVNLGPVGGTTTDTLVGRGQAVSASEMKRGDLVFFDTYKTNGHVGIYLGNGTFLNDNTSHGVSVDSMSNPYWKAAFKGVVRRVVQ

SEQ ID NO: 28594 - protein, 337 aa, Erwinia amylovora
MSILVTGGAGYIGSHTVLSLLQRGDDVVILDNLSNASRESINRVEKLTGKTATFFEGDLLDRSCLRSVFSAHRISAVIHFAGLKAVGASTRKPLEYYQNNVTGTLVLLEEMRSAGVNQFIFSSSATVYGADAPVPYVETTPIGGTTSPYGTSKLMVEQILRDYAKANPEFKTIALRYFNPVGAHESGQMGEDPNGIPNNLLPYIAQVAIGRLEKLGIFGDDYPTEDGTGVRDYIHVMDLAEGHLKALDHLSAIEGYKAYNLGAGKGYSVLEMVKAFEKASGGTVAYQISPRRDGDLAAFWADATLADKELNWRVSRGIDEMMRDTWNWQSQNPQGDS

SEQ ID NO: 28595 - protein, 342 aa, Rauvolfia mannii
KLSDSQTMALFTVFLLFLSSSLALSSPILKEILIEAPSYAPNSFTFDSTNKGFYTSVQDGRVIKYEGPNSGFVDFAYASPYWNKAFCENSTDAEKRPLCGRTYDISYNLQNNQLYIVDCYYHLSVVGSEGGHATQLATSVDGVPFKWLYAVTVDQRTGIVYFTDVSTLYDDRGVQQIMDTSDKTGRLIKYDPSTKETTLLLKELHVPGGAEVSADSSFVLVAEFLSHQIVKYWLEGPKKGTAEVLVKIPNPGNIKRNADGHFWVSSSEELDGNMHGRVDPKGIKFDEFGNILEVIPLPPPFAGEHFEQIQEHDGLLYIGTLFHGSVGILVYDKKGNSFVSSH

SEQ ID NO: 28596 - protein, 93 aa, Triticum aestivum
  misc_feature (23)..(23): Xaa can be any naturally occurring amino acid
MAATIHSEKARQIFDSRGNPTVXVDECCSYGTLARAAVPSGASTGVYEALELTDRGSDYLGKGVSKAVNHVNFIIAPAVVGEDPTAQTELYNF

SEQ ID NO: 28597 - protein, 344 aa, Rauvolfia serpentina
MAKLSDSQTMALFTVFLLFLSSSLALSSPILKEILIEAPSYAPNSFTFDSTNKGFYTSVQDGRVIKYEGPNSGFVDFAYASPYWNKAFCENSTDAEKRPLCGRTYDISYNLQNNQLYIVDCYYHLSVVGSEGGHATQLATSVDGVPFKWLYAVTVDQRTGIVYFTDVSTLYDDRGVQQIMDTSDKTGRLIKYDPSTKETTLLLKELHVPGGAEVSADSSFVLVAEFLSHQIVKYWLEGPKKGTAEVLVKIPNPGNIKRNADGHFWVSSSEELDGNMHGRVDPKGIKFDEFGNILEVIPLPPPFAGEHFEQIQEHDGLLYIGTLFHGSVGILVYDKKGNSFVSSH

SEQ ID NO: 28598 - protein, 161 aa, Zea mays
PASEAVPYFEQIGPLFRQLMPMMEASPVYSMARNASGYAWKALFDLAGGLLREYDQEATVFLSKFIDHCPPVTFLVKFTVDAIDDTDIVEDVLRPRVDSIGGQIKKVILSGTHLTPCIQDVKWQVGSEYTPADAIAQGLKSLALSETRVLSRTIADWFTSL

SEQ ID NO: 28599 - protein, 454 aa, Clostridium difficile 630
MDIKELVKMQRKYYNTGKTRDISFRIEQLKKLKLVVSQNEEKILLALKKDLNKSDFEGFMTEVGMFYSELNFAIKNIRKWSKIKRVKSSMVNFPSISKVVPQPYGVTLIMSPWNYPFQLALIPLVWSLAAGNCVILKPSEYSASTSSVVKDIVEDTFSKEYVAVVQGSQEESEKLLLERFDYIFFTGSTNVGKIIMKSASEHLTPITLELGGKSPCIILKDANIDLTAKRLTWGKLINAGQTCVAPDYVLVHEDRKNELIEKIKYYTNKYFGDNPCNNEQFPKIINQKHFNRILSLIDKDKIVYGGNYNKETLKIEPTIVDNVNWDDNIMKEEIFGPIFPILTYKDLDEVIQKIIQMPNPLALYIFTKNKYLENKLLEMIPAGGCCINDTVTHIATNYLPFGGIGESGMGSYHGKAGFDTFTHYKSVLKKLNLDVPIRYAPYDNKLIKVLKKIM

SEQ ID NO: 28600 - protein, 211 aa, Methanococcoides burtonii DSM 6242
MTFPYTKEVLEHFRNPQNVGKMEDPDGKGLEGSPACGDMVAVYLKVNPDTLVIEDISFESYGCASNIATASMITEMAKGKTLEEAKKITWKEAANALGGLPPVKAHCSVLAVEGLRSAIRDYEEKHGMVVENEATTVEVVSKRLKHVMNPMAGLDIIRTELVLKVVVEEGTVRIVLDIPSTHQFAVAIKEDIVDKLESLWDVESVTVDFIS

SEQ ID NO: 28601 - protein, 479 aa, Cryptococcus neoformans var. neoformans JEC21
MASRNPVVTRRAATRSRNDENAAPQQSVRTKPSISHLGPASKTAAVNVSVAAGKKPVAVKVGAKRTALGGVVVNGKGETEAGKKPLKASGKTVTEARQPLASRQNNAQPTRPIAAIPHRSKATPANVYAPVEAPAKLTVEEDMQMEIDARRSQPVSNAADFATVDEELLDDESEEDDMEEEDEEDWLRMSEEEMVKAQEQLDVVQATFKDDVDMFDTTMVAEYADEIFEHMERLEESVMPNPRYMDFQTEIEWTMRTTLIDWLLQVHLRYHMLPETLWIAVNIVDRFLSTRVVSLVKLQLVGVTAMFIAAKYEEILAPSVEEFVYMTENGYTKDEILKGERIILQTLDFTISSYCSPYSWVRRISKADDYDVQTRTLSKFLMEVTLLDHRFLRCKPSMIAAIGMYLARKMLGGDWNDAFIYYSNFTESQLITGASLLCERLIEPDFESVYVYKKYANKKFLRASTFARDWALTNAANSS

SEQ ID NO: 28602 - protein, 400 aa, Zea mays
  misc_feature (213)..(213): Xaa can be any naturally occurring amino acid
MERRLSATSRRSAPSAIQRLSHLAQRVGAVNLAEGFPDFPAPPHVKAAAVAAIAADLNQYRHVQGICDILANTMKRDHDLDVDPLTDFVICCGQSEAFAAAIFAIIDQGDEVLIFDPAYETYETSIELARGVPVYVPLDPPSWTLNEEKFLKSFTSRTKALVLNSPHNPTGKVFSKEELLIISQACQKMDCFVITDEGYEYITYDANKHISLXASLPGMQDSTIITSSLSKTYSVTGWRLGWACAAASIASAIRNIHIKLTDSAPAPFQEAALIALTSTADYYISLRKDYEVKRDFILLLLKDLGFKISVKPQGSVFVFAELPRSCQLSDVEFVTKLINDAGVVAVPGRGFFHKTCDGESYCHRYVRFAFCKGDDTLKAAAMKMRKLASRQGEPWLTGRQ

SEQ ID NO: 28603 - protein, 446 aa, Oryza sativa Japonica Group
MGNGGGGNKKGRRDSPSPPLETPPRGELPSTSSSSSSRATKRHRVAGMADRYFPNDLPDFVAEAPDGGRGLLSLPYSSLSERLLRAALRIKDKVMEETWTRARRQVTDYTLYTGALGTALLLFKSFQVTGNRADLALAGDIVKECDAASRGLPFLTFICGRAGVCALGAVIAKHCNDQLLLTHYLSSFDEIIVTEKVPNELLYGRAGYLWACLFLNTHLGEKTIPHEHITSVAKDIIDEGRKLAKKGNCPLMYEWHGKKYWGAAHGLAGIMHVLMHTELKLDEKDDVKNTLLYMIRNRYPTGNYPSSEGSESDRLVHWCHGAPGVALTLAKAYQVFHDEHFKQTAAEAAEVVWNRGLLKRVGICHGVSGNAYVFLSLYRLTGNVEYLYRAKAFACFLLEKADQLIADGAMHGGDHPFSLFEGRAGMAYLLLDMVSPSESKFPAYEL

SEQ ID NO: 28604 - protein, 285 aa, Triticum aestivum
  misc_feature (48)..(48): Xaa can be any naturally occurring amino acid
  misc_feature (216)..(216): Xaa can be any naturally occurring amino acid
  misc_feature (262)..(262): Xaa can be any naturally occurring amino acid
ELPWNFELFKMPRRTEDAEPAQPMECLEFDDNEEEEVEEEEIEYEEIXEEVEEEVVEEEEEEEEEVEEVEEEEDPEEREVLDEIDASHDSDSKSEVVPLPQQDGAKDGSDKEKHAELLALPPHGSEVYFGGISSDASSDDLKKLCEPVGEVVEVRIMLSKKDSRGYAFVTFRTNDLALKAIEKLNKATFKGKKLRVSSSQAKNKLFVGNIPHSLVXSIDFKKAVEEVGPGVLKVDLIKDPRTDRHRGYGSVEYYYNACAEFXRQKMTAPNFTLDYNAPTVSWGNP

SEQ ID NO: 28605 - protein, 324 aa, Burkholderia sp. 383
MPKAIRYDQPGGPDVMKWVDVEVGEPKAGEVRIRQHAVGLNYIDVYFRTGLYPQALPGGLGMEAAGEVTAVGEGVTTLKAGDRVAYVGQPPGAYAQERVMPADRLVKLPDGISYDDAASVMLQGLTAHYLLRRTYPVKAGDTILIHAAAGGVGLLVCQWAKALGATVIGTVGSDEKAALAKAHGCDHPIVYTRENFTQRVKEITNGAGVPVVYDSIGKDTYIGSLDSLAPLGLFVSFGNASGPLPLIDSKEFSSRGSLFFTRPTLFSYIAKRADLESAAAELFDVLLSGKVKTSINQRYPLAEVARAHEDLEARKTTGSTILVP

SEQ ID NO: 28606 - protein, 326 aa, Mesorhizobium sp. BNC1
MRLILPLPGNETFARRLADDGGWELGALATRRFPDGETYVRILSDVKDKAVDLVSTLARPDDGFLRLIFVADAARSLGAREVNLIAPYLSYMRQDRRFQPGEAITSRSFARLVSSSFDRLVTVDPHLHRYPALSALYTIPTITLHAAPLLADWIASAVEKPLIVGPDEESEQWVSAIAARIGAPHAVLRKVRHGDRNVEIALPDLTGWRGRQPVLADDIASSGHTLIEAARQLPLQGFARPVVAVVHAIFAEDSFQRLAPLCDRIVSSDSVPHESNAVSLAGVIAGAIASSAADDADLVRHRRPPEPLDEVEQAGFDSFPASDPPP

SEQ ID NO: 28607 - protein, 573 aa, Haemophilus influenzae R2846
MKKLSGAEMVVQSLRDEGVEYVFGYPGGAVLDIYDAIHTLGGIEHILVRHEQAAVHMADGYARSTGKVGCVLVTSGPGATNAITGILTAYTDSVPMVIISGQVMSNLIGSDAFQECDMLGISRPVVKHSFIVKKAEDIPSTLKKAFYIASTGRPGPVVVDIPKDTVNPNFKYPYEYPESVELRSYNPTVNGHKGQIKKALKALLVAKKPILFVGGGAITAECSKQLIQFAQRLNLPVTSSLMGLGAYPSTDKQFLGMLGMHGTLEANTAMHESDLILGIGVRFDDRTTNNLEKYCPNAKVIHIDIDPTSISKNVPVAIPIVGNAKNVLEEFLGLLNEEGLKSQTDLESWWQEINQWKAKKCLEFDRTSGVIKPQQVVEAVYRLTKGQAYVASDVGQHQMFAALHYPFDEPRHWINSGGAGTMGFGFPAALGVKLAHPEGTVVCVTGDGSIQMNIQELSTATQYGIPVVIICLNNHFLGMVKQWQDLIYSGRHSQTYMNSLPDFAKLAESYGHVGIKIATPDELESKLQEAFSIKNKLVFVDINVDESEHVYPMQIRGGAMNEMILSKPQEETN

SEQ ID NO: 28608 - protein, 388 aa, Burkholderia pseudomallei K96243
MKIHEYQGKEILRKFGVAVPRGKPAFSVDEAVKVAQELGGPVWVVKAQIHAGGRGKGGGVKVAKSLEQVREYSNQILGMQLKTHQTGPEGQKVNRLLIEEGADIKKELYVGIVIDRVSQKVVVMASSEGGMDIEEVAEKTPEAIHKVAVEPSVGLQDAEADDLAKKIGVPDASIPQAREILKGLYKSFWETDASLAEINPLVLTGDGKVIALDAKFNFDSNALFRHPEIVAYRDLDEEDPAEIEASKFDLAYISLDGNIGCLVNGAGLAMATMDTIKLFGGEPANFLDVGGGATTEKVTEAFKLMLKNPGLKAILVNIFGGIMRCDVIAEGVIAGSKAVNLNVPLVVRMKGTNEDLGKKMLAESGLPIISADSMEEAAQKVVAAAAGK

SEQ ID NO: 28609 - protein, 218 aa, Nanoarchaeum equitans Kin4-M
MHYIEQKLMDGFHIDNRPLLEYRPIKIKEDQNRVWLSLGNTQVIAGLSISEEEPMEKGKANLIVNADFSPIAGKEYFQGPPTEQDLILARLIDRALRSSNAIALEKHVIDENKVKSFYIDVIVLEDDGNILDASMLAVVKLLEKANLLERKPLYISFYKYKNIIFVDPTKEEEQISNAKISIAIDGENIVSIQKDYGSFDENEIEELIDLAFDLYKKL

SEQ ID NO: 28610 - protein, 230 aa, Saccharomyces cerevisiae
MRQVLQKDKRDVQLSKALSYLLRHTAVKEKLTIDSNGYTPLKELLSHNRLKTHKCTVDDIHRIVKENDKQRFHIKTLGADEEWICATQGHSIKSIQPSDEVLVPITEASQLPQELIHGTNLQSVIKIIESGAISPMSRNHVHLSPGMLHAKGVISGMRSSSNVYIFIDCHSPLFFQTLKMFRSLNNVYLSSSIPVELIQKVVVKGNLKDEEKLDTLRRILHERNIPLEKI

SEQ ID NO: 28611 - protein, 347 aa, Staphylococcus aureus subsp. aureus Mu50
MKALKLYGVEDLRYEDNEKPVIESANDVIVKVRATGICGSDTSRYKKMGPYIKGMPFGHEFSGVVDAIGSDVTHVNVGDKVTGCPAIPCYQCEYCLKGEYARCEKLFVIGSYEPGSFAEYVKLPAQNVLKVPDNVDYIEAAMVEPSAVVAHGFYKSNIQPGMTVAVMGCGSIGLLAIQWARIFGAAHIIAIDIDAHKLDIATSLGAHQTINSKEENLEKFIENHYANQIDLAIESSGAKVTIGQILTLPKKGGEVVLLGIPYDDIEIDRVHFEKILRNELTVCGSWNCLSSNFPGKEWTATLHYMKTKDINVKPIISHFLPLEKGPETFDKLVNKKERFDKVMFTIY

SEQ ID NO: 28612 - protein, 498 aa, Polaromonas sp. JS666
MRAVPTFAQLCGIRDAARQQALEHTSGLITASDLELVRFAWCDLHGVTRGKTLVAGAAAKAMQEGVGLVSTLVLKDTSDRSTAFKVFERGGPAGLPGFEFASNLLLLADPSSFRQLPWTPATGWVQGQLWFQNGQPVELDTRRVLQQALAGLARAGYGMKCGLEVEFHIYKITEEGTRDQLDPNQAGWPGLPPQVSLVHPGYNMLTEGWYDLAEEPLRIVQHTAQALGLPLLSLEIELGPSQVEAVFEATDALTAADNMVLFRNAVKQALRRAGYHASFMCRPPFANIMSSGWHLHQSLVDSETGRNVFQREAPAPGSTAADARHTLSETGEHYLAGLLAHARGMAVFCTPTINGFGRYRPNALAPQAVLWGRDNRGAMLRVVGQCGDGATRIENRIGEPAANPYLYLASQIHAGLDGITRRLKAPPATDAPYGASGTLLPTSLGEALEALQTDPILVKAFGSAFVDYLVRVKRSELDRYAQAEDKDDWQRREYFSRI

SEQ ID NO: 28613 - protein, 242 aa, uncultured bacterium
MTRPAAVVARRMAIPCVSGSSEIDITYEQKIFRTSSNVQFKEGDVLTIDGSTGRAILDKVPTIKPEISGDFSKLMSWADRYRKLKVRTNSETPLDTKTAREFGADGIALCRTDHMFFDEDRILSVTEMILSKTIKDRNNALAKLLPHQKNDFIQIFELMNGLPVTDRLLDPPLHEFLPKNDKDIGDLTSVTRLNANEIRSRTDELHEHNPMLGHRGCRLGISFPEIYEMHCLAFFEALGECK

SEQ ID NO: 28614 - protein, 378 aa, Schizosaccharomyces pombe 972h-
MSMLSTLRTAGSLRTFSRSACYSFRFSSTKAAAGTYEGVKNANGNYTVTMIAGDGIGPEIAQSVERIFKAAKVPIEWERVKVYPILKNGTTTIPDDAKESVRKNKVALKGPLATPIGKGHVSMNLTLRRTFGLFANVRPCVSITGYKTPYDNVNTVLIRENTEGEYSGIEHEVIPGVVQSIKLITRAASERVIRYAFQYARQTGKNNITVVHKATIMRMADGLFLECAKELAPEYPDIELREEILDNACLKIVTDPVPYNNTVMVMPNLYGDIVSDMCAGLIGGLGLTPSGNIGNQASIFEAVHGTAPDIAGKGLANPTALLLSSVMMLKHMNLNDYAKRIESAIFDTLANNPDARTKDLGGKSNNVQYTDAIISKLK

SEQ ID NO: 28615 - protein, 388 aa, Synechococcus sp. WH 5701
MAEWSRRRVLLAGLAITGAASGVSEFLRRRSFQYEQADLTDQLLNSPDVVNRAVTNAIEGDKEATAEVERILAGLNLQAPNLPYDRSISKTLIQASRLATEQYLTGKFNLSFDGSIRGLPTYSDRFSGYTQFASIKGPETVNAEQRIDLDQRSGRDPLLAGSHRLSRLITGFAGRTGPAMVIRWSFPVYWGFVLSGPSHHLLVLRGTQRGYEWFQTLRANQVVAREVPELEFAGSIHDGFASIYARLSRPVIDAARHLDPTKPLFVSGHSLGSPLASLAALDIAQKIPSFRDNLRLYTYAGPRLGNPAFAEAFSRLVPNSYRIVNQADLVPTLPPTRTRDIIYVHLGEPWGFTSASGDIGPNHFISAYRLAVDQEREQPLASIKLVPQ

SEQ ID NO: 28616 - protein, 327 aa, Vitis vinifera
MEEGEMVCEAARKGDTAKLRALIDSGADVSFFDREGLSPLMHAARLGHADAVKILLEAGAPWNALSPSNLSAGDFAMDSGHQEAFEVLLNAGIQAELILGTITRKANKNGDSDEDYLGDRITFSEDKLMDSNSKAIMMAWEKPLMEAHAKAVCSGGGHILNIGFGMGLVDTAIQQYKPATHTIIEAHPEVYNRMLHTGWGEKDNVKIIFGRWQDVLPQLESYDGIFFDTYGEYYEDLREFHQHLPTLLKPGGIYSFFNGLCGGNAFFHVVYCHLVSLELENLGYSTQLIPLPVKDCLGEEVWEGVKHKYWKLDTYYLPVCQSLQDSE

SEQ ID NO: 28617 - protein, 341 aa, Williopsis saturnus
AGVAKFAKYPLTFGPSPISNLNRLSQHLGSKVNVYAKREDCNSGLAFGGNKLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVYEGKSMQGLIALIKEDYFKPGANVLYVHLGGAPALSAYSSFFPTKTA

SEQ ID NO: 28618 - protein, 782 aa, Vitis vinifera
MCKEELSWSSRPTAHSIPFSSSPVCRDTRNMKTWRLSIVVLVSFHFALVVAEEIKHQQKNTYIVHMDKSNMPTTFDDHFQWYDSSLKTASSSADMLYTYNNVVHGFSTRLTTEEAELLRGQLGILSVLPEARYELHTTRTPEFLGLGKSVAFLPQADSASEVIVGVLDTGVWPELKSFDDTGLGPVPSSWKGECETGKTFPLSSCNRKLIGARFFSRGYEVAFGPVNETIESRSPRDDDGHGSHTSTTAVGSAVEGASLFGFAAGTARGMATHARVAAYKVCWLGGCYGSDIVAAMDKAVQDGVDVLSMSIGGGLSDYTKDSVAIGAFRAMEQGILVSCSAGNGGPAPSSLSNVAPWITTVGAGTLDRDFPAFVMLGDGKKFSGVSLYSGKPLSDSLIPLVYAGNASSSPNGNLCIPDNLIPGKVAGKIVLCDRGSNARVQKGIVVKEAGGVGMILTNTDLYGEELVADAHLLPTAAVGQKAGDSIKSYISSDPNPMATIAPGGTQVGVQPSPVVASFSSRGPNPVTPEILKPDIIAPGVNILAGWTGAVDTRKVSFNIISGTSMSCPHVSGLAALLKAAHPEWRPAAIKSALMTTAYHTYKGGETIQDVATGRPATPFDYGAGHVNPVSALDPGLVYDATVDDYLSFFCALNYKQDEIKRFTNRDFTCDMNKKYSVEDLNYPSFAVPLQTASGKGGVVKYTRTLTNVGTPATYKVSVSSQISSVKISVEPESLTFSEPNEKKSYTVTFTASSMPSGMTSFAHLEWSDGKHIVGSPVAFSWT

SEQ ID NO: 28619 - protein, 472 aa, Spiroplasma citri
MNLELNALINGELINNGDWLEIISPINNKPYGRVPALKEKEINEAFKGVRHSQKAWAKLTLFERISYLQKWAKLLESHKTELAKIMAHEVGKSLKDGQIEVERSIEYIDYTIEEAKRVFPETLTGDGWNVKNKIGIFSRVPKGVVLAISPFNYPVNLSIAKIAPSLVVGNTVVFKPATNGSLTGLYMAKLAFEVGFPKGVFNVVTGRGRDIGDLLVLNPEINVISFTGSVAVGNHIRKLGHGKDLVLELGGKDPVLVLKDADLAKAVKEIVAGAYAYSGQRCTAIKRVLVDETIAAELVQLLKIEVGKLEVGSPLDNKAIIPVIDLKAADFVQGLIDDALAKKATLVLGNQRKDNLLSATLIDHVTPEMRLAWEEPFGPVLPIIRCKNVEEMITLANKSNFKLQACIFTKDINAAFNIANELETGTVNINGRTQRGPDSFPFLGIHDSGQGVQGIRETINSVTRFKGLVINY

SEQ ID NO: 28620 - protein, 464 aa, Candida albicans
MFVLHSYSKLPNINEYAKAKSTPLDVFVWGTGSMCELGLGPSAKNKEVKRPRLNPYLTEEKLGGTKIVDFAVGGMHTLALDGKNRIWSWGGNDSEVLGRDTCQAKEVLKDIDGKNGNDDDDDDEDGDLNEAESTPALVENLPEGEIVQLAATDNLSAALLSNGDVYSWGCFRCNEGLLGFLRDEIKLQKTPLKIKELKKHCPIMRSVKIILLALDSKEWMPGVNGQQYQLGRRILERHRYRSLEPQQFGLYNIKYIASGDFHCFAIDHSHNVYAWGLNQYGQCALTGDNGELEDGSVLMKPTLIPELSHKGIKEIAAGEHHTLALTEDGQVYAWGRYDMKEIGIPKDKLPKSTFKINTGTHGSFSFLQNLFAVKIKTIGVGSHHSFAVTEDGVVYAWGFAETYGPGLGPSIDDVEKPTRIVNTATKNEDILLIGAGGQFSVSGGVKFEDEEKAEVRLDKYEDLE

SEQ ID NO: 28621 - protein, 150 aa, Zea mays
MAEQTFIMIKPDGVQRGLIGEVISRFEKKGFYLKGLKLQNVEKSFAEQHYADLSSKPFFAGLVEYIVSGPVVAMVWEGKSVVSTGRKIIGATNPLASEPGTIRGDFAVDIGRNVIHGSDSVESARKEIALWFPEGIAEWRSSQHNWIYEA

SEQ ID NO: 28622 - protein, 167 aa, Bacillus thuringiensis
FKEYIDPAVGLQGFQARRIAFNINIPKELVGQAVKFMMGLYRAFIEKDCSIAEINPLVTTGEGKVMALDAKLNFDSNALYRHKDILELRDLDEEDAKEIEASKYDLNYIPLDGNIGCMVNGAGLAMATMDIIKHYHGDPANFLDVGGGATAEKVTEAFKIILSDKNV

SEQ ID NO: 28623 - protein, 167 aa, Bacillus sp. AH 1123
FKEYIDPAVGLQGFQARRIAFNINIPKELVGQAVKFMMGLYRAFIEKDCSIAEINPLVTTGDGKVMALDAKLNFDSNALYRHKDILELRDLDEEDAKEIEASKYGLNYIPLDGNIGCMVNGAGLAMATMDIIKHYHGDPANFLDVGGGATAEKVTEAFKIILSDKNV

SEQ ID NO: 28624 - protein, 493 aa, Bordetella pertussis Tohama I
MSLSVGNAALLPGRNLIGSEWREAALGARFAVADPATGKVIAHVPDSGARDAGAAVTAAHQAFADWRRTPAKVRAQIIKRWNALLHENAEDLARLISSEQGKPLAEARGEVSYAASYVEWFAEEATRADGDLIPSPAQGRRMFALREPVGVVAAITPWNFPAAMIARKIAPALAAGCTVVCKPAEDTPLTSLALTALAQQAGVPPGVLNIVTASRGRAAEVADAWLDDPRVRKITFTGSTPVGKHLARRSADTLKRVSLELGGNAPFIVFDDADLDAAVEGLMVSKFRNGGQTCVCPNRIFVQAGVHDAFVRKLAARVEGLVVGPASDPASQIGPMINARAVEKIEHHVADALERGARLAVGGKRIHSARCAGDHYYAPTVLTGVDETMACFREETFGPVAPITVFASEAEVVAAANATAFGLAAYFYSTDVRRIWRLADALETGIVGVNEGALAAEAAPFGGVKDSGYGREGSRHGLAEYMQIKYVCQGQLD

SEQ ID NO: 28625 - protein, 176 aa, Brassica napus
  misc_feature (70)..(70): Xaa can be any naturally occurring amino acid
MASASATATLLKPTPLPPHKPIITASVSPPLPPPRRHNLLRRDLLSLSAASTLLLTQSLPFLAPSPASGXPEDEEYVKDTSAVISKVRTTLSMERTDPNVADAVAELREVSNSWVAKYRKEKALLGKASFRDIYSALNAVSGHYVSFGPTAPIPAKRKARILEEMETAEKALSRGR

SEQ ID NO: 28626 - protein, 415 aa, Robiginitalea biformata HTCC2501
MDIFLITTILVLVSALFGYVNTRFIRLPNTIGLTVITIVFTLAVFAISAVDSTLLDAERYILEHIDFKSLLLDTMLGFLLFAGALHTDLEKLRAQRWPVLAFATFGVLVSTFLVGGATYMLLPLLGLQVDFIYCLLFGSLISPTDPIAVLGILKKAGAPKKLEIKIVGESLFNDGVGVVIFLTIFGLASGSGEPFSLAHVAELFIHEVAGGLLLGLALGWVTYRMMRSIDDYSIEVIITLATVMTGIVLSQYLHVSGPLAMVAAGLMIGGPRTRSAAMSEITETYVDRFWELLDVLLNTILFVLVGMEILVLDLESPYVIAGVVMIPITLLCRHISLFLPVKIFEKRLDFVPHTHLMMTWGGLRGAISIALALGLTQDMHRDLFLVVTYIVVIFSIIVQGLSVETLVGRLRKGWN

SEQ ID NO: 28627 - protein, 436 aa, Vibrio vulnificus YJ016
MVKSAPATYRIFYCLFNQKHKVKLMPFSTLSLSSELIHALPKDFKKPTDIQALAIPELLAGQDLLALANTGSGKTLAYGLPLLEKLRVNPEQKALILVPTRELATQVSEAINQVGQALGLNAVCLCGGVDKEQQLQALATNPHILVATTGRLVDLANNGLDLSNIHYLVLDEADRLLDMGFWPDVQNIAAQTSSQRQTAMFSATFSDELKGKAKLLMQAPKQVAAHQENSTNQDIAETLYLVNKGSKTKALIELIQKNAWTQALVFIGAKENADGLAKKLNKAGISTNALHGDKSQAEREEALAQFKSGQTQVLIATDLLARGIHIEQLPVVINFELPMHAETYVHRVGRTARAGEQGVALSLVCHGEMDALSAIRHLTQRELPVQDLEGFPVTDKPSTGESKRAPRDKKANRRTQNKKSVKQFQSKAKRPAPKSK

SEQ ID NO: 28628 - protein, 267 aa, Ostreococcus tauri
MSSKTSVAPAIIIGGGRVGQALREMGPEGDVVVRRGEAFPSEPSSGPIFVATRNDVLEDVIANTPANRREDLVFMQNGMLQTFLDAQGLGANTQALIYFAVAKAGDAPTDGVTELNPEGLTAVTGKWADAVAARFHAGNLSCHVLDASTYQGSMYEKLIWICAMMLVGAQHEGAKVGDVATTHKDEVVALIEELLSGTTTCTGAQFAPGAVDRLIAYAKTVAHFPCGVKEFPWRNGYFHGLSAEAIAEGKPDPFPIHTKLLQNIGAI

SEQ ID NO: 28629 - protein, 369 aa, Thermotoga sp. RQ2
MKKEKKDYYEILGVPRDATQEEIKRAYKRLVKEWHPDRHPENRKEAEQRFKEIQEAYEVLSDPQKRAMYDRFGYVGEQPTYQETESGGFFDDIFREFENIFNRDIFDVFFGERPHQEERREYARRGEDIRYEIEVTLSDLINGAEIPVEYERYETCPRCGGTGVEPNAGYINCPSCGGTGRIREERRSFFGYFVSERTCERCGGTGKIPREYCHECGGSGRVLRKVRKTVKIPPNVEDGTQLRITGGGNAGYYGGPYGDLIVIVRVKPDPRFKKSGSDLVYDITIDYLQAILGTTVEVPLPEGGTTMLKIPPGTQPETVFRLKGKGLPNRYGRRGDLIVNVHVEIPKSLSREERKVLEELAKKRGVTID

SEQ ID NO: 28630 - protein, 165 aa, Triticum aestivum
  misc_feature (120)..(120): Xaa can be any naturally occurring amino acid
FQQGLYMGNGGGANVVAPGYTKGDGLGAEIVGTFILVYTVFSATDAKRNARDSHVPILAPLPIGFAVFLVHLATIPITGTGINPARTLGAAIIYNRDHAWSDHWSLGRPFIGAALAAIYXVIIKGIPFKTSLNCRGCAEVGNYCLPSLFAESSSLSLKTTAHARY

SEQ ID NO: 28631 - protein, 348 aa, Saccharomyces cerevisiae
MSIPETQKGVIFYESHGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQQYATADAVQAAHIPQGTDLAQVAPILCAGITVYKALKSANLMAGHWVAISGAAGGLGSLAVQYAKAMGYRVLGIDGGEGKEELFRSIGGEVFIDFTKEKDIVGAVLKATDGGAHGVINVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 28632 - protein, 434 aa, Mycobacterium tuberculosis
GQSYQAVSAQAAAFHDRFVQLLNAGGGSYASAEIANAQQNLLNAVNAPTQTLLGRPLVGDGADGASGPVGQPGGDGGILWGNGGNGGDSTSPGVAGGAGGSAGLIGNGGRGGNGAPGGAGGNGGLGGLLLGNGGAGGVGGTGDNGVGDLGAGGGGGDGGLGGRAGLIGHGGAGGNGGDGGHGGSGKAGGSGGSGGFGQFGGAGGLLYGNGGAAGSGGNGGDAGTGVSSDGFAGLGGSGGRGGDAGLIGVGGGGGGNGGDPGLGARLFQVGSRGGDGGVGGWLYGDGGGGGDGGNGGLPFIGSTNAGNGGSARLIGNGGAGGSGGSGAPGSVSSGGVGGAGNPGGSGGNGGVWYGNGGAGGAAGQGGPGMNTTSPGGPGGVGGHGGTAILFGDGGAGGAGAAGGPGTPDGAAGPGGSGGTGGLLFGVPGPSGPDG

SEQ ID NO: 28633 - protein, 336 aa, Triticum aestivum
  misc_feature (18)..(18): Xaa can be any naturally occurring amino acid
  misc_feature (231)..(231): Xaa can be any naturally occurring amino acid
  misc_feature (236)..(236): Xaa can be any naturally occurring amino acid
  misc_feature (249)..(249): Xaa can be any naturally occurring amino acid
MTEAVGDFGLIGLAVMGXNLILNAVDHGFTVVAFNRTVAKVDRFLNDEAKGKSIVGAHSIKEFVAKLKKPRRMMMLVMAGKPVDDFIELLLTEGGAEEGDIIIDGGNSHYPDTNRRTKYLASKGIRFVGSGVSGGEEGARYGPSIMPGGNEEAWPYIKDVLQSISAKSDGEACCQWVGDEGAGHYVKMVHNGIEYGDMQLICEAYDIMKRSGHEQQEMGDVFRVEQGVLDXFLIEXRDIMYKNDDDGVXIVEKTWIAGQKDSRDCINALDLVCRHLIGRRLRSLLSLKSERGRCWLFDGLATFWNAGFLDLDRPVHRDIESSSSLSNLSRTLGKLN

SEQ ID NO: 28634 - protein, 304 aa, Staphylococcus aureus subsp. aureus Mu50
MTNKVVILGSTNVDQFLTVERYAQPGETLHVEEAQKAFGGGKGANQAIATARMQADTTFITKIGTDGVADFILEDFKAAHIDTSYIIKTTEAKTGQAFITVNAEGQNTIYVYGGANMTMTPEDVINAKDAIINADFVVAQLEVPIPAIISAFEIAKAHGVTTVLNPAPAKALPNELLSLIDIIVPNETEAELLSGIKVTNEQSMKDNANYFLSLGIKTVLITLGKQGTYFATKNQSQHIEAYKVNAIDTTAAGDTFIGAFVSRLNKSQDNLADAIDFGNKASSLTVQKHGAQASIPLLEEVNQV

SEQ ID NO: 28635 - protein, 251 aa, Carboxydothermus hydrogenoformans Z-2901
MRKLITVKTEKELRLMREAGRIVALTLQALEKAIEPGITTLELDKIAEETIKKLGGKPAFKGLYGFPATICASINEEVVHGIPGLRKLRNGDIISIDIGAVVDGYYGDAAKTWPVGEVSPEAKKLIEVTEASLYAGIEAAVVGNRVSDISHAVESYVVRHGFSVVRQYAGHGIGKALHEEPNVPNYGKPGRGARLVPGMTLAIEPMVNIGTYEVFTLPDKWTVVTRDGKWSAHFEHTIAITENGPMILTLP

SEQ ID NO: 28636 - protein, 119 aa, Plantago major
MATSSEEGQVYSVHSVEEFKDHLEKSKEAKKLVVIDFTASWCGPCRFIAPILAELAKKTPHVMFLKVDVDELKAISVEYEVEAMPTFVFLKDGKPIDRLVGAKKEDLLAKITTHGTVVA

SEQ ID NO: 28637 - protein, 334 aa, Magnaporthe grisea 70-15
MSANLEAQAAAEATLQGFLWRQREAPKPLPAGTSAKGQTSIITGSNTGLGLEASRQLLRLGLSHLVMGVRSKERGEAAAEQLRAEFPDAKISVWIVDMASYDSIRAFAAKCGAELERIDSVILNAAVQTPQFSLVEATGHELTMQTNYLSTAFLSLLLVPVLKAKKKEGAAPPVLSIVGSDTSYMTTLLSMNPALPACDKPENYSQFQAYARAKLLLVFFVAKLAEHVDPADVIINYPNPGLTKGTEIGRSATTLSKVTFAAMQYLLARELDVGASVYLDAVFNYGAKGHGSFISDWTIKPYPPVWYTEEGKQLRTSLWEETLNELKPAGAPLP

SEQ ID NO: 28638 - protein, 284 aa, Chenopodium rubrum
MEGKEEDVRLGANKYSERQPLGTSAQSKDYKEPPPAPLFEPGELQSWSFWRAGIAEFMATFLFLYITVLTVMGVKRSPNMCASVIQGPSWAFGGMIFALVYCTAGISGGHINPAVTFGLLLARKLSLTRAVFYMVMQCLGAICGAGVVKGFQPTPYDVLGGGANKVNHGYSKGDGLGAEIVGTFVLVYTVFSATDAKRSARDSHVPILAPLPIEFAVFLVHLATIPITGTGINPARSLGAAIIYNKERSWNDHWIFWVGPFIGAALAAVYHQIVIRAIPFKSKG

SEQ ID NO: 28639 - protein, 182 aa, Vitis vinifera
MASEDAQDHRIARISSAIRVIPDFPKPGIMFQDITTLLLDPQAFKDTIDLFVERYKGKNISVVAGIEARGFIFGPPIALAIGAKFVPMRKPNKLPGAVISQEYALEYGTDKIEMHVGAVQAGERALVIDDLIATGGTLCAAINLLERVEVDVVECACVIELPELKGRDRLGDKPLFVLVSAA

SEQ ID NO: 28640 - protein, 486 aa, Ricinus communis
MVENTAAKNHPHQVFDVSINMQTQVVGSKWLDDDGRTKRTGTVWTASAHIITAVIGSGVLSLAWAIAQLGWIAGPAVMFLFSLVTYYTSTLLSACYRSGDPVNGKRNYTYMDAVRTNLGGAKVKLCGFVQYLNLFGVAIGYTIASSISMMAIKRSNCFHKSGGKNPCHINANPYMIAFGIAEIIFSQIPDFDQLWWLSILAAVMSFTYSTIGLGLGIAQVVENGKAMGSVTGISIGANVTPTQKIWRSFQALGDIAFAYSYSIILIEIQDTVRSPPSESKTMKKATLISVAVTTLFYMLCGCFGYAAFGDMSPGNLLTGFGFYNPYWLLDIANVAIVVHLVGAYQVYCQPLFAFVEKAAAQRYPDSGFITKDIKIPVPGFRPFNLNLFRSVWRTLFVVFTTVISMLLPFFNDIVGLLGALGFWPLTVYFPVEMYIAQKKIPKWSTRWLCLQILSAACLVITIAAAAGSIAGVVGDLKSVKPFQTSY

SEQ ID NO: 28641 - protein, 575 aa, Pseudomonas sp. A14
MKNQTFSKALLATALSCALFNVHAASQAPVGAENGMVVTAQHIASKVGVEVLKSGGNAIDAAVAVGYALAVVYPAAGNIGGGGFMTIQLADGRKTFLDFREKAPLAATANMYLDKDGNVIKGASTTGYLAVGVPGTVSGMEYAREKYGTKTRQQLISPAITLADKGFVLEQGDVDMLWTSTKDFEKDRANSGAIFMNKGQPFQPGERLVQKDLARTLRLISAKGTDGFYKGEVADKLVASMKAGGGIITQADLDQYKTRELAPVECDYRGYHVVSAPPPSSGGVVICEIMNILEGYPMKELGYHSAQGVHYTIEAMRHAYVDRNSYLGDPDFVKNPLAHLLDKDYAAKIRAAINPQKAGISQEIKPGVPPHEGSNTTHYSIVDKDGNAVSVTYTLNDWFGAKVMANGTGVLLNDEMDDFTSKVGVPNMYGLIQGEANAIGPGRRPLSSMSPTIVTKDGKTVMVVGTPGGSRIITATLLTMLNMIDYGMNLQEAVDAPRFHQQWMPESTNIEAFALSPDTQKILESWGQKFAGPQPANHIAAILVGAPSLGGKPIGKNRFYGANDPRRNTGLALGY

SEQ ID NO: 28642 - protein, 342 aa, Kineococcus radiotolerans SRS30216
MSTATTGSTGYVNPTGDFRRDQRYIETRITADGRDGYPVEADRYRLIVSRACPWANRAIIVRRLLGLEPVLSMGIAGPTHDERSWTFDLDPDGRDPVLGIERLQEAFFARYPGYDRGITVPAIVDVPTGKVVTNDFPQITVDLSLEWTQFHREGAPQLYPEHLRAEIDAVNRDVFRDVNNGVYRAGFAGTQEAYQRAHDRLFARLDALSERLEHQRYLVGDTITEADVRLFTTLARFDPVYHGHFKCNRQKLSEMPVLSAYFRDLYQTPGFGDTTDVLHIKQHYYGVHRDINPTGVVPAGPDLSGWLEPHGREALGGRPFGDGTPPPPPVEAEVVPAGHRPV

SEQ ID NO: 28643 - protein, 451 aa, Shewanella sp. MR-4
MAQHFDYICLGAGSGGIASANRAAMRGAKVLLIEAKHVGGTCVNVGCVPKKVMWYGAHIAEAMHLYAKDYGFDVSVNKFDWNTLVNSREAYIGRIHEAYGRGFTNNKVTLLNGYGRFVNGNTIEVNGEHYTADHILIATGGAPTIPNIPGAEYGIDSDGFFALREQPKRVAVVGAGYIAVEVAGVLHALGSETHLFVRKHAPLRNFDPMLIDALVDAMKTEGPTLHTNSVPQSVVKNADDSLTLHLENGESMTVDCLIWAIGRSPATGNIGLENTDVQLDSKGYVITDAQQNTTHKGIYCVGDIMAGGVELTPVAVKAGRLLSERLFNGMSDAKMDYSQIPTVVFSHPPIGTMGLTEPEARAQYGDDNVKVYTSSFTSMYTAVTSHRQACKMKLVCAGKEEKVVGIHGIGFGMDEILQGFGVAMKMGATKADFDAVVAIHPTGAEEFVTMR

SEQ ID NO: 28644 - protein, 229 aa, Zea mays
MAGGDDLKLLGLWASPYVLRVKLALSLKGLSYENVEEDLRDKSELLLKSNPVHQKVPVLIHGGKPICESQVILQYIDEAFAGTGPSLLPADPYERAVARFWAAYIDDKMLPAWNQSTMGKTEEERAEGKKQSVVTVETLEGALRDCGGQGKPFFGGDSVGYVDVVLGGLLGWVRASEELHGVRPFDPERTPLLAAWSERFGALDAVQTVMPDVGRLLEFGKALMARLAA

SEQ ID NO: 28645 - protein, 514 aa, Oryza sativa Indica Group
MNGGDAAAAAATPSHRRLPDFLQSVNLKYVKLGYHYLITHLLTLLLLPLMAVIVLEAGRTDPDDLRQLWLHLQYNLVSVLVLSAVLVFGATVYVLTRPRPVYLVDFACYKPPDKLKVRFDEFLHHSKLCGFSDDCLEFQRKILERSGLSEETYVPEAMHLIPPEPTMANARAEAESVMFGALDKLFKFTGVKPKDVGVLVVNCSLFNPTPSLSAMIVNKYKLRGNIKSFNLGGMGSSAGVIAVDLARDMLQVHRNTYAVVVSTENITQNWYFGNRKSMLIPNCLFRVGGAAVLLSNRGADRRRAKYALKHVVRTHKGADNKAFNCVYQEQDDEGKTGVSLSKDLMAIAGGALKTNITTLGPLVLPFSEQLLFFATLVAKKLFNAKIKPYIPDFKLAFEHFCIHAGGRAVIDELEKNLQLQPVHVEASRMTLHRFGNTSSSSIWYELAYMEAKGRVRRGHRIWQIAFGSGFKCNSAVWHALRNVKPSPESPWEDCIDRYPVELVDGFATHNNTQQ

SEQ ID NO: 28646 - protein, 118 aa, Triticum aestivum
  misc_feature (38)..(38): Xaa can be any naturally occurring amino acid
FTSFGSRATSLLLAKMSTVTRAYLDQRLAAAKRCSREXKATAVATVVAATVPTLASVRMLPWAKANLNPTGQALIISTVAGMAYFIVADKTILFMARKHSFDDAAPQEQLLPLKKITL

SEQ ID NO: 28647 - protein, 420 aa, Oryza sativa
MDRASENRRLAAVGKPVPGIGEMGNRRPLRDINNLVGAPSHPSAIAKKPMLEKSGKEEQKPALVVSHRPMLRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLSAAAVYTAQCALTRCQQWTKTCELHSRYTGEQLLECSRMMVDFHQKAGAGKLTGVHRKYSTFKFGCAAKTEPALFLLESGAGGYNLQKQPC

SEQ ID NO: 28648 - protein, 167 aa, Bacillus sp. AH 1247
FKEYIDPAVGLQGFQARRIAFNINIPKELVGQAVKFMMGLYRAFIEKDCSIAEINPLVTTGDGKVMALDAKLNFDSNALYRHKDILELRDLDEEDSKEVEASKYDLNYIPLDGNIGCMVNGAGLAMATMDIIKHYHGDPANFLDVGGGATAEKVTEAFKIILSDKNV

SEQ ID NO: 28649 - protein, 320 aa, Ostreococcus tauri
MANGAREVVAAASTSETRTKTLDPFVGQLCASAFSASFAEFCTIPLDTAKVRMQLASNATGAVDGRYASMASTMRTVVAEEGAAALWKGIAPGIHRQVLFGGLRIGMYEPVKAFYAEKMGTASEGADAPLALKIAAGLTTGAIGITIASPTDLVKVRMQAEGRLPEGTPKRYPSAVGAYGTIVRQEGVAALWTGLTPNIMRNSIINAAELASYDQFKQTFVGMGAKADEVSTHIASAIGAGFVATCVGSPVDVVKSRVMGDSVGKYKGFIDCVTKTLTHEGPMAFYGGFLPNFARLGGWNVCMFLTLEQVRRLMRENDIM

SEQ ID NO: 28650 - protein, 167 aa, Bacillus sp. AH 1270
FKEYIDPAVGLQGFQARRIAFNINIPKELVGQTVKFMMGLYRAFIEKDCSIAEINPLVTTGDGKVMALDAKLNFDSNALYRNKDILELRDLDEEDSKEIEASKYDLNYIPLDGNIGCMVNGAGLAMATMDIIKHYHGDPANFLDVGGGATAEKVTEAFKIILSDKNV

SEQ ID NO: 28651 - protein, 167 aa, Bacillus sp. AH 1271
FKEYIDPAVGLQGFQARRIAFNINIPKELVGQAVKFMMGLYRAFIEKDCSIAEINPLVTTGDGKVMALDAKLNFDSNALYRNKDILELRDLDEEDSKEIEASKYDLNYIPLDGNIGCMVNGAGLAMATMDIIKHYHGDPANFLDVGGGATAEKVTEAFKIILSDKNV

SEQ ID NO: 28652 - protein, 325 aa, Vibrio vulnificus YJ016
MKHIAIIGECMIELNGKPFGSMHQTFGGDTLNAAVYLSRGCEANNKPDEVKVSYVTALGNDPISTGMLTRWEDEGVSTDLVLRDETRTPGLYLIQLDDQGERTFLYWRNQSAARYLLQHPNFGMVKQALTQVDAVFLSGISLAILPEEDRISLLNLLVELKAQGVEIAFDSNFRPALWPQDDNQTVKNVYQAMYQLTDVAMVTFDDEQLIWGDATPEQTIERLTSLGVDKCIVKLGADGCLVQDSTNQGSSAALAPQAVPTQPVAQVVDTTSAGDSFNGGFLSAYLAGADLATSCQRGNALAGAVIQHRGAIIPKAFTQPALGVV

SEQ ID NO: 28653 - protein, 257 aa, Zea mays
  misc_feature (14)..(14): Xaa can be any naturally occurring amino acid
IRLLDPPLHEFLPXGNVEEIVRELCAETGANEEEALERVEKLAEVNPMLGFRGCRLGISYPELTEMQARAIFEAAIAMSNQGVEVFPEIMVPLVGTPQELGHQVNVIKQTAEKVFANAGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKVGLDYVSCSPFRVPIARLAAAQVLV

SEQ ID NO: 28654 - protein, 167 aa, Bacillus sp. AH 1272
FKEYIDPAVGLQGFQARRIAFNINIPKELVGQAVKFMMGLYSAFIEKDCSIAEINPLVTTGDGKVMALDAKLNFDSNALYRHKDILELRDLDEEDSKEIEASKYDLNYIPLDGNIGCMVNGAGLAMATMDIIKHYHGDPANFLDVGGGATAEKVTEAFKIILSDKNV

SEQ ID NO: 28655 - protein, 397 aa, Burkholderia pseudomallei K96243
MSQVKRLTDLIAEGKLSGKRVFIRADLNVPQDDHGNITEDTRVRASVPAIQAALDAGAAVMVTSHLGRPTEGEFKPEDSLAPVAKRLAELLGRDVPLVANWVENGVEVAPGQVVLLENCRVNKGEKKNSDELAQKMAKLCDVYVNDAFGTAHRAEATTHGIAKYAPVACAGPLLAAELDALGKALGNPKRPLVAIVAGSKVSTKLTILKSLAEKVDQLIVGGGIANTFMLAAGLAIGKSLAEADLVGEAKAIIDEARKRGASVPIPTDVVVAKEFSPTAAATVKKVADIEADDMILDIGQDTAKALAGQLEKAGTIVWNGPVGVFEFDQFGNGTKTLADAIASSAAFSIAGGGDTLAAIAKYGIHDKVSYISTGGGAFLEFLEGKKLPAVEVLETRA

SEQ ID NO: 28656 - protein, 451 aa, Thermotoga sp. RQ2
MKMERKNVWHHRKKKEIEAFSKEYIEFMSKAKTERMTVKEIKRILDESGFVPLEDFAGDPMNMTVYAVNRGKAIAAFRVVDDLKRGLNLVVAHIDSPRLDFKPNPLIEDEQIALFKTHYYGGIKKYHWLSIPLEIHGVLFKNDGTEIEIHIGDKPEDPVFTIPDLLPHLDKEDAKISEKFKGENLMLIAGTIPLSGEEKEAVKTNVLKILNEMYGITEEDFVSGEIEVVPVFSPREVGIDRSLIGAYGQDDRICAYTALRALLSANSEKSIGVIFFDKEEIGSDGNTGAKARFYLKALRQILKMQGAKDSEFVLDEVLENTSVISGDVCAAVNPPYKDVHDLHNAPKLGYGVALVKYTGARGKYSTNDAHAEFVARVRKVLNEQGVIWQVATLGKVDQGGGGTIAKFFAERGSDVIDMGPALLGMHSPFEISSKADLFETYVAYRSLMEKL

SEQ ID NO: 28657 - protein, 702 aa, Ostreococcus tauri
MRHRDLDASRSTTHAARARDRAIARAVSPAPRPSSRGVSRRAKGMRARDSRVTLGCLAISSSASGCNSHGTYPEIPGTHFKQSYCSPKTPPTSGAKNVRRGVTFASPRAKKPCLTTLTARSRDACARTVRGHARRRDPIAGSTDVGRRAGDGTPRRGHVASIETMSLARGRPSARPRGMMTSRARVEGGDGARATVVRPRASADREHGSLKKSRIGLCGLAVMGQNLALNVASKGFDISVYNRSGDKTETCVERAKKEGLGEKLRGYQDVGDFVDSLAKPRCVIILVKAGAPVDATIEKLSQFLEPGDCIIDGGNEWYENTERRAREVAEKGLLYIGMGVSGGEEGARNGPSMMPGGSREAYDIIADILKPVSAQTDSGACVTYIGPGGAGNFVKMVHNGIEYGDMQLISEAYDVLKTVGGLTNEELMAAFDDWNKAELESYLIEISSIILGKKDDQPGASGFLVDKILDKTGMKGTGKWTVQQAAELSVAAPTVASSLDARFLSGLKDERVAAEAFYAKLGLAPATAMGAADKKQLIKDVRYALYASKVMSYAQGMNLIRAKSNEQGWDLDLGEMARIWKGGCIIRAGFLDRIKSAYDRDAKLPSLLMDEQFAKEVIEREGAWRRVVTSAIAAGVAVPSMSGSLAYFDAYRRARSPANLVQGQRDFFGSHTYERTDMEGWYHTLWSDANSADSITTSGYKA

SEQ ID NO: 28658 - protein, 478 aa, Burkholderia pseudomallei K96243
MHRATKIVATIGPASSSPEVLSQMMHAGLDVVRLNFSHGSADDHRERAEMVREAARRVGREIAIMADLQGPKIRVGKFEAGKTTLTPGQPFILDATCELGNDERVGLDYKDLPRDLKPGDVLLLNDGLIVLKVDRVLGDEIHTTVKVGGDLSNNKGINRQGGGLSAPALTAKDMEDIRTAMSLGADLVAVSFPKNATDMEMARQLANIAGAPYGIKPKMIAKIERAEAIPALQEILDASDGIMVARGDLAVEVGNAAVPALQKRMIRMARESNKLVITATQMMESMIHAPVPTRAEVSDVANAVLDGTDAVMLSAETATGKYPAVTIEAMAAVCVEAEKSEHVELDKDFLDRTFTRIDQSIAMGALFTAYHLGAKAIVALTESGATALWMSRHYTHVPIFALTPRVGSERAMALFRNVTPLHVDFNSDRDSALQQALELIVRRGYVAHGDMVVLTVGEPMGQAGGTNTLKIVRVGEHY

SEQ ID NO: 28659 - protein, 288 aa, Vibrio campbellii AND4
MWQAISQQLSDTLMFEYLISEKVKLSGGDTSESYMINDGEQRYFVKINDKDFLANFEVEAESLHLIRETSTLFVPEVVLVGKTKTHSFIILNYLPTKPLEDDCNSFKMGQQLARLHLWGEQKEYGFDTDNYIGPTLQPNQWHKKWCVFFAEQRIGWQLQLLKEKGVYLVDIDDFTDVVKQLLTHHTPQPSLLHGDLWSGNVALTPAGPICYDPSCYWGDRECDLAMTEFFGGFHAHFYQGYESVAPLPVGYEQRKDIYNLYHALNHCNLFGGHYLEQAQSIIKRIMTL

SEQ ID NO: 28660 - protein, 308 aa, Mesorhizobium sp. BNC1
MKTYKLVNRDVSAPGRDSAADADGSGVEMPMIGLGVFQTPPDETTAAVEEALRLGYRHIDTAAAYGNEREVGEGIRRAGIARDEVFIETKIWISDYGYDETLHAFDKSAGKLGVDQIDLLLLHQPLPSAFDRTLGAYRALEKLLADGKVRAIGVSNFMPEHLTRLLTETSIVPAVNQIEVHPYFQQRALQRLHAEHGILTQAWSPIGGITFYRGGEKSTLEDPVLLEIAQQHGKSAAQVMLRWHLQEGRSVIPKSTKPARIAENFDVFDFELSGEQIAAIDALDTGVRSGPEPDSITLESYGRPIPEA

SEQ ID NO: 28661 - protein, 246 aa, Mesorhizobium sp. BNC1
MTENIKDKVVVITGASSGLGAETARHLVREGAKVVLGARRLDRLEALAKELSLGEEAIFKVDVTDREQVKAFVDHAVKTQGKIDVMINNAGIMPLAPLEMMRFDEWDQCIDVNIKGVLWGIAAALPFFKEQKSGQFINVSSVAGHTIGAGGAIYSATKYSVRVISEALRKEVKPYNIRTTILSPGAVDTELPGSVGAPGVSEAVAGFYHQTAIPADSFARCVLFAMSQPENVDINEILFRPTAQEL

SEQ ID NO: 28662 - protein, 93 aa, Glycine max
  misc_feature (84)..(84): Xaa can be any naturally occurring amino acid
MASGQQERSQLDRKAREGETVVPGGTGGKSLEAQQNLAEGRSRGGQTRREQMGEEGYSEMGRKGGLSTNDESGGERAAREGIDXDESKFKTKS

SEQ ID NO: 28663 - protein, 344 aa, Polaromonas sp. JS666
MSTPVPGSAGSLHSVTDNRAHSPWRLSVAPMMDWTDRHCRHFHRLLSGHALLYTEMVTTGALIHGDVARHLRFGVEEHPVALQLGGSEPAELAQCATLGEQWGYDEINLNCGCPSERVQRGSFGACLMAEPQLVADCVKAMVDVVSVPVTVKHRIGIDKGESYGFVRDFVGAVSEAGCSTFIVHARNAWLKGLSPKENREVPPLRYELVHRLKAEFPQLTIAINGGITTSTQVAEQLQQLDGVMIGREAYHNPWWLSVWDAAFYGVADAGRTRESVEAQMVDYMAREAAEHGTPWSSIARHMLGLRHGLPGARRWRQVWSNHKLKALHPRDVMALAHEAVLEAA

SEQ ID NO: 28664 - protein, 369 aa, Festuca arundinacea
MVMMVDPPNGMGNHGKHYYTMWQTMFEIDTKYVPIKPIGRGAYGIVCSSINQETNEKVAIKKINNVFDNRVDALRTLRELKLLRHLRHENVICLKDIMMPIHRRSFKDVYLVSELMDTDLHQIVKSSQPLSNDHCQYFLFQLLRGLKYLHSAGILHRDLKPGNLLVNANCDLKICDFGLARTNNTKGQFMTEYVVTRWYRAPELLLCCDNYGTSIDVWSVGCIFAEPLGRKPIFPGTECLNQLKLIVNVLGTMSDSDLEFIDNRKARNYIKSLPYTPGIPLSNMYPQAHPLAIDLLQKMLVFDPSKRISVLEALAHPYMSALYGPAANPPAQVPIDLDIDENIGVETIREMLWQEMLQYHPEAATMVNM

SEQ ID NO: 28665 - protein, 102 aa, Triticum aestivum
MERAGGRKANQLRAYSCTRNPLERAHGSARWAQGDTVVVAAVYGPRPGTRKGENPEKASIEVVWKPKTGQIGRQEKEYEMTLKRTLQSICLLTVHPNTTTSL

SEQ ID NO: 28666 - protein, 1294 aa, Saccharomyces cerevisiae
MSQQENGDVATELIENRLSFSRIPRISLHVRDLSIVASKTNTTLVNTFSMDLPSGSVMAVMGGSGSGKTTLLNVLASKISGGLTHNGSIRYVLEDTGSEPNETEPKRAHLDGQDHPIQKHVIMAYLPQQDVLSPRLTCRETLKFAADLKLNSSERTKKLMVEQLIEELGLKDCADTLVGDNSHRGLSGGEKRRLSIGTQMISNPSIMFLDEPTTGLDAYSAFLVIKTLKKLAKEDGRTFIMSIHQPRSDILFLLDQVCILSKGNVVYCDKMDNTIPYFESIGYHVPQLVNPADYFIDLSSVDSRSDKEEAATQSRLNSLIDHWHDYERTHLQLQAESYISNATEIQIQNMTTRLPFWKQVTVLTRRNFKLNFSDYVTLISTFAEPLIIGTVCGWIYYKPDKSSIGGLRTTTACLYASTILQCYLYLLFDTYRLCEQDIALYDRERAEGSVTPLAFIVARKISLFLSDDFAMTMIFVSITYFMFGLEADARKFFYQFAVVFLCQLSCSGLSMLSVAVSRDFSKASLVGNMTFTVLSMGCGFFVNAKVMPVYVRWIKYIAFTWYSFGTLMSSTFTNSYCTTDNLDECLGNQILEVYGFPRNWITVPAVVLLCWSVGYFVVGAIILYLHKIDITLQNEVKSKQKKIKKKSPTGMKPEIQLLDDVYHQKDLEAEKGKNIHITIKLEDIDLRVIFSAPFSNWKEGNFHHETKEILQSVNAIFKPGMINAIMGPSGSGKSSLLNLISGRLKSSVFAKFDTSGSIMFNDIQVSELMFKNVCSYVSQDDDHLLAALTVKETLKYAAALRLHHLTEAERMERTDNLIRSLGLKHCENNIIGNEFVKGISGGEKRRVTMGVQLLNDPPILLLDEPTSGLDSFTSATILEILEKLCREQGKTIIITIHQPRSELFKRFGNVLLLAKSGRTAFNGSPDEMIAYFTELGYNCPSFTNVADFFLDLISVNTQNEQNEISSRARVEKILSAWKANMDNESLSPTPISEKQQYSQESFFTEYSEFVRKPANLVLAYIVNVKRQFTTTRRSFDSLMARIAQIPGLGVIFALFFAPVKHNYTSISNRLGLAQESTALYFVGMLGNLACYPTERDYFYEEYNDNVYGIAPFFLAYMTLELPLSALASVLYAVFTVLACGLPRTAGNFFATVYCSFIVTCCGERLGIMTNTFFERPGFVVNCISIILSIGTQMSGLMSLGMSRVLKGFNYLNPVGYTSMIIINFAFPGNLKLTCEDGGKNSDGTCEFANGHDVLVSYGLVRNTQKYLGIIVCVAIIYRLIAFFILKAKLEWIKW

SEQ ID NO: 28667 - protein, 266 aa, Vitis vinifera
MGNTLLEALNVRVVGNGERVLVLAHGFGTDQSAWQRILPYFLPHFRIILYDLVCAGSVNPDYFDFRRYTTLDAFVDDLLNILDALGVDRCAYVGHSVSAMIGILASIRRPELFTKLVLIGASPRFLNDHDYHGGFEEGEIEKVFSAMEANYDAWVHGFAPLSVGADVPAAVREFSRTLFNMRPDITLFVSRTIFNSDLRGVLGLVKVPCCIIQTAKDVSVPTSVALYLKNHLGGRNTVEMLNVEGHLPHLSAPMLLAPVLRRALSR

SEQ ID NO: 28668 - protein, 339 aa, Vitis vinifera
MGQSSGDHNDYSSTFSDCNSDRSGEFPTTSSQGRRLLLACAADNCDDLIRQLVSDLNSCSIDEQKQAAMEIRLLAKNKPENRLKIAGAGAIKPLISLISSSDAQLQENGVTAILNLSLCDENKELIASSGAIKPLVRALKTGTSTAKENAACALLRLSQIEENKIVIGMAGAIPLLVNLLGYGSFRGKKDASTTLYSLCSVKENKIRAIQAGIMKPLVELMADFGSNMVDKAAYVLSQLVSLPEGKTSLVEEDGIPVLVEILEDGSQRQKEIAVAILLQICEDSLAYRNMVAREGAIPPLVALSQSSANRSKQKAEALIDLLRQPRSGNVAARTSDVSV

SEQ ID NO: 28669 - protein, 193 aa, Spiroplasma citri
MKGRKIMSKNNVLPIIVEIPKGSGHKYEYDLKTGRIVLDRVLYGANFYPGEYGFIENTLDWDGDPLDVISLSTYPTIPGCQINVRILGTINMIDNGEIDTKLMAVMGDDPRFNHIQTLEDVPLAIRNEIETFFLQYKTLQKKEVKINGWSGLDQALKEIKECQERYLEYKDILETKGKDAVMKIWKEKGLGQI

SEQ ID NO: 28670 - protein, 469 aa, Streptomyces viridochromogenes
MFQNADEAKKLIADEDVKFIDVRFCDLPGVMQHFTIPASAFDPAEELAFDGSSIRGFQAIHESDMAVRADLSTARVDPFRRDKTVNINFFIHDPITGEQYSRDPRNVAKKAEAYLASTGIGDTGYFGPEAEFYVFDSVRLANSATESFYHIDSEAGAWNTGALENNRGYKVRYKGGYFPVPPVDHFADLRAQISLELDRAGLQVERHDHEVGTAGQAEINYKFNTLLAAADDLQLFKYIVKNVAWQNGKTATFMPKPIFGDNGSGMHVHQSLWTGGQALFYDEAGYAGLSDTARYYMGGILKHAPSLLAFTNPTVNSYHRLVPGFEAPVNLVYSQRNRSAAMRIPITGSNPKAKRVEFRAPDSSGNPYLAFSALLLAGLDGIKNKIEPAEPIDKDLYELAPEEHAGVPQVPTSLPAVLDRLEADHEFLLAGDVFTPDLIETWIDYKRTNEIAPLQLRPHPYEYEQYYDV

SEQ ID NO: 28671 - protein, 277 aa, Oryza sativa Japonica Group
MAQPQPQRMEDQLQSQAQGQGQGQTEAIKYGHVFAVTGELAGQPIAPRDAAAMRSAEESVPGVPVPQDIGGGYSAGVAMETAAAYNQAVAAVRPGQASDAATNQGIAVTQTSVPGGRIITEFVAGQVVGQYSVADQAVEQDATKITVGEALEATALAAGERPVDRTDVEAIRAAEMAAQGSDVTMPGGLADQAQAAARSNADADRDDDKITVGDVLTDATAKLAGDKVAGAEDAAKVVQAETYSDAAARTRAGGVGAAVSTAARLNQADDDADDDAE

SEQ ID NO: 28672 - protein, 313 aa, Streptococcus pneumoniae TIGR4
MKLFALNSNQEIAQKIAQAVGVPLGKLSSRQFSDGEIQVNIEESVRGYDVYIIQSTSFPVNNHLMELLIMVDACVRASAHSINVVLPYFGYARQDRIACPREPLTAKLVANMLVKAGVDRILTLDLHAVQVQGFFDIPVDNLFTVPLFAKHYCDKGLLGSDVVVVSPKNSGVKRARSLAEYLDAPIAIIDYPQDDATRNEGYIIGDVEGKKAILIDDILNTGRTFSEASKIVEREGATEIYAVSSHGLFVEGAAELLDNTNIKEILVTDSVATKEKTPKNVCYITASELIGDAIVRIHERKPVSPLFAYNKKK

SEQ ID NO: 28673 - protein, 614 aa, 'Chlorella' ellipsoidea
ELNLDDVGYDDVGGVRKQMAQIRELVELPLRHPQLFKTIGVKPPKGILLYGPPGSGKTLIARAVANETGAFFFLINGPEIMSKLAGESESNLRKAFEEAEKNSPAIIFIDEIDSIAPKREKTQGEVERRIVSQLLTLMDGLKARSHVIVMGATNRPNSIDAALRRFGRFDREIDIGVPDEIGRLEVLRIHTKNMKLDENAELELIGRDTHGYVGADLAALCTEAALQCIREKMDVIDLEDDTIDAEILNSMAVTNDHFKTALGISNPSALRETVVEVPNVNWEDVGGLEGVKRELQEVVQYPVEHPEKFEKFGMSPSKGVLFYGPPGCGKTPLAKAIANECQANFISVKGPELLTMWFGESEANVREILDKARQSAPCVLFFDELDSIANQRGSSQGDAGGAADRVLNQMLTEMDGMNSKKTVFIIGATNRPDIIDSALLRPGRLDQLIYIPLPDDPSRNQIFKAALRKSPVAPDVDINQLVKYTNGFSGADITEICQRACKYAIRENIEKDIEREKRLADNPDSMEEDVDEVPCITRAHFEEAMKYARRSVSDADIRKYQAFAQTLQQSRGFGSDFRFPDRPGQAPATTPAGQAAAPAFASGAAADDDDDLYS

SEQ ID NO: 28674 - protein, 313 aa, Rhodococcus sp. RHA1
MALSAAARQIVDAAAARFPGSMTATPVQQLRDMLAASAIPSSTGIHGRFDVMVPSAAGGIPVRIYRPTPAPDLPVVVWLHSGGFVVGSLDQNDEYLRQLSNAARVVVVSVDYRLAPENRYPAALEDARTVWDWMKAAPDELAADVGTAVLAGESAGGNLTFALSQQLKDHGAPMPDAQISFYGTAETRVSNPECSTSMLSPQDCEWFWDQYVPRRAGRADPYVSPARARDVTSLPPTLVATAEVDPTRDATEDYARRLAAAGVSVDLQRYEGMMHGFATMTGALQPAAALFERTVQFIDRSLYARETGDSRRK

SEQ ID NO: 28675 - protein, 264 aa, Ostreococcus tauri
  misc_feature (263)..(264): Xaa can be any naturally occurring amino acid
MGAPRSPGGARASDDDARGRPSAPDELKNYEKLGRIGEGTYGVVYKARCRATNEIVALKRVRMDRERDGMPLTSLREIKILQRCAHENVISLKRVIQGETPSNVFLVFEYCEHEMARLIDFVKTKFTTSEVKSLMMQTLRAVEYLHERKVFHRDLKLSNLLLNQRGELKLCDFGLARTYDPIEAGIYTPKVVTLWYRAPELLFGEEQYTAAIDMWSCGCVFAEFLKHAPLFPASTEIELMQMICALLGNPNSNIWPGWDSLPXX

SEQ ID NO: 28676 - protein, 431 aa, Salmonella enterica subsp. enterica serovar Typhi str. CT18
MKTPRLLQYLAYPQKITGPIIEAELRDVAIGELCEIRRGWHQKQVVARAQVVGLQRERTVLSLIGNAQGLSRDVVLYPTGRALSAWVGYSVLGAVLDPTGKIVERFTPEVAPISEERVIDVAPPSYASRVGVREPLITGVRAIDGLLTCGVGQRMGIFASAGCGKTMLMHMLIEQTEADVFVIGLIGERGREVTEFVDMLRASHKKEKCVLVFATSDFPSVDRCNAAQLATTVAEYFRDQGKRVVLFIDSMTRYARALRDVALASGERPARRGYPASVFDNLPRLLERPGATSEGSITAFYTVLLESEEEADPMADEIRSILDGHLYLSRKLAGQGHYPAIDVLKSVSRVFGQVTTPTHAEQASAVRKLMTRLEELQLFIDLGEYRPGENIDNDRAMQMRDSLKAWLCQPVAQYSSFDDTLSGMNAFADQN

SEQ ID NO: 28677 - protein, 207 aa, Alternaria tenuissima
MANPRIEELPDEPEKKNVQIEEDESSDESEGEEGEVSVPAGSSVAVHSRNEKKARKAIAKLGLKHIDGITRVTLRRPKNILFVINQPDVYKSPSSNTWIIFGEAKIEDLNSQAQASAAQQLAQAEAASHDHAGHDHGDEASKGKGKAVEDKKDEEEEDDDEEIDDSGLEAKDIELVMQQASVSRKKAVKALKENDNDIVNSIMALSI

SEQ ID NO: 28678 - protein, 249 aa, Arabidopsis thaliana
MKFNVANPTTGCQKKLEIDDDQKLRAFFDKRLSQEVSGDALGEEFKGYVFKIMGGCDKQGFPMKQGVLTPGRVRLLLHRGTPCFRGHGRRTGERRRKSVRGCIVSPDLSVLNLVIVKKGVSDLPGLTDTEKPRMRGPKRASKIRKLFNLGKEDDVRKYVNTYRRTFTNKKGKKVSKAPKIQRLVTPLTLQRKRARIADKKKRIAKANSNAADYQKLLASRLKEQRDRRSESLAKKRSRLSSAPAKPVAA

SEQ ID NO: 28679 - protein, 523 aa, Haemophilus influenzae R2846
MTNIHNHKILILDFGSQYTQLIARRVREIGVYCELWAWDVTEEQIREFAPTGIILSGSPESTTEENSPRAPEYVFNAGVPVLGVCYGMQTMAMQLGGLTETSDHREFGYASVSLENSTALFANLNDNLTASEPKLDVWMSHGDKVTRLPQNFQVTGTTPTCPIAAMSDESRRFYGVQFHPEVTHTKKGLELLTNFVVNICGCETKWTAENIIEDAVARIKEQVGDDEVILGLSGGVDSSVVALLLHRAIGKNLHCVFVDNGLLRLHEGDQVMEMFGDKFGLNITRVDAESRFLGELAGVSDPEAKRKIIGKVFVDVFDDESKKLTNVKWLAQGTIYPDVIESAASKTGKAHVIKSHHNVGGLPDYMKLGLVEPLRELFKDEVRKIGLALGLPAEMINRHPFPGPGLGVRVLGEVKKEYCDLLRRADAIFIEELRNSGWYEKTSQAFSVFLPVRSVGVMGDGRKYDWVISLRAVETIDFMTAHWAHLPYDLLGKVSNRIINEVNGISRVVYDISGKPPATIEWE

SEQ ID NO: 28680 - protein, 894 aa, Coccidioides immitis RS
MMLGTQNPYTAVLPSIPSAISSTYMTLPGKGQAGSMLNREGVFSSPTESEFSEGCDGFDSVRLWDEKKVADWLHSIRCGQYEAIFKANHFNGDNLLDCDQKILQEMGIKKVGDRVRISVAVKQLRTKSVSSRKKKNRDSFVALDSSRFTPPSAESPRPSTARQQPSNSRQWPRHENGKGSPRAASPLTEHDRGLRPYRYAGASPVESARREQGGSYFSRPSDPSQSSRAAAHMRQAPSIDGLTMGALPPNSPVIRVIYTGGQTKVLNVKHCKTAEEVMLAVLRKLLLPESHFRNYCFYVLDGLDPDPANCRRISDSELLQICDGSGRSERGRLILRKLHAGEPEAEELQRAAQLAMDENQVAHMNALSTTNVRNQIKLQKLTGESWHNIRQPRSPLTATDRHRDDYPKIATAKAGDRQQSTKLRSFFGARPPSEMIIHELTSYFPSHQKEDIEKTMRLSVRRSQRLSRAASRLSVVSNISLASSLKDAPPIPSIADTWLTGAGQQPTRGSRPLSVSRFNLPQASFRDSIASSNLQPLQEESPVEPNRKSYVSFDSASEIAGGESRQGFLDESICLNAPDTGGSLNERLSIIVAEDGEEDDDGLADFLAGNNFSNKNWMKGSLIGEGSFGSVFLALHAITGELMAVKQVELPSATKGTEFDNKKTTMVNALKHEISLLQGLQHPNIVQYLGTSTDDQYLNIFLEYVPGGSIATMLKQYNTFQEPLIRNFVRQILTGLSYLHSRDIIHRDIKGANVLVDNKGQIKISDFGISKRVEASNMLSAGGSARHLHRPSLQGSVYWMAPEVVRQTAHTKKADIWSLGCLVVEMFIGAHPFPDCSQLQAIFAIGNNKARPPPPENASKEATAFLDMTFEIDHEKRPSADDLLNDPFLETMIG

SEQ ID NO: 28681 - protein, 278 aa, Oryza sativa
MEQYEKEEKIGEGTYGVVYRARDKVTNETIALKKIRLEQEDEGVPSTAIREISLLKEMHHGNIVRLHDVIHSEKRIYLVFEYLDLDLKKFMDSCPEFAKNPTLIKSYLYQILRGVAYCHSHRVLHRDLKPQNLLIDRRIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQDLATIVPTLDPAGLDLLSKMLRYEPNKRITARQALEHEYFKDLEMVQ

SEQ ID NO: 28682 - protein, 510 aa, Polaromonas sp. JS666
MQDILEQLEKKRAAARLGGGQKRIDAQHGKGKLTARERLELLLDEGTFEEWDMFVEHRCTDFGMADNKIPGDGVVTGYGMINGRLVFVFSQDFTVFGGALSEAHAEKICKVMDQAMKVGAPVIGLNDSGGARIQEGVASLGGYADVFQRNVMASGVIPQISMIMGPSAGGAVYSPAMTDFIFMVKDSSYMFVTGPEVVKTVTHEEVSAEELGGAITHTTRSGVADLAFENDVEALLMLRRLYNYLPLNNREKAPARPSADPAGRMDLSLDTLVPENPNKPYDMKELIVKTVDDGDFFEIQPEYAKNIVIGFARMEGQSVGIVANQPLVLAGCLDIKSSIKAARFVRFCDAFNIPVITFVDVPGFMPGTSQEYGGIIKHGAKLLYAYAECTVPKITVITRKAYGGAYDVMSSKHLRGDVNFAWPNAEIAVMGAKGAVEIIFREDKGDPAKLAAKEAEYKARFANPFVAGARGFIDDVILPHETRRRICRSLVMLRDKKIENPWRKHGNIPL

SEQ ID NO: 28683 - protein, 167 aa, Brassica napus
MVNYVLKITADLENLTNLQPSGGCDDPNFPYLFKLKCERCGEVTQKETCVTLNETFTPPGGRGTCHLVQKCKFCGREGNVTMIPGKGRPLTLEDSEGGEHAPLMVFDCRGYEPIDFGFGGFWKAEAESGAKFDEIDLSSGEEFTEYDEKGECPVMLSNFRASFTVTK

SEQ ID NO: 28684 - protein, 182 aa, Triticum aestivum
  misc_feature (46)..(46): Xaa can be any naturally occurring amino acid
MGLTFTKLFSRLFAKKEMRILMVGLDAAGKTTILYKLKLGEIVTTXIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 28685 - protein, 437 aa, Vitis vinifera
MQYHALSLARQASLEVDIVAYGGSTPHSAVLENPSIHIHTMKQWPTIPRIVSKIFYPLVLLFKALFQFFTLFWFLCVKIPSPDVFIVQNPPSVPTLVAVKWASWLRNSAFIVDWHNFGYTLLGLSLGRSSRFVALYHWFEKYYGKAANGSLCVTRAMQHELAQNWGIKATVLYDQPPEFFRPTPMEEKHKLFCRLHKDLCHPRGGQDCVTAGTMELWNQDTDETLFTAKMDTDIFLKSNRPALVVSSTSWTPDEDFGMLLEAAVMYDRRETNSGKQFLYPRLLFIITGKGPNKEKYEEKIRQLKLNRVAFRTMWLSAEDYPLLLGSADLGICLHTSSSGLDLPMKVVDMFGCGLPVCAVSYSCIEELVKVEKNGLLFSSSSELANELLMLFKGFPDNCDALKLLRNGVVEAGFSARWDTEWERHAKPLISKASSFLF

SEQ ID NO: 28686 - protein, 433 aa, Wigglesworthia glossinidia endosymbiont of Glossina brevipalpis
MNINEVNFDRYYIWHPYSSITKPLKTYHVVSAKKCKLKLINGKKLIDGMSSWWTVIHGYNHPKINQAIINQIKKVSHVMFGGITHSPAIKLCKKIIKLTPKGLECVFLSDSGSVSIEVALKMALHYWFSKNERKKVKFLSLRGGYHGDTFGALSVCDPKNSMHNIYQGYLPNQEFTNTFDRKFNEKWESGDDLNLVKLIEKHHKKLAAVIIEPIVQGVGGMNFYHKQYLISIKKLCKFYKILLIVDEIATGFGRTGKLFACNYSKITPDILCIGKALTGGAITLAATITKRKVSETICNKKTPEFMHGPTFMANPLSCAASCANLSLIEEGKWIQQVKFIYQEMCKYLYPLIEHSYVKDVRILGAIGVVETKFFVNLENIQNWFVRHGAWIRPFRKLIYLIPPYIISSYELKFLIKLISLSLNDDKNFLYIKN

SEQ ID NO: 28687 - protein, 397 aa, Legionella pneumophila str. Lens
MSQFPRIKRLPPYVFNTINQLKMEARARGEDIIDFGMGNPDQPTPPHIVNKLIEVAQRPDTHRYSMSKGIPRLRRAMATWYLRHYDVHLDSEKQILATIGSKEGLAHLALAISGPGDTVLVPDPAYPIHTYGFIIAGANVKQIPLIDEVQFLAAVEDAINRTWPKPKALVLNFPANPSTHCVEYEFFEKVVDLAKRNNIWIIHDLAYADIVFDGYKAPSILQVPGAIDIAIETYSMSKSYNMPGWRVGFACGNEELVAALTRIKSYLDYGTFTPIQVAAITALEGPDDCVLEIRNLYEKRRNLLCDGLNDIGWEVSKPKGTMFVWAPIPLNYRAMGSLEFSKYLLKEAQVAVSPGIGFGQQGDGYVRFGLIENKDRIRQALRNIKALFKRDGLLKAI

SEQ ID NO: 28688 - protein, 486 aa, Pseudomonas stutzeri
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDTEAEAIELANSLPYGLASAIWTENASRAHRVAGQIEAGIVWVNSWFLRDLRTAFGGSKQSGIGREGGVHSLEFYTELKNICVKL

SEQ ID NO: 28689 - protein, 202 aa, Bromus secalinus
STHGKIRIHDYVANGYVILFSHPGDFTPVCTTELAAMANYAKEFEKRGVKLLGISCDDVQSHKEWTKDIEAYKPGSKVTYPIMADPDRSAIKQLNMVDPDEKDAEGQLPSRTLHIVGPDKKVKLSFLYPSCTGRNMDEVVRAVDSLLTAAKHKVATPANWKPGECVVIAPGVSDEEAKKLFPQGFETKDLPSKKGYLRFTKV

SEQ ID NO: 28690 - protein, 172 aa, Glycine max
  misc_feature (11)..(11): Xaa can be any naturally occurring amino acid
MDHDKTGCEAXPEGPILCITNCGFFGSAATMNMCSKCHKDMMLKQEQAGLVASSIGNIMNGSSSSSGNEPAIATSVDVSVNSIEPKIIPAQPLVASGSEESDEAKPKDGPNRCSNCNKRVGLTGFNCRCGNLFCSVHRYSDKHNCPFDYHTAARDAIAKANPAVKVEKLDKI

SEQ ID NO: 28691 - protein, 421 aa, Arabidopsis thaliana
  misc_feature (238)..(238): Xaa can be any naturally occurring amino acid
MLVPNKRFHYLLQFQMWCLPSVRPNVSEMFFKSPMLKPTARFSSTSSPYLPPSFSVAPMMDWTDNHYRTLARLITKHAWLYTEMIAAETLVHQQTNLDRFLAFSPQQHPIVLQLGGSNVENLAKAAKLSDAYGYDEINLNCGCPSPKVAGHGCFGVSLMLKPKLVGEAMSAIAANTNVPVTVKCRIGVDNHDSYDELCDFIYKVSTLSPTRHFIVHSRKALLGGISPADNRRIPPLNXRYEYYYALVRDFPDLRFTINGGITSVSKVNAALKEGAHGVMVGRAAYNNPWQTLGQVDTAVYGVPSSGLTRRQVLEQYQVYGDSVLGTHGNGRPNVRDLVKPLLNLFHSENGNSLWKRRADAAFKECRSVGSLLEESLRAIPDCVLDSPISGSPESGDEDVFADVHNVLPPPYEAGEEIILCA

SEQ ID NO: 28692 - protein, 328 aa, Xanthobacter autotrophicus Py2
MAGPAAKIVPAAQPRPGRGRVYDSITETIGNTPLVRLKRLAELRGAKAEILAKLEFFNPISSVKDRIGVAMIEAMEAAGVLDQDTVLVEPTSGNTGIALAFVAAARGYRLILVMPESMSVERRKMLAILGAELVLTPANLGMKGAVARAEQLIAELPKAAMPQQFKNKANPDIHRRTTAEEIWNDTDGKVDAVVAGVGTGGTITGIGQVLKPRKASLKMIAVEPEDSPVLSGGSPGPHKIQGIGAGFVPDVLDRSIIDEVVTVGNQTAFDTARALARYEGIPGGISSGAAVAAALEIAVRDDMAGKSIVVIVPSFAERYLSTALFEGL

SEQ ID NO: 28693 - protein, 163 aa, Bordetella pertussis Tohama I
MKHVISVLMENEPGALSRVVGLFSARGYNIETLTVAPTEDATLSRLTVVTVGSDEVIEQITKHLNRLVDVVKVVDLTEGAHIERELMLIKVRAVGKEREEMKRMADIFRGRIIDVTDKSYTIELTGVQEKIQAFIEALDRSAILETVRTGVSGIGRGERILKI

SEQ ID NO: 28694 - protein, 330 aa, Arabidopsis thaliana
TSSIVVSSPISKAFRWFSQVTSCKHEYHLQCIIEWSQRSKECPICWQLFVLRDPASQELLAAVEKERLLKTRNISSSSPISIHHSHDDFHSEEEESQFSSFDEQFLRHLTEAAHRRCLLRRRDDQISSSLVSSSDPTTIHPTDLVNLYRLSAISHVEHQNSNPCPSPGSMTPSPVSGHSSIPADSNNGSRISPGPSPSRSSQSPKSPEASSLPEAIKSKLAAASAKYKESISKSKQGLKEKLLARNNSVKELSKGVQREMNAGIAGVARMIERMDFSSKRFGGSAHVSTSTATASGFNFSFKGKRVEANSKSNNNGDKTEPQKLQGGETC

SEQ ID NO: 28695 - protein, 507 aa, Pisum sativum
MAKLLALSLSFCFLLLGGCFALREQPQQNECQLERLDALEPDNRIESEGGLIETWNPNNKQFRCAGVALSRATLQRNALRRPYYSNAPQEIFIQQGNGYFGMVFPGCPETFEEPQESEQGEGRRYRDRHQKVNRFREGDIIAVPTGIVFWMYNDQDTPVIAVSLTDIRSSNNQLDQMPRRFYLAGNHEQEFLQYQHQQGGKQEQENEGNNIFSGFKRDYLEDAFNVNRHIVDRLQGRNEDEEKGAIVKVKGGLSIISPPEKQARHQRGSRQEEDEDEEKQPRHQRGSRQEEEEDEDEERQPRHQRRRGEEEEEDKKERGGSQKGKSRRQGDNGLEETVCTAKLRLNIGPSSSPDIYNPEAGRIKTVTSLDLPVLRWLKLSAEHGSLHKNANSIIYALKGRARLQVVNCNGNTVFDGELEAGRALTVPQNYAVAAKSLSDRFSYVAFKTNDRAGIARLAGTSSVINNLPLDVVAATFNLQRNEARQLKSNNPFKFLVPARESENRASA

SEQ ID NO: 28696 - protein, 338 aa, Vibrio vulnificus YJ016
MKVLVTGGCGYIGSHACVALVRAGHQPIVLDNFSNSHPNVVARIETLIGQSLVVYQGDIRDRLVLDAIFDQHEIGAVMHFAGLKAVGESVEKPLEYYDNNLTGTLNLLAAMRVAHVYRLIFSSSATVYGDPKTVPITEAAPTGATTNPYGTSKHMVERCLSDFSAANPDWSITLLRYFNPIGAHPSGLIGEDPSGIPNNLMPFITQVAIGRRERLSIFGDDYPTEDGTGVRDYIHVQDLVEGHVAALEKRGNVRGLHTYNLGTGNGVSVLQMVAAMNRVLGRELPVRIEPRRAGDIAQCFAQADKAAQELGWKAQHDLTDMVEHSWHWQQRNPNGYQS

SEQ ID NO: 28697 - protein, 248 aa, Mycoplasma genitalium G37
MGSSNLNINSKITDIFAYQVFDSRGVPTVACVVKLASGHVGEAMVPSGASTGEKEAIELRDNDPKNYFGKGVNEAVDNVNKVIAPKLIGLNAFDQLTVDQAMIKLDNTPNKAKLGANAILSVSLAVSKAAAKAQNSSLFQYISNKLIGLNTTNFVLPVPMLNVINGGAHADNYIDFQEFMIMPLGAKKMHEALKMASETFHALQNLLKKRGLNTNKGDEGGFAPNLKLAEDALDIMVEAIKLAGYKPW

SEQ ID NO: 28698 - protein, 672 aa, Psychrobacter arcticus 273-4
MIEFKDVGVRRDGRELFAGASFQLHPGHKVGLTGNNGTGKSTLFALLLTRMGTGDTEVTLDKGEVSIPDSWHVAHMAQEVGATTQTAIDYVLSGDEQWYEINATLNDLSSVSDEQIGVLHQQFDEIDGYRTPTKAAQIMAGLGFNTNQHELPVEGFSGGWRMRLNLAKTLMSRADLMLLDEPTNHLDLDAILWLETWINAFTGLVIVISHDQTFLDNTVGHILHVEQQKITLYTGNYQQFIRTRHERMAQQQQAFEKQEATKAHLDDFIRRFRAKASKAKQAQSRIKQLERMAELSPMMADNPFSFRFYEPANMSSPLIELTDADIGYSDTPLLYNANVQVTPDTRIGLLGMNGAGKSTLIKALVGELGVLTGSYNVSDTLKLGYFNQHQMDILDPKATPIEMLRRLAGKTSDAMLRSFLGSFDFRGDRIDTISELFSGGERARLTLALIVWQRPNVLVLDEPTNHLDLQMRQALTIALQGFEGAVVLVSHDRELIANVCDELFLVHDGQIDEFDGDISDYGKWLAEKRKQENSQDKNTSKKKSKKESKKFVSRETNANSAGSQAGKQVGNSESQPALSKDAQRKLAAEQRKLTAPIRRDIETTEKTLATIDEKLLVLEEKLANTDLYEESRKADLMTLLNEQTMLQQQHSQHEEKLLLAMTTLEEMEASIG

SEQ ID NO: 28699 - protein, 542 aa, Vibrio vulnificus YJ016
MMRAVKHRQLSLLFPFLKWLPKVNAQSLQADFWAGLTGAIIVLPQGIAYAMIAGLPAEFGLYTAIIPAILASLFGSSHHLISGPTAALSVIVFTTVSQFAEPSTPLYIQLCFTLTLCAGVIQLLFGLLRFGAVVNFVSHSVVLGFTAGAAIVIGVSQLKHVLGLQYNSGETAIENLLLLGSHAVHFNAKELSVGMVTIVMCVMCKRIWPKLPHMLLATLASMAFALWMNHAGYPVLMVSEVSSRSLSLSSPFAGLNHVEPMLGGIVAVAMLGLVEAISISRSVALKSRQSLDSNQEFVGQGLSNIVGSFFSCYVSSGSFTRSGVNYSSGAKTPLAAVFAALLLLVIMLLFAPYAANIPIAGMGGLLLVVAWHLVDVHHITTIVKHDKKEAVVLVATCLAALFLHLELSIYVGVGASLFFYLRKTSRPAIERLSHDELNLEQQDDIAVIRINGSIFFGCVQYLHQEMQNVSAKHLIILGRGINFIDHLGVQMLDDYVSTSGRHVYFCRFKASAKASLLNGATSVREEHFSERLTPLLTLICKG

SEQ ID NO: 28700 - protein, 489 aa, Arabidopsis thaliana
NWKPKNSRLVAYGCDLPPSPPSLPIIGHVHLLLSSLAHKSLQKLSSKYGPLLYLRVFNFPVVLVSSASVAYEIFKAHDLNISSRDNPSIDDSLLIGSSVFGSAPYGDYFKFMKKLLVTKLLGPQALERSRGIRADELERFHSSLLDKAVKKEIVEIGKEATKLSNNSLWRMSIGRSFSEKNGEAERVRGLVTELDGLTKKVLFATLLHRPLEKLGISLFKKEIMCVSDSFDEVLERVLVEHEQKLDDHQDRDMMDVLLAAYGDENAEHKISRNHIKAFFVELFFAGTDTSAQSIQWTMAEIINNPNILKRLREEIDSVVGKTRLIQETDLPKLPYLQAVVKEGLRLHPPLPLFVRTFQEGCKIGGFYVPEKTTLIGNAYVMMRDPSVWEDPEEFKPERFLSSSRSTQEEERREQALKYIPFGSGRRGCPGSSLGYIFVGTAVGMMVQCFDWSIKGDKVQMDEAGGLNLSMAHSLKCTPVPRNRPLLADQ

SEQ ID NO: 28701 - protein, 368 aa, Burkholderia pseudomallei K96243
MKTKAAIAWKAGEPLTIEEVDLEGPRAGEVLIEVKATGICHTDYYTLSGADPEGIFPAILGHEGAGVVVDVGPGVGTLKKGDHVIPLYTPECRECKFCLSRKTNLCQKIRATQGCGLMPDATSRFSVGGKPIFHYMGTSTFSNYIVVPEIAVAKVREDAPFDKICYIGCGVTTGVGAVVYSAKVEAGANVVVFGLGGIGLNVIQGARMVGADKIIGVDLNPKRVELARKFGMTHFINPNEVENVVDHIVQLTDGGADYSFECIGNVKVMRQALECTHKGWGQSFIIGVAAAGEEISTRPFQLVTGREWKGSAFGGARGRTDVPKIVDWYMEGKINIDDLITHTLPLEKINEGFELMKKGESIRSVVLY

SEQ ID NO: 28702 - protein, 125 aa, Mycoplasma genitalium G37
MNQLTKTIGSHIQIVGDDTYCTNAELAKKGVAQNTTNSILIKLNQIGSISETIQTIEVAKKANWSQVISHRSGETEDTTIADLAVAAQTGQIKTGSMSRSERIAKYNRLLYIEIELGDKGKYLGW

SEQ ID NO: 28703 - protein, 345 aa, Polaromonas sp. JS666
MDLSRFPRRRYTQGPTPLEFLPHFTEALRATCPEGSGPNIWIKRDDMLGLTPGGNKTRKLEFLAADALAQGADTLITCGAPQSNHCRATLCAAIKEGLKCRFVIEERVPNSYRENASGNNFLFRLLGVEAITVVPAGTNMMEAMQKVAADLAKEGRKGYIVPGGGSNAIGGLGYVACAQELQQQFFEQGVQIDKIVVGSGSSGTHGGLLAGFLGNHIHIPLIGIGVSRDPVDQDPLVHKEAQAVADLLGLNMTIPREAVVSYGDWWRPKYSVPNQAMVEAVQMLARTEAILLDPVYTGKIMAGLIGLARKGHFRRDENVLFIHTGGAPSLHAYEAEVLGLTELPA

SEQ ID NO: 28704 - protein, 411 aa, Vibrio sp. Ex25
MNFNLNLIREQFPALAQYHNDKPVTFFDGPGGSQVPQSVLDSMVGYLGRFNANLGGHYFSSQKTVDVMQNARESAQALLNAPSSGNIVFGANMTSLTFQLSRAISRDWQEGDEIIVSALDHYSNVSSWQQAAEDQGVIVHQVRINEDDCTLDLEHLSSLLSDKTRLVAVTYASNTTGSIVDVQRVVSMAHNVGAQVYVDAVHYAPHHLVDVQALGCDFLACSAYKFFGPHVGIAYIADQWLHSIRPYKVEPATNIGPGRFETGTQSFEGLAGVVAAVEYLAQFGEAGLPLRQRLEQSYQLYEQHEQRLSERFLQRLSALDGVNLFGIAKEDSQLRTPTFALTFDRYSPEFIAKTLGEHNICVWNGHFYALGLVRQLGLEESGGVVRIGCMHYNTIEEVDMLFDVLENILDA

SEQ ID NO: 28705 - protein, 129 aa, Saccharophagus degradans 2-40
MKYVGGCHCGEVRFEIEAPDALEVVSCNCSICNKTGFLHLILPLSRFKLLQGKQAITTYTFNTGVAKHTFCKHCGVKPFYTPRSNPDGIDINVRCLDNPPASLNITPFDGVHWEDNAAELAHLSDEAGV

SEQ ID NO: 28706 - protein, 223 aa, Xanthomonas oryzae pv. oryzae KACC10331
MQPTAIAPSILSADFARLGEEVNNVLKAGADWVHFDVMDNHYVPNLTIGSMVCQALRKHGITAPIDVHLMVEPVDRIVPDFADAGATTISFHPEASRHVHRTIQLIKSHGCQAGLVLNPATPVDILDWVLPELDLVLVMSVNPGFGGQAFIPSALDKLRAIRTKIDALGKPIRLEIDGGVKADNIGAIAAAGADTFVAGSAIFNAPDYAQVIAQMRAAVEAVR

SEQ ID NO: 28707 - protein, 693 aa, Candida albicans SC5314
MTSLQQQRVKYGPPHHIKRRPYHPILESLEFQTNQHLIQEYSLDIVNTLSQLESLTLVNPAMIDLQPEIQWFMRPFLLDFLIELHSSFKLQPTTLFLCLNIIDRYCAKRIVFKRHYQLVGCTALWIASKYEDKKSRVPTLKELTIMCRNAYDEEMFVQMEMHILSTLDWSIGHPTLEDCLQLAIDSNNLSNNTTNDIENKSVRPNRKSSISSAVTAVARFLCELSLYDKYFLSVPPSLIAITANLLSCSMLQIPHASITLKNLIEQEIINPQQKKQKKAFSSNSSRTTTASYTHQNQSDVRHSSFDEDIDLDSGDEGDDDEDYIDEFYETNNYDDTNATTFDESISKSTTVNDENQPPQIHTPFLSGLDEDSILSIKKICLMLIIQLSKVTEVLSKKYENLGVIQVINNFHSNYKFIIQSIYENQELLLNTINDSTNNNEIDYKLIQSSEILLQFPKFDEYLTEDEDENVSTDDEANSQPQGYDGSGSDGNNQLFTPKSPNAFSSNSSLTLNNHPQSMVPVTPPSATSQYSLFSNKNNRTHESTSGLNSTCNTPTHISISSFAPPQPPPGSILKPKLTSINSTNSLKIKKLTSNSNSSNINIHHGHHNTKQEKRYSHISIGSNSSSKYDGFSPIKSISTNGSLITNNGSLITNNGSFTNIVNNTNSSSPLMNQQQQQQVTQSSLYQHHHQYHQ

SEQ ID NO: 28708 - protein, 164 aa, Bacteroides fragilis NCTC 9343
MATAYHNLSDYDFNSVPNAEEMKFGIVVSEWNANITGALLDGAVKTLKKHGAKEENILVKTVPGSFELTFGANQMMENSDIDAIIIIGCVIKGDTPHFDYVCMGVTQGVAQLNATGDIPVIYGLITTNTMEQAEDRAGGKLGNKGDECAITAIKMIDFVWSLNK

SEQ ID NO: 28709 - protein, 234 aa, Oryza sativa
MGYAQLVIGPAGSGKSTYCSSLYQHCETVGRTIHMVNLDPAAEHFSYPVSTDIRELISLDDVMEELGMGPNGGLIYCMELLKLLTDPSENHRHLEDNLDDWLDEQLEGYLDDDYLVFDCPGQIELFTHVPVLRNFVEHLKRKNFNVCAVYLLDSQFVSDVTKYISGCMASLSAMIQLELPHINILSKMDLVSNKKDVEEYLNPEAQVLLSQLNRQMAPNFGKLNKSLAELVRMT

SEQ ID NO: 28710 - protein, 133 aa, Glycine max
RISSHVVTTVNRAGAGLVVPLTGLKSMAGFPTGKTNIAIPSIVGTGGGVHCMQGGPPIGRKKFGTFSYWPDLVDAQLAKEVESFLRKGWIPCLEFGWEHGFGFRGPTSLPGSFDGPLWTMWKLPMLGCTDAFK

SEQ ID NO: 28711 - protein, 355 aa, Borrelia burgdorferi B31
MKIFLTGIAGFIGFHVAKKLVEKGHEVLGIDVLNDYYELKFKHERLEALGFCSKDVKTHKIIKSEKYNNLSFAYLDILNKDKLLELFKDHKFTHVCHLAAQAGIRDSLENPDSYVSINIVGFFNVLDVCRVYKENIEHFVYASTSSVYGINENMPSSEDSITDHPLNLYAASKKSNEMMAHAYSASFNIPTTGLRFFTVYGTYGRPDMALYLFSDGIKNGKAINIFNNGNMARDFTYVGDIADGVYKVLKNPAKSDCNFDVKNPNSSTSSFPYRIYNIGTGHATKLLDFISELEANFDKKALKNYMPMQKADVVESCCDILKLKNDVGYEAKVSIKEGIKEFSQWYKMLESTKKT

SEQ ID NO: 28712 - protein, 309 aa, Wigglesworthia glossinidia endosymbiont of Glossina brevipalpis
MTNFIYNKHIISINDLSKKEMNSIIDFSFSFKLKSFNTFLKNKIIAICFLEASTRTRLSFESAIYRSGGTCIGFSDSSNTSLEKKGESFIDTISIISKYVDAIIVRHPKEGAARLASEYSNNIPVINAGDGANQHPTQTILDLFSIKETQGKLDNLNIAIIGDLKYSRTVHSLSQAISKFKKNKIYFIAHSALMLPSYIINILEEKKVEYSFHDSIEEVIKKIDILYITRIQKERLDSSEYANINAKFILKKSDLFYAKKNLKILHPLPRSNELSFEVDKTSYAYYFQQAENGLFVRQAILSSILNKKL

SEQ ID NO: 28713 - protein, 509 aa, Oryza sativa
MVQLFFQGTTDGGSVDTDAVKARRSLLGKVEPIIRSVIKSGGGYEARMWLCSTVSSIHLLDPYGQRDLFLNLLGMKNSKRDVAARLLRMIFDKKPKKAGSIIAKKCQMLQDFFQGNPKQIMQWFGHFAVTGELTHKKGARALSQFAFVNRDICWEELEWKGKHGQSPAVVATKPHYFRDLDVLQTVENFLEYVPDFWSSEELADSVKDGEILQIDTEYFVDQFVYLMYEENSRDAWQLVDEFLMDEQFSSLSQHLLIHLDEQRLLNFLRALGKLIKLNSQCKEMVFPCCWLEVLLSAHSDHISLDELVLLNCVISKGRQLWRLMNDEEQEEEQGQMQELLKSTNQLTDADHFALMKGFVDTELPDALKWIGIQSWLVFCELSKGCKSADSCEHLFTCNRIEFRKADDYPLVQNDGNSIALDSDDEDLIRGSHKRRKRDRKRKRRRYDSDEDDLDQLLELGTSNRRGIESHHGCWYLSTDGFSASWDIADIPDHLSSHYLKTWLKFACFR

SEQ ID NO: 28714 - protein, 154 aa, Wigglesworthia glossinidia endosymbiont of Glossina brevipalpis
MNTYEGKLQSKNSKIAIIISRFNSFINKNLLDGAIDSLKRIGRLKSENISIFWVPGVCEIPIIVNFLSKQNKYNGLITLGTVIQGKTFHHELISKDFNNIIFNISIKKNIPISVGVLYTRNINQAIERSGTKLGNKGSDAALSVLEMINLLKII

SEQ ID NO: 28715 - protein, 321 aa, Arabidopsis thaliana
MASRIAKDVTELIGNTPLVLNNVAEGCVGRVAAKLEMMEPCSSVKDRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAEAMTFEA

SEQ ID NO: 28716 - protein, 220 aa, Gossypium barbadense
MDADTWSVRLSSASKRYQSSLESRSNMLMGFEEIDEEDDIREEFPCPFCSEYFDIVGLCCHIDDEHPVEAKNGVCPVCALRVGVDMVAHITLQHGNIFKMQRKRKSRKGGSHSTLSLLKKELREGNLQTLLGGSSCIVSSSNSAPDPLLSLFILPMVDDFVSDQPPFRTETSRNNKSSDMNKSERTTQSSPLSVKDQEEKAKRCECVQGLLLSTIVDDIL

SEQ ID NO: 28717 - protein, 333 aa, Cryptococcus neoformans var. neoformans JEC21
MAPASHFTLNNGKKIPSIGLGTWQSEPGQVAKAVESALKSGYRHIDCAWAYGNEKEVGEGLKASGVPREEIHITSKLFELHHHPEHVELACKDTLKNLGVEYLDLYLLHWNINFQVDAPKGTVPTFDHAVKADNGKIKLDVALADNVMPTWREMEKLVEKGLVKSIGISNFNIHRTEKLLKEAKIKPVADQVELSIQCPQHELVAYLKSKDILPQGYSPLGGTGKSNLRENDVVQKIADKYKVQTANILLSWLVMRGINPVPKSVTPERIANNLKLVDLSQEDFKELEKLAESHPPKRVCDQSEDFEPKYDIFQENDPEFSDKAQFAKLGLKL

SEQ ID NO: 28718 - protein, 504 aa, Glycine max
LHDFGFDIKFGLGSSEDSQEGNSVHNISVNGNMSIGVSPSLIAGANIKGFTTISVLPPPPPSYFLGYTLPSGHPCNTFTLPPPPADKKRTGPRPCPVCYLPVDEAIALMPKFPSPSPVLKNLAFIYEETLSRDGEFGGSDFGGYPTLRQRNESFDIRESMSVHCGFVRGTKPGRNTGFDMDEDDLLEMEQCHGVVVASAIFGNFDEINEPTNISDYSKETTVCFLMFVDEQTEKYLISSGKLGISKKIGLWRTIVARNLPYPDARRTGKIPKLLLHRLVPNARYSIWLDGKLELVVDPYQILERFLWRKNATFAISKHYRRFDVFIEAEANKAAGKYDNASIDFQIEFYKNEGLTPYTEAKLPLISDVPEGCVIVREHVPISNLFTCLWFNEVDRFTSRDQISFSTVRDKILSRVDFHFNMFLDCERRNFVVQKYHRDLLLRLAPPASPPPPSPPPPLPVLETSPEKGANSPIRRGPGRRGKDRRAGSRRHRKVVAGGREMEPS

SEQ ID NO: 28719 - protein, 420 aa, Xanthobacter autotrophicus Py2
MMLPLPAPHPAVSNGSYDVLRVREDFPILDLKVNGKPLVYLDNGASAQKPRQVLDRIQQVYTSEYANVHRGLHYLANAATEAYEGGRARVQRFLNAARPEEIVFTRSATEAINLVAATFGKARIKPGDEIVLSIMEHHANIVPWHFLRESLGAVIKWAPVDEEGNFLMDEFEALLTERTKMVAITQMSNVLGTTVPVKEVVKIAHARGIPVLVDGSQGAVHLDVDVQDLDCDFYIITGHKLYGPTGIGALYGKYEHLEAMPPFNGGGEMIREVRQDTVTYGDPPHRFEAGTPAIVQAAGLGAALDYIESIGKARIRAHEAELTRYAQERLGELNSVRIIGTAKDKGAIISFEIKGAHAHDFATLIDNDGIAVRAGTHCAMPLLERFGVSATCRASFGLYNTREEVDRFVAALSKAQELIG

SEQ ID NO: 28720 - protein, 248 aa, Bordetella pertussis Tohama I
MTTAENRARLVLGNWKMHGNLAENAALLAELRAADAAAHCEMGVCVPFPYLAQTAAALQGSAIGWGAQDVSAHAKGAYTGEVAAPMLAEFGCRWVLVGHSERRTLHAESDQLVADKARAALEAGLTPVVCVGESLQEREGGNTLGVIERQLEPVLALGRDALVRMVLAYEPVWAIGTGRTASPEQAQEVHSAIRVALDGLQASQVRVLYGGSVKGANAASLFAMPDIDGGLVGGASLVAEEFLRIAAA

SEQ ID NO: 28721 - protein, 258 aa, Burkholderia pseudomallei K96243
MRLQEKVAILTGAASGIGEAVARRYLEEGARCVLVDLKPADGALARLIDAHAGRAIAVSADVTRRDDIARIVATAVERFGGVDILFNNAALFDMRPLLDESWDVFDRLFAVNVKGLFFLMQAVAQRMVEQGRGGKIVNMSSQAGRRGEALVSHYCATKAAVLSYTQSAALALARHGINVNGIAPGVVDTPMWEQVDALFARYENRPLGEKKRLVGEAVPLGRMGVPDDLTGAALFLASADADYITAQTLNVDGGNWMS

SEQ ID NO: 28722 - protein, 519 aa, Glycine max
MTSSEWRVERRQSSTNESPLSRDLEHATETGSLSIVVLGASGDLAKKKTFPALFNLYLQGFLLPDEVCIFGYARTKISDDELRNRLRGYLVPKKGASPQQLEDVEKFLQLIKYVSGSYDSEDGFRLLDKEISEHEYLKNSVEGLSRRLFYLALPPSVYPSVCKMIKTCCMNKSDLGGWTRIVVEKPFGKDLESAEQLSTQIGQLFEEPQIYRIDHYLGKELVQNMLVLRFANRLFMPLWNRDNIANVQIVFRENFGTEGRGGYFDQYGIIRDIIQNHLLQVFCLVAMEKPVSLKPEHIRDEKLKVLESVLPIKDDEVVLGQYEGYKDDPTVPDNSNTPTFATVILRVHNERWEGVPFILKAGKALNSRKADIRVQFKDVPGDIFKCQKQGRNEFVIRLQPSEAMYMKLTVKKPGLEMETVQSELDLSYRQRYQAVTIPEAYERLILDSIRGDQQHFVRRDELKASWEIFTPLLHRIDKGEFKSTPYQPGTRGPVEADKLLLEKAGYVQTHGYRWIPPTL

SEQ ID NO: 28723 - protein, 288 aa, Brassica juncea
MEGKEEDVRVGANKFPERQPIGTSAQSDKDYKEPPPAPLFEPGELSSWSFWRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVIKGFQPTPYQTLGGGANTVAPGYSKGSGLGAEIIGTFVLVYTVFSATDAKRSARDSHVPILAPLPIGFAVFLVHLATIPITGTGINPARSLGAAIIYNKDHSWDDHWIFWVGPFIGAALAALYHTIVIRAIPFKSKSKS

SEQ ID NO: 28724 - protein, 128 aa, Polaromonas sp. JS666
MAYSEKVVDHYENPRNVGSFEKGDDSVGTGMVGAPACGDVMKLQIKVNPATGVIEDARFKTYGCGSAIASSSLVTEWVKGKTLDEAASIKNSAIAEELALPPVKIHCSILAEDAIKAAVNDYKQKHAH

SEQ ID NO: 28725 - protein, 701 aa, Borrelia burgdorferi B31
MNKKIFYITILLHLPNLLFSYSTKYDIEVKMSAFVMSLAIIVISSISIGNLVAKIGIPKVIGQITAGIILSPNAFGKIQIPLLFPLGITQIGENYLINEKIFAISTIASIILLFTAGLETDLKLFIKFLPRGGIIGITEVVGTFTSFVLMASIIFNVPLISPTSLFIGIIGTPTSAGIAASILSAKKKMSTSEGVTIISTSIIDDVLSMLMLTSVITISRSISDLDIASSIKAIVQNIVIWLCLTFSLIYISETLSRLLKKLNSVTLATVITLSLALTIASIFQNLGMSFVVGAYVFGLAMSKTDIVYVIQDKLTIFERFFIPIFFTSIGLMSDINEILSKEVLILGLAISAIAIITKSIFCFIPALFLGFNKLGALKIATGMVPRGEVSLIMANVALSSGFISQKIFGIIIIMVFLPTIIATPIINFLFKINKSGLKKELPIDQNTHICVSFEYDNLAKILIWDFKNELRKEGFFTQQIKNDSSQYINARKNNISFSIKREGSKITFECPNNHLIIIQDLFRETILNLEKITKEVETVSLRAKKLDYSINYDKILSNINLNKRIKKENIILELKSSNKADVIRELLSVINIEIDKERIFQDLMEREKLITTALKEGFAIPHLKTNLISKIHIAIGISHEGIDFNALDKNLSHVFILILCPAKDYVSYPRILASVVGKVDLYKKEILNAKTDKEIYNIIVS

SEQ ID NO: 28726 - protein, 464 aa, Mycobacterium tuberculosis
  misc_feature (1)..(1): Xaa can be any naturally occurring amino acid
  misc_feature (101)..(101): Xaa can be any naturally occurring amino acid
  misc_feature (184)..(184): Xaa can be any naturally occurring amino acid
  misc_feature (297)..(297): Xaa can be any naturally occurring amino acid
  misc_feature (344)..(344): Xaa can be any naturally occurring amino acid
  misc_feature (446)..(446): Xaa can be any naturally occurring amino acid
  misc_feature (461)..(461): Xaa can be any naturally occurring amino acid
XTHYDVVVLGAGPGGYVAAIRAAQLGLSTAIVEPKYWGGVCLNVGCIPSKALLRNAELVHIFTKDAKAFGISGEVTFDYGIAYDRSRKVAEGRVAGVHFLXKKNKITEIHGYGTFADANTLLVDLNDGGTESVTFDNAIIATGSSTRLVPGTSLSANVVTYEEQILSRELPKSIIIAGAGAIGXEFGYVLKNYGVDVTIVEFLPRALPNEDADVSKEIEKQFKKLGVTILTATKVESIADGGSQVTVTVTKDGVAQELKAEKVLQAIGFAPNVEGYGLDKAGVALTDRKAIGVDDYXRTNVGHIYAIGDVNGLLQLAHVAEAQGVVAAETIAGAETLTLGDHRXLPRATFCQPNVASFGLTEQQARNEGYDVVVAKFPFTANAKAHGVGDPSGFVKLVADAKHGELLGGHLVGHDVAELLPELTLAQRWDLTASELARNVHTHPTXSEALQECFHGLVGHXINF

SEQ ID NO: 28727 - protein, 237 aa, Gossypium barbadense
LTDDHCQYFLYQLMRGLKYIHSANALHRDLKPSNLLLNANCDLKICDFGLARTTSETDFMTEYVVTRWYRAPESLLNCSEYTAAIDIWSVGCILMEIIRREPLFSGKDYVQQLGLITQLLGSPEDSDLGFLRSDNARKYVKQLPHFPKQPFAGKFPDVSPLAIDLAEKMLVFDPSKRITVEEALNHPYLSSLHEINEEPTCPSPFVFDFEQMALNEEDIKELIWRESLNFNQDKMPE

SEQ ID NO: 28728 - protein, 1280 aa, Oryza sativa Japonica Group
MDTASFVTSLLTSFVIFVVLVLVFTWLSSRPGNAPVYYPSVLLRGLDPWEGRGRGTRSPVGWLRQAISASEGDVVAAGGVDAAVYLVFLSSVLSILVFSGIVLLPVLLPVAATDDNLNLERAIGLKNGKTPQNFTELEKLALGNVQEHSRRLWAFLLSVYWVSFVTYFVLWKSYKHVSNMRAAARSTPDVKPEEFAVLVRDVPKPPPDQTIKDSVDSYFRALHPDTFYRSMVVTDHTKADKIYQEIEGHKQKIARAEVVYAESKTTGKPEGTKPTHRIGFLGLIGKKVDTIEYCNDQIKELLPKLEAEQKTTLREKQQQAAIVFFNRRSAAASASQTLHAQMFDKWTVEQAPEPRQIIWSNLSKKIYERQIRQVVVYTIVFLTVVFYMIPITAISALTTLEKLREKLPFLKVVVDQPKIKTVLQAYLPQLALIVFLALLPSLLMFLSKLEGIPSQGHTVRAAAGKYFYFIVFNVFLGVTISSTLFSALTTIINNPPGIVNMLASSLPGSATFFLTFVALKFFVGYGLELSRLVPLIIFHLKRKYLCKTEDEVRAAWAPGDLGYNTRVPNDMLIVTIVLCYSVIAPLIIPFGVAYFALGWIIVKNQVLRVYVPSYESNGRMWPHMHTRIIAALLIYQITMVGVILLKKFLYSPVLVPLIPISFIFAYICHMRFYPAFAKTPLEVVQHNVKDTPNMDAVYTSYIPACLKPEKLEDVDIFEDAQSTRGRSRAGVPTSHPLLAKHLLFHLAALRAPPLRYAVAVLSRLLPHGPLDPFPLNTVLRIAAGSPRPRVALELHRRRLALPDTHTYPPLIQACARLLALREGECLHAEAAKNGFVTLVFVQNSLVHLYGACGLFESAHKVFDEMPVRGRNLVSWNSMLNSFAANGRPNEVLTVFWEMLGVDFAPDGFTIVSVLTACAEFGALALGRRVHVYVEKVGLVENSHVSNALIDLYAKCGSVNDARRIFEEMGLGRTVVSWTSLIVGLAANGFGKEALELFSLMEREKLVPTEITMVGVLYACSHCGLVDDGFRYFDRMKEDYGISPRIEHLGCMVDLLGRAGRVEEAYDYIITMPLEPNAVVWRTLLGSCAMHKKLELGKVAWERLVELDPGHSGDYVLLSNLYAAVGMWADVHVLRKTMVKDRVRKNPGHSLVELRNSVYEFVMGDRSHPESEQIYEMLAEIAERLRREGYIPRTSNVLADIEEEEKETALNYHSERLAIAFALLKSLPGIPIRIIKNLRMCGDCHVAFNLISKVYDREIIVRDRSRFHHFQGGACSCKDYW

SEQ ID NO: 28729 - protein, 715 aa, Ralstonia metallidurans CH34
MSQAIESIPLSSTVSWQQQGDIAVLWLDNPPVNGLGDSTRAGLHAGITRALQDATVAGVVLAGAGKAFCGGADIRQFNTPAATARPLTRDVLALIESASKPVVAAIHGVALGGGLELAMGCHYRVVASDASLGLPEVNLGLVPGGGGTQRLPRLVGVEQALDMVQQGASVSGEAAARIGLADAVADARPSGTRDAGPVVALAIDFCRSAAARAVAHPVASALAVKASGDVDFGARIAAINGKARNALAQNACIRCVEAATQLPIADGLAFERAQFEALVAGNESKALRHIFFAEREAPKFAEGKGLALRPIERVAVIGSGTMGVGIAMSFVNAGIPVMLIEREQAALDRGMALIRRNYEITAAKGKLAPQQIDACMGRITPTLAFEAVADADLVVEAVFEDMAVKQAIFERLDALCKPSAILATNTSRLNIDTIAASTKRPGDVIGLHFFSPANVMKLLEVVRGQATRADVIASCMAMAQRIRKIPVLVRVCEGFVGNRMLTPYWREAGFLLEEGASPLQVDRALTQFGMAMGPLTMADLAGMDINWATRKRLAPTRPAHLRYSAVADRICELGRFGQKTNGGYYRYEPGSRTPIPDPQIDALIEECAREAGITRRPVADEEIVERCMLALINEGARILDEGIAQRASDIDVVYVHGYGFPAWRGGPMFYAETLGLAHVLARIRALQDVHGAHWEPAPLLERLVAEGRQTFDGPR

SEQ ID NO: 28730 - protein, 581 aa, Mycobacterium smegmatis str. MC2 155
MTVPKPAPGDGQTFLGPQQRAQAWEQLGNQQFDVVVIGGGVVGAGAALDAATRGLKVALVEARDFASGTSSRSSKMFHGGLRYLEQLEFGLVREALHERELSLTTLAPHLVKPLPFLFPLTNRWWERPYVAAGIFLYDQLGGAKSVPAQKHLTKAGALRLAPGLKRSSLIGGIRYYDTVVDDARHTMTVARTAAHYGAVVRSSTQVVALLREGDRVTGVRVRDSEDGSVTEVNGHVVVNATGVWTDEIQALSKQRGRFRVRASKGVHIVVPRDRIVSEVAIILRTEKSVLFVIPWGTHWIIGTTDTDWNLDLAHPAATKADIDYILGHVNTVLATPLTHDDIDGVYAGLRPLLAGESEETSKLSREHAVAVPAPGLVAIAGGKYTTYRVMAADAIDAAAEFVPTRVAPSITEKVPLMGADGYFALINQTEHVGRQYGLHPYRVRHLLDRYGSLIGEVLALADGKPELLEPITEAPVYLKVEAAYAAAAESALHLEDILARRMRISIEYPHRGVECAREVAEVVAPILGWSVEDVDREVATYAARVDAEVRSQQQPDDESADALRQAAPEARAEILEPVPLN

SEQ ID NO: 28731 - protein, 387 aa, Bacillus cereus
MEFEFFFQIALILLSTKLAGDLSVRLGQPSVLGKLIVGIVIGPAVLGWIENSELLTQLSNVGVILLMFMAGLETDLEELNANRNSSLAVALGGIILPFVGGYVSGLVMGMEQGNAVFLGLLLCATSVSISVQTLRDLGKMKTRESTTMLGAAVFDDILVVILLAFAMSFLGTDDVNLTMVILKKVVFFASIILIGWKGVPAIMRWLSPLRVSESIVSAALIICFSFAYFGELLGIAGIIGAFAAGIAISQTNYKHEVEKKVEPIAYAMFVPVFFVSIGMNITFDGIGNQIWFILALTVIAVLTKLIGCGFGARMTGFDAKSSAIIGAGMVSRGEVALIIAGTGLSSGLLAQDYFTAIVIVVILTTMITPPMLKYTFGAKDKAMKASK

SEQ ID NO: 28732 - protein, 328 aa, Wigglesworthia glossinidia endosymbiont of Glossina brevipalpis
MISLREFIFSNNVNKYISKEDLYSLFIIIELTSKIIHNYIILNNITRIKQEKIKKNIHGEHQTKLDLLSNKKFIDMIKTHYNIAGIASEEEAKFISFKQEKYGKYIFLIDPLDGSLSADCNTPVGTIFSLYCRVTPIGVEISEKDFLQPGNKQILSGYILYGSSTILVFTVKSGVHIFTYHPFFSTFFLSKKNFNYPKKNNIYSINEANYNNFSLGIKKYIMSCKSNNNISSRYTGSLVADFHRNLIKGGIYLYPNTKIYKHGKLRLMYECNPIALISSQANGSSSDGNINILDINPKILHQCSPFFVGTKSMVKLVNKFILGYYNHN

SEQ ID NO: 28733 - protein, 179 aa, Wigglesworthia glossinidia endosymbiont of Glossina brevipalpis
MNLNSVPAGEKLPNDIYAIIEIPTNSNPIKYEVDKKTGILFVNRFIPTSMFYPCNYGYINHTISLDGDPLDILVPTPYPVLHGSVIRCNPIGVLKMIDESGEDAKIIAMPHQKLLAGYNNNIKNIDDISNLMKSQISHFFEHYKDLEKKKWTKVISWEDVKSAEKEILSSFNRKKTLNI

SEQ ID NO: 28734 - protein, 318 aa, Oryza sativa
SRASSTCGHEGGFRRDGKEVKAVVSPGAAAGANSGSPILASPHPPLPRRRAEIRTREGDPEDFKEDSVGASQDVGSSDHESPLHSPVSYNPPIGCLQQKHCSGNGGGRSFSSGSSAWSSSRSVTDSDDDTGGSPENDDDGVLDDWEAVADALSVDDNHNHQDPVPADPPVVPASCPVPANAATRQEPIKSSTRAWSPDDAFRPQSLPSLSKQVSFPASMGNFWVPMGIGSAQKGVPSKPTSCPICYEDLDPTDSSFLPCPCGFHLCLFCHKRILEADGRCPACRKQYISASSGGETVGSEREMGNLRLSRSCSMGPRY

SEQ ID NO: 28735 - protein, 652 aa, Ustilago maydis 521
MASLWPFGGPSSRAQGGVLSKDAAPSYDDLRTCASATIPPLIICEGFLSAAQSVVWGNEFRTYLGVGHQQFVDQMLSRSSAQREPRDHGRKRRSGLGSDRSVIFAPIGPVSSLHDRACELFYALRGGTVDYGEQHSRQHGHSRFGRPYHQGLCPRWGLGSNTHTGLPAHFIGHSLGGPTILKLQQLLRQGFFDHALGLPSQSEWKAQDLILSITSVSSPFRGTPLVYSLGSEPLPYPKVRMFSFGDVLSKLVHIAAYLDLPFFDAHADAWHFSAKRRRAIKRSQLAGGSVVGEESTKRKAEDVQAGVAVHHLGVEQTAGVKDFLKQLWKSDWAGGRDCAPWDCTFAERDLDRASDQWGVEVNVVKRKRKTWYRSYAGGMTVADDCDQARPRFHRPETYWSLSPLTYTAHRIGHFDYSRLQPCPSFLSSADDKHSRSAMESLDSKWWANDGVVPLASQFHPFDCDRQTCRHFHGMSASLPFGTRSQRAESVIQPNETTPDSTSTRISTSNSSPTWPSGTLVNVHDDNQMCNMDRDAFESCVLPPPATHSHSKTNRSMIGSARSAIRIAYFTSLRAINLHDPPLVTPSEEELGSFLRDLARDPELGSAPSASRPAPPERQEHDRELQRHLLDPADNQWYTFEIDNLDHTSLCPF

SEQ ID NO: 28736 - protein, 105 aa, Salmonella enterica subsp. enterica serovar Paratyphi B str.
MLHLTVEQARGFYAEHDGKPFFDGLVEFMTSGPIVVSVLESENAVQRHRDLLGATNPANALAGTLRADYADSLTENGTHGSDSLESAQREIAFFFGEGEVCPRTR

SEQ ID NO: 28737 - protein, 591 aa, Vigna radiata
MSKQTYSFCFCLRRRFSLPVSEAPPEIRTLFDRYSDENGIMTASHVRGFLVEVQKEESVTEEEAQAIIDGHKHLSIFHRRGLNLESFFNYLFSSNNNPPLSPSLGVHQDMSSPLSHYFIYTGHNSYLTGNQLSSDCSDVPIIKALQKGVRVTELDIWPNESKDDVDVLHGRTLTSPVALIKCLRSIKQYAFVASEYPVVITLEDHLTPDLQAKVAEMITQTFGDILFSPGSESLKEFPSPKSLKRRIIISTKPPKEYIEAKEVQEKGEGSQKEKPVDDEEAWGKEVPSLRGGTISDHKNIEDEDDLDNEDDTDEAEYSRQNASDEYRRLIAIHAGKPKGGLTECLKVDPDTVKRLSLSELQLEKAAETHGKEIIRFTQRNILRVYPKGTRIASTNYNPLIGWMHGAQMVAFNMQGYGRSLWLMQGMFKANGGCGYVKKPDFLLKTGLNNEVFDPKARLPVKKTLKVTIYMGEGWFHDFKHTHFDQYSPPDFYARVGIAGVPYDTVMKKTKSVEDNWSPSWNEEFKFPLSVPELALLRVEVHEYDMSEKDDFGGQTCLPVWELRSGIRAVPLYSRKGEKYHNVKLLMRFEFI

SEQ ID NO: 28738 - protein, 506 aa, Oryza sativa Japonica Group
MAARVPGGGGAAAAAEAEVVPTFSSLEPIYGDGSPLDEARLRLARLADKFHAVYAARPALFARSPGRVNLIGEHIDYEGYSVLPMAIRQDMIVAIRRAEGKEVRVANVDDKYPICVYPADPDKEIDIKNHKWGHYFMCGYKGVYEYCRSKGIDMGGPVGLDVVVDGTVPTGSGLSSSAAFVCSATIAIMGVLEKNFPKKEVAQFTCQSERHIGTQSGGMDQAISIMAKPGFAELIDFNPIHATDVQLPPGGTFVIAHCLAESKKAETAATNYNNRVVECRLAAIVLAIKLGMETKKAVSSVTTLSDVEGLCVSFAGKEGSSDPGVAVKKLLHEESYTTEEIEKITGQSLTSIFQSSQTSLDVLRAAKHFKLFQRAFHVYSEARRVYAFRDTVLSKLSAEDMLQKLGDLMNESHYSCSVLYECSCPELEELVKVCRDNGALGARLTGAGWGGCAVALVKEGIVPQFILNLKETYYKSRIDRGVINQKDLGLYVFASKPSSGAAIFKL

SEQ ID NO: 28739 - protein, 591 aa, Vigna radiata
MSKQTYSFCFCLRRRFSLPVSEAPPEIRTPFDRYSDENGIMTASHVRGFLVEVQKEESVTEEEAQAIIDGHKHLSIFHRRGLNLESFFNYLFSSNNNPPLSPSLGVHQDMSSPLSHYFIYTGHNSYLTGNQLSSDCSDVPIIKALQKGVRVTELDIWPNESKDDVDVLHGRTLTSPVALIKCLRSIKQYAFVASEYPVVITLEDHLTPDLQAKVAEMITQTFGDILFSPGSESLKEFPSPKSLKRRIIISTKPPKEYIEAKEVQEKGEGSQKERPVDDEEAWGKEVPNLRGGTISDHKNIEDEDDLDNEDDTDEAEYSRQNASDEYRRLIAIHAGKPKGGLTECLKVDPDTVKRLSLSELQLEKAAETHGKEIIRFTQRNILRVYPKGTRIASTNYNPLIGWMHGAQMVAFNMQGYGRSLWLMQGMFKANGGCGYVKKPDFLLKTGLNNEVFDPKARLPVKKTLKVTIYMGEGWFQDFKHTHFDQYSPPDFYARVGIAGVPYDTVMKKTKSVEDNWSPSWNEEFKFPLSVPELALLRVEVHEYDMSEKDDFGGQTCLPVWELRSGIRAVPLYSRKGEKYHNVKLQMRFEFI

SEQ ID NO: 28740 - protein, 294 aa, Zea mays
GKAVSKFCARHLHKQVLINDANSSGDLPTSLHKAFLRMDEMMKGQRGWRELTELGDKGNKISGMIDDIIWPPKGGDSDKIREDWDTEEGPNSNFPGPTSGSTACVAVIRNDKLIVANAGDSRCVISRKGQAYNLSTDHKPDLEEERERILGAGGFVVAGRVNASLNLSRAIGDMELKQNDLLPVERQIVTAEPELKTVQLSEDDEFIVLACDGIWDCMSSQEVVDFVHKQLKTEDKISSVCEKLLNRCVAPTSGGEGCDNMTVIVVQFKKPALAVATSSAEQSATTAEGMRPKI

SEQ ID NO: 28741 - protein, 350 aa, Bifidobacterium longum NCC2705
MRKKLILDLDTGIDDALAIAYALGSADEIDLIGITATYGNVAVPLAARNALAVLHLFGRDDVPVYPGVDHPIAPATLPKMRGTTPDERAQAYARWQNGGADGWQTDASWSPTPGSVAVHHSNGIGGAIIPDSPRAPEAPGSAVDFIITAAREYGPDLTIVPTGAMTTMATVFRNAPDLKDSGVNVTLMGGALTLPGNVSPAAEANISQDPEAADYLFKCGARTTMIGLDVTHQTALTREKAHEWASLGTQAGDFLVTMTDYYIDFYLKNQPEIRGCGLHDPLAVAAALDPSLVTTFGFNLQVDLEGPFRGRTIGDRSRLQDPDKHTQVALGVDVPEFLGRFMTRVTAAAR

SEQ ID NO: 28742 - protein, 310 aa, Zea mays
MTAGQLLRTEPSAQPQRVRHSTPPAALQADIVPSYPPPESDGDESWVWSQIKAEARRDADAEPALASFLYATVLSHASLDRSLAFHLANKLCSSTLLSTLLYDLFVASLAEHPSVRAAAVADLIAARSRDPACAGFAHCLLNYKGFLAVQAHRVAHVLWAQGRRALALALQSRVAEVFAVDIHPAATVGRGILLDHATGVVVGETAVVGDNVSILHHVTLGGTGKAVGDRHPKIGDGVLIGAGATVLGNVRIGAGAKVGAGSVVLIDVPPRSTAVGNPARLIGGKKGEEVMPGESMDHTSFIQQWSDYII

SEQ ID NO: 28743 - protein, 297 aa, Oryza sativa Japonica Group
MRKREEGRTPARSAGTTTTARKGSGAGSAATGRGRWPGEPPATLDPAFPTEVLKDFLFLGSYNNASRSEVLKTLSITHILNTVPDCQNLYRNSFTYHCIQDERSLDFDGANRFLEQCERETSRVLVHCMSGKNRCDSSVVSIHVVSIVVNDRLILLWYKISRSAAIVIGYLMKSRGWRLSQSYQWVKDRRPQVQLTDASQNQLVEYEQKLFGPNVGAPAQSSVPTESFRPLGFGFPKPAGDIQAPVFNQQPVPSIFERVNPSNIPSNFTFGAMEANTPMDDNGAPAPTSGDNPMDSS

SEQ ID NO: 28744 - protein, 183 aa, Brassica napus
  misc_feature (95)..(95): Xaa can be any naturally occurring amino acid
  misc_feature (153)..(153): Xaa can be any naturally occurring amino acid
  misc_feature (162)..(162): Xaa can be any naturally occurring amino acid
MASSMLSSAAVVTSPAQATMVAPFTGLKSSAAFPVTRKANNDITSIASNGGRVSCMKVWPPVGKKKFETLSYLPDLTDVELAKEVDYLLRNKWIXPCVEFELEHGFVVPVSTGSTPGILMMDVYWTMWKASPWFGCTDSAQVLKEVKNAKRSXPNAFIRIIXIDTRQSVHQFIAYKPPSFTGA

SEQ ID NO: 28745 - protein, 462 aa, Ralstonia metallidurans CH34
MAQAPHIASRKLRDIVTSRTLDSFLAGVSRRDPNQPEFFQAVKEVMMTLWPFVERNPRYGDQALLERLVEPERVIQFRVAWTDDRGQVQVNRAFRVQHSSAIGPYKGGMRFHPTVNLSVLKFLGFEQTFKNALTTLPMGGGKGGSDFDPKGKTDAEVMRFCQALITELYRHLGPDTDVPAGDIGVGAREVGFMAGMMKKLSNQSACVFTGKGLAFGGSLMRPEATGYGTVYFAQEMLHRRGREFDGLRVLLSGSGNVAQYAAEKAIELGAKVLTVSDSGGVLHFPEGMNREQLDALMTFKNDTRGRLSDFAEQHGLRFEAGKTPWHVPADVALPCATQNELNGQDAERLLSNGVFCVAEGANMPSTLDAVDRFVAARILYAPGKASNAGGVATSGLEMSQNAMRMAWHHAEIDEKLHAIMKDIHGNCIHYGQKEDGYINYVEGANIAGFVKVADAMLAQGVI

SEQ ID NO: 28746 - protein, 309 aa, Zea mays
  misc_feature (192)..(192): Xaa can be any naturally occurring amino acid
  misc_feature (218)..(218): Xaa can be any naturally occurring amino acid
  misc_feature (226)..(226): Xaa can be any naturally occurring amino acid
  misc_feature (273)..(273): Xaa can be any naturally occurring amino acid
MALRRLLQGIVLPRTTGRHVGASFSTEAGETIRATLFPGDGIGPEIAESVKQVFNVAGVPIEWEEHYVGTEVDPRTESFLTWESLESVRRNKVGLKGPMATPIGKGHRSLNLTLRKELGLYANVRPCNSLPGYKTRYDDVNLVTIRENTEGEYSGLEHQVVRGVVESLKIITRQASLRVAEYAFHYAKANGXRERVSAIHKANIMRKTDGLFLKCCRXVAEKYPEXTYEEALLTMLHDGMFCQLKVSVSLSIVDRLLIVIFLNIISFSDTVVXNCICLQLVKNPGLFDVLMMPNLYGDIISDLCAGLIR

SEQ ID NO: 28747 - protein, 489 aa, Picea sitchensis
MSFNENLETGTRDLRRPLLHKGSWYSSSSRSVIERGGSSQIVPEAPKESAVIVVFCTLIVALGPLQYGFTNGYSSPTEDGIMSDLSLTISQFSLFGSLSNVGAMIGALVSGIMADYIGRKGALLVASIPNILGWFAISFAKSSLFLYIGRLLTGFGVGVISFTVPVYIAEIAPKHLRGSLGTINMLSITIGIFIAYLLGIFISWRHLALAGVVPCSLLVLGLFVIPEAPRWLAKIGKDSDFEASLQTLRGFDSDVSLEAFEIRSAMEANNQEDRIRLSELCQRRYAFPFTIGIGLLVLQQLTGVSGVMFYNSSIFEAAGITSANAASLGLAVVQVVMTGFIAWLMDKAGRRLLLMISSAGMAISLVLIAFAFYMKIHISAASHIASILALIGLLAYIIAFSLGMGAIPWIIMSEILPTNVKGIAGSVATLANWALSWAVTMTINLLLEWSSVGTFSLYALFTVFTFIFVVLCVPETKGKTLEEIEASYR

SEQ ID NO: 28748 - protein, 280 aa, Oryza sativa Japonica Group
MAAATVSVRFHPAASAARCGGGSRRSRRLSGVIRAQSAPASAAAAALTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGVSVKTK

SEQ ID NO: 28749 - protein, 338 aa, Physcomitrella patens subsp. patens
MAPVMQSTQQWVEKYRPRKVKDVAHQEEVVRTLTNTLETGNLPHLLFYGPPGTGKTTTALAICHQLFGPELYKTRVLELNASDDRGINVVRTKIKDFAGVAVGAGVSGYPCPPFKVLILDEADSMTEDAQNALRRTMENYSKVTRFCFICNYVSRIIEPLASRCAKFRFKPLLENVMQNRIQYICQEEGLKLDQEALSTLSRVSEGDLRRAITCLQCAVRLYGSNISSKEIISVSGIVPDSVLEGLLKACQSGQFDLAHQEVRDIIAEGHPVSQILSQLFDFVVQSPNISDIQKARITERLAETDKCLIDGADEYLQLMDVASNTMRALCNQTQECTY

SEQ ID NO: 28750 - protein, 477 aa, Nocardioides sp. JS614
MSSGLWIDGGWQESRGDRGEFAVVDPATTGVLARVVDGSVEDMAAAVDAASRTHETWAETPARERSVVLRRAWELMTERSEELARLIVLENGKALPDARSEVVYAAEFFRWFSEEAVRAHGDMRRSPSGQNWIMVTEEPIGVALLVTPWNYPAAMATRKIAPALAAGCTAVLKPAAETPLTALALAELLADAGLPDGVLNVVCTTRAGQLVEHALGDPRVRALSFTGSTEVGRKLLALAARNVVRASMELGGNAPFVVLDDADLEEAVEGLMVAKLRNGGSACTAANRIYVADRVADEFVERFTARMAGVRHGNGLDEGVELGPLVNEDTQRKVGELVDGALREGASLATGGGHDGLPGYSYRATVLTDVKPDAEILKHEIFGPVAPIVRFGEDAEAVALANDSEFGLISYLYTRDLDRGLAVSRRLRSGMVGVNRGVVSDPAAPFGGVKQSGIGREGAAEGLREFTEMKYTAIPYR

SEQ ID NO: 28751 - protein, 194 aa, Zea mays
  misc_feature (185)..(186): Xaa can be any naturally occurring amino acid
MDVDVDEATATPASASAKPASNGEAPSGAREVDVGEEYTLAGVLRSFVDGVWYPDEPLLRRLRAASCEAAPRLKGASRNSARDLLEWTRQGSGLRAILVISLKTCISRWRLETLTGLLIFMFFLLIATANAIIVSALMSLAAAGGFLAIFFACLVAVYIGAVGVAIFAISAIVISSVVGVMITTXXWVGFFWMI

SEQ ID NO: 28752 - protein, 506 aa, Carboxydothermus hydrogenoformans Z-2901
MSVLLTILDGWGIAETTYGNSIKEAGTPNFNRYWDNYPHTILEASGLAVGLPRGQMGNSEVGHLNMGAGRIVYQELTRITKEIEEGSFFQNRELLEAVNHAQKTGGNLHLMGLLSDGGVHSHIEHLFALLELCRREKFSRVFIHPFLDGRDVPPQNAREYIEALEARLKELGFGQIATVMGRYYAMDRDKRWERTEKAYRAMVFGEGFKVTEPEAAVALAYDRGETDEFVSPTVVLTSEGQPRGVVKEGDSIIFFNFRPDRARQITRAFVDDDFTGFNRKKIENLHFVCFTQYDKTIKAPVAFLPQTIENCLGEYLSKKQKKQLRIAETEKYAHVTFFFNGGVEKPYPGEERILIPSPKVATYDLKPEMSAYEVTEKLLEEMEKGYDLIVLNYANPDMVGHTGVFEAAVRAIKAVDECLGRVVDKFLSLGGTAIITADHGNAEKMLEEDGSPHTAHTTNPVPFILVGEKYRGIKLKEKGSLANVAPTILKILELEIPEEMTSEPLF

SEQ ID NO: 28753 - protein, 809 aa, Malus x domestica
MEMPGRRSNYTLLSQVPDDQAAAFYETESKNNKGKGDRGFDWETGADFRANQQPNRAGNPYSSAGLQRQSSGSSFAESSISGEYYPPTLSTAAVSEIDGFGYVPDDVFKVSGGGGEFRMKGVDGAVTATGGGGGSSSGKSWAQQTEESYQLQLALALRLSSEATCADDPNFLDPVPDESASRTSGSVDAVSHRFWVNGCLSYFDKVPDGFYLIHGIDQYVWTVCTDLQENGRIPSIESLRSVDPGIGSSIEVVLIDRRSDPSLKELQNRVLTISCTCINTKEIVDHLAKLVCSRMGGSSSVGEDEILSIWRESSDDLKDCLGSVVVPIGSLSVGLCRHRALLFKVLADTIDLPCRIAKGCQYCTRDDASSCLVRFGLDREYLVDLIANPGYLREPDSLLNGPSSISISSPLRFPRLKPVEPTIDFRLLAKQYFSDCQSLNLVFDEAPAGSAVDEDNIHPKKFDRKSTEGKNLISNLSGDTSAHAKIPRTSGHRDGPRVDTITGSRFVEGVQLVPSKPSRELGFDIEDLDIPWSELIIKERIGAGSFGTVHRADWHGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDLNPNVAAIIEACWANEPWKRPSFASIMDSLTPLIKAPVAQPSRADMPLLT

SEQ ID NO: 28754 - protein, 350 aa, Mycobacterium smegmatis str. MC2 155
MLLAHATRLGLAAIPRMSDRRKHLLLGGRSVTVDGNTLDTTMQFMLTTQRLAGLPGLVADYDPEHGVAVSRAKLRETAAMMRMPIHVDVSDISIPGPAGPLAARRYVPVERGSASALVLYFHGGGFVIGDLEVHDNLCRLICRDGDVQVVSVDYRLAPEHKAPAAAEDAYAAYQWALEHAGGLGASRIVVAGDSAGGNLAAVVSQWARDDELPLPALQVLLYPITDWVSETRSRTLFSDGYFLNRQDMDWFAGHYLDGADVTPEDPAVSPLLAEDLSGLPPALVVTAGFDPLRDEGNRYAAAMRDAGVLVDLREERSMIHAFANFFPLGGGGAAATTAMISALRAHLRHV

SEQ ID NO: 28755 - protein, 144 aa, Zea mays
  misc_feature (7)..(7): Xaa can be any naturally occurring amino acid
  misc_feature (94)..(94): Xaa can be any naturally occurring amino acid
  misc_feature (134)..(134): Xaa can be any naturally occurring amino acid
MESTFIXMIKPDGVQRGLIGEIISRFEKKGFYLKALKLVNVERSFAEKHYADLASKPFFQGLVDYIISGPVVAMVWEGKSVVTTGRKIIGATNXLASEPGTIRGDFAVDIGRNVIHGSDSIESANKEIALWFPXSSQHPWIYEK

SEQ ID NO: 28756 - protein, 827 aa, Cryptococcus neoformans var. neoformans JEC21
MAEQPAQAPAAAPVKKEKIVPPSPPLKIRDRDRGYEYMRVGFLGEGGFARVYEVQDQRASRRAVKVVSKASIKTKKNKTKLWAEIKLHQMLAHPNIVRFDDCFEDEENVYMILELCHHGSLMDLLRRRKRYTEPEARYYLVQLIAACQYMHQTNVIHRDLKLGNLFLDENMDIKVGDFGLAALIEKPGDRKKTICGTPNYIAPEVLFDTANGHSFEVDVWSVGVILYTLLIGKPPFQTKDVKAIYKRIRENRYEFPPEKEISPSAQELITLILNTNPDKRPNLDTILSHRWFLDGPFPAYIPASANDFAPDYRHISSSQSRRNFAALCHKSKIGVAQSINVEPARSRSALGPSIMQQERDFKNAVQPDSPISALLNSARQPLIQASASAIKEPSLLRKLSAAGAASTLSPVRKGAIGKENHELGRRPVAMERVGEESEEERDAEEVKPKYNGITRESELAAQKARIVSQMAAAERQVYAEAMEKASESAASGKRPVYQESRSRVAAASRGTLPLAATTGQATVSTFSAASSDTVSKSGSRYVAYESSRPEKTRDFKTSLFETFGQNLSTALVMAQTEEGFTSPSIEAKPQPPRVFVVSWLDYCTKYGMGFAMTDGTVSVHFNDSTSLVLAPGKRYFDDIRPAGADDLSQNIRRNYSIERYPSDLKNKVYLLKHFENYMLDKLFGDQPYTFENKELTTEMVFVVRYLRMKHVILFRLSNDVLQFNFYDHTKLILSREGLVVTVIDRHSVMRTWSLEELLRPLDDDLSPKDKKRIEGIVHKVQYAKDVLAKIKSHTSSSKAAAASSSVPVSANTRSAAAIEREMGRPIR

SEQ ID NO: 28757 - protein, 199 aa, Wigglesworthia glossinidia endosymbiont of Glossina brevipalpis
MLVANKFIDFTAPAILSNGEIVQNFNLSNYIKNKVSVLFFWPMNFTFVCPSELIAFDKRFFEFKNRNVKLVGVSLDTVYSHQAWRSTSTKLGGIGEVRYPMVSDIKRNIMKSYNVEHPEIGVALRASFLIDKAGIVRHQIINDLPIGRDINEMIRVIDALLFHEKHGEVCPAQWKKNREGIVPSREGISQYLSENLNDL

SEQ ID NO: 28758 - protein, 437 aa, Oryza sativa Japonica Group
MESATEKVRRTPSSCLLLRISDICKVRSVGVAPTVREKPKADGSATGESSEDGGAHLKVHPHHVSDHESVSECSSARCEEAFVERLLDAISGLKLSYVNLQQALVPYDPEEITIADERFTSELQETAGLKDLYVNMNKWRNPMYQCYVGSRIQEQQKLAVELQAGMCKRDSEIVCLRAELDELERKNMELEEKIGQSALQKEGSFAIGMGVSTDMFMELFELSTKSIHDFAKLVVRWMKLSRWNLGNLTSPIDNSVVYDKRSHKNYAVEAYFACMMLMGHKEEYLSLDVFDYVMSFSDPFDALMKAPDSCFGRFCREKYLAILPPSMEDSFFGNLDHRSFVENGGHPRTPFYQAFVTMSRYVWASLTVARSLNPRAEMFYVKGGTEFRSKHMECVPSKITKEGDKVSVGFTVMPGFKIGCTVIRCRVYLSMVNERNF

SEQ ID NO: 28759 - protein, 350 aa, Kineococcus radiotolerans SRS30216
MSPPVSPRGPVPAPGRVVAPSSPVETVRGVSAFVGRWFALIVLAAGAVALAFPPAFAGWSPAVPWLLSVIMLGMGMTMRPADFAIIGRRPWALLLGVAAQYTIMPLLGFGVAHLLGLSAVLTAGMILVGAAPGGTASNVMVYLAKGDTPLSVAMTSVSTLIAPVLTPLLVLALVGESLPVDGWAMFRSILQIVLVPVVLGLLLRLLLPRVVERCLDVLPLLSVLGITAVVLAVVAGSASTLLEVGLVLVLAVVLHNVGGLALGYAVGRATRMPVASRRAISIEVGMQNSGLAAALATVYFAPAAALPAAIFSVWHNVSGSLLATRWSRRPVPVADVSALEAQGADGSRAR

SEQ ID NO: 28760 - protein, 133 aa, Zea mays
QCQLPSSSPAALCPSPRHQGPRSPERDLAATQAMESPFRADLLRGKAALVTGGGSGIGFEIAAQLARHGAHVALMGRRREVLDKAVAALRSEGLRAVGFDGDVRKQEDAARVIAATVEHFGKLDILVNGAAGN

SEQ ID NO: 28761 - protein, 352 aa, Clostridium difficile 630
MGNKMRASVLYNVGDVRYEMVDIPEITDTQVLVNVKYVGICGSDLPRSMVSGLSGNTKYPLILGHEFSGEVVKIGEKVKHINVGDRVAVAPLVPCGKCDYCNEGNFGLCDDYNIIGTRVNGAFAEYVRVPEEHILKLPDTLDYETAAGIEPATIAYHGISKSNIRVGDSVVVLGCGPIGQFVIQWAKVFGASKIIAVDIFDEKLELSKLLGANYILNSKEVNVIKEIKKITNGGADVVIETAGSRFTQEQSLFVAKKRGNIVFVGISHTELPLSADATECILRGELTLKGSWNSYTSPYPGRAWTATLDFMEKGDIIFKPMISDKIGLNEVGDFLSKMSKREINFNKILVEI

SEQ ID NO: 28762 - protein, 483 aa, Burkholderia pseudomallei K96243
MQDISMLIGGERRPATGGATFERRNPLDGELATRAPAATAADARAAVDAASAAFAPWAALGPSARRALLLKAAAALEGKRDAFIAAMAAETGASAIWARFNVELAANGLVEAAALTTQIGGELIPSDVPGSLAMGVRQPAGVVLGIAPWNAPVILGVRALALPLACGNTVVFKGSELCPATHGLIADALHEAGLPRGVVNFVTNAPADAGAVVDAMIAHPAVRRVNFTGSTRVGRIIAERCARHLKPAVLELGGKAPFVVLDDADLDAAVAAAAFGAFANSGQICMSTERIIVDERIADAFVAKLADKAASLPLGDPRNGPVVLGSVIDAQTVERCNALIDDALAKGAVLRCGGKADSTLMPATLVDRVTPAMRLYAEESFGPVKGIVRVAGEEAAIACANDNAFGLSSAVFSRDVARAMRVAARIEAGICHVNGPTVHDEAQMPFGGMKDSGFGHFGGKAGIAEFTDLRWITVQTAPRHYPF

SEQ ID NO: 28763 - protein, 507 aa, Zea mays
  misc_feature (352)..(352): Xaa can be any naturally occurring amino acid
MDEYIYQSLFLSVLAVALLQLVKMALKPRPRLPPGPWKLPVIGSMHHLVNVLPHRALRDLADVHGPLMMLQLGQTPLVVASSKETARAVLRTHDTNFATRPKLLAGEIVGYEWVDILFAPSGDYWRKLRQLCAAEILSPKRVLSFRHIREEEVMLRVEEIRAAGPATPVNLSVMFHSITNSVVSRAAFGKKRKNAAEFLAATKAVVGLSSGFNVPDLFPTWTTVLAKLTGMTRSLKEIHKTVDTILEEIIEERKRIRDEKIKGGDAAEDVDENLVDVLIGLQEKGGFGFQLTNSIIKAIILDMFAGGTGTSGSAMEWGMSELMRNPPVMKKMQALIREAFRGKTAVTEGDLXASNLQYPKLVIKEALRLHPPAPLLVPRESIEECELDGYTIPAKSRVIINAWAIGRNPKYWDDAGEFKPERFEDGSRDFTGSSYEFLPFGSGRRMCPGFNYGLASMELAFVGLLYHFDWSLPEGVKDVDMGEAPGLGVRRRTPLMLCATPFVLVPA

SEQ ID NO: 28764 - protein, 472 aa, Mesorhizobium sp. BNC1
MEKADIGLIGLGTMGANLALNIAEKGFRIAVFNRTTERTHEFAQEAGSLAGNIVPCDTLQALVEGIKPPRPIILMVPAGSVVDEQIAALDPLVARDDIIIDAGNANFRDTRRRMLELAKTGPRFIGMGVSGGEDGARHGPSIMVGGPDESYRRIEPVLEAIAARYEGEACQAWLGPDGAGHFVKTIHNGIEYADMQMIAEIYGILRDGHGLQAGEIAPIFAQWNDGRLNSYLIEITAKVLEASDPDTGKPIVDVILDRAGQKGTGRWSAIEAQSLGIPATAIEAAVAARSLSALKAERETAEKRYGSLAAAMAGSPGADELATLEAALFAGKIVAYAQGFSVMAAASREFGWNLPLGTIARIWRAGCIIRSQFLGAIAEAFDGAPETDNLLMTEAFSQHMEAAHPRLRRVVAKSAEAGLPVPSLSAALAHFDTFRRGRGTANLIQAQRDFFGAHGFERVDSEGSHHASWKRD

SEQ ID NO: 28765 - protein, 269 aa, Psychrobacter arcticus 273-4
MQAWVIGNWKQNPATSHDVDALLNELCTAISTTKQLSHNNSTRCQIMVAPSFLHLAAVSSRLKDTSVLCAAQDVSAYSASVGAYTGDCSAQQIADVGATWTILGHSERRQYHQESNDTLLQKMTHALTQELGVVFCIGETQAQYDAKQTLPVIDSQLAVVKKLIAEQPEVIDSLSTRLIIAYEPVWAIGTGKVPTVSEVSATHQYIKQTLAGFADSLSNMTVLYGGSVNADNADSFAADPMIHGALVGGASLKAESFLAIVTAFSKGSM

SEQ ID NO: 28766 - protein, 423 aa, Picea sitchensis
MGGRHSKSLRPRRYSPSSYTPSAAWDSSSYGPSSEVPPETYSQPAAKQKLQRRYSRIADNYNSLDEVTAALAQAGLESSNLIVGIDFTKSNEWTGARSFNRRSLHHIGDTPNPYEQAISIIGRTLSAFDEDNLIPCFGFGDASTHDQHVFSFYPDDRLCNGFEEALRRYREIVPHLRLAGPTSFAPMIEGAIRIVEQSGGQYHVLLIIADGQVTRSVDIENGQLSTQEQNTVNAIVEASEYPLSIVLVGVGDGPWDMMRQFDDNIPARAFDNFQFVNFTEIMSKNVPQSRKETEFALASLMEIPSQYKATLDLQILGRRRGKMPDRFPLPPPLGNDNYAARQQYQRADSFQTNTPRNHCGDSFAGSAPPEFKDTQDAQMCPICLMNAKDLAFGCGHQTCYDCGQNIVTCPICRSDITTRIKLY

SEQ ID NO: 28767 - protein, 843 aa, Malus x domestica
  misc_feature (118)..(118): Xaa can be any naturally occurring amino acid
MEMPGRRSNYTLLSQVPDDQAAAFYETESKNNKGKGDRGFDWETGADFRANQQPNRAGNPYSSAGLQRQSSGSSFAESSISGEYYPPTLSTAAVSEIDGFGYVPDDVFKVSGGGGEFXMKGVDGAVTATGGGGGSSSGKSWAQQTEESYQLQLALALRLSSEATCADDPNFLDPVPDESASRTSGSVDAVSHRFWVNGCLSYFDKVPDGFYLIHGIDQYVWTVCTDLQENGRIPSIESLRSVDPGIGSSIEVVLIDRRSDPSLKELQNRVLTISCTCINTKEIVDHLAKLVCSRMGGSSSVGEDEILSIWRESSDDLKDCLGSVVVPIGSLSVGLCRHRALLFKVLADTIDLPCRIAKGCQYCTRDDASSCLVRFGLDREYLVDLIANPGYLREPDSLLNGPSSISISSPLRFPRLKPVEPTIDFRLLAKQYFSDCQSLNLVFDEAPAGSAVDEDNIHPKKFDRKSTEGKNLISNLSGDTSAHAKIPRTSGDDRNPQLFNPLQNILHTPPMVNDPIPLKCMPPVGHRDGPRVDTITDSRFVEGVQLVPSKPSRELGFDIEDLDIPWSELIIKERIGAGSFGTVHRADWHGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDLNPNVAAIIEACWANEPWKRPSFASIMDSLTPLIKAPVAQPSRADMPLLT

SEQ ID NO: 28768 - protein, 360 aa, Carboxydothermus hydrogenoformans Z-2901
MDKFAFIIHPLEAKDVAKKFGFAKYLPDRLIEWGLKKLPAFKASHITGVKSPYNEVEGYFITCPLTTRQMVELPEEFVLGKIIEAGKVAEKLGAKIVGLGAFTSVVGDAGITVAKNLNIAVTTGNSYTVATALEGTKKAAAIMGHDLKKANVVVIGAAGSIGKVAARFMAKEVKNLTLVGRNLAKLEPVADLILKESGLAVAITDNVKKSLKEADIVITVTSSVDTIIEPEDLKPGAVVCDVSRPRDVSKEVAKLRDDVLVIEGGVVEVPGDVEFNLNFGFPPKTSYACMAETMILTLEGRFENFSLGRDMELEKVEEISRLAQKHGFKVGGFRSFERAISSEEIEKIRKNALKKSVFAT

SEQ ID NO: 28769 - protein, 327 aa, Polaromonas sp. JS666
MSHPDSPAGAAEPVAITATEAPAEVVCVASWNADLVSHVARPIARGETLMASAFSISPGGKGSNAAVAAARQGARVALIARIGDDDFGRMGMTLWHAEGVATDHVEHAAGECSGVAQILVYDDGDNSIAVCPGAGSGLGASQVQAAHGVLRSCRVVMASCEVPVEATLQAFRLAREAGAITLLNPAPARPLPEELLALVDVLTPNESELYQLAGAEHSGSLDAAANHLLAGGTGAVLVTLGAAGCRLYQGRQTPIGLAGRSMPVLDTIGAGDTFTGTLAAALARGEPLASAMQWANAAAALSVTRRGAIDGIPARADVAALMSQVAR

SEQ ID NO: 28770 - protein, 330 aa, Oryza sativa Japonica Group
MAEAAAAPPAAAATNYEVDLGNLMAYDPSHHLPAASSSREELREECLRKGTELAQAVADALFALPATEDRDGPMVRLPPPTTRFPREKHLPRPKPPTKWEQFAKMKGITKHKKNKREWDEQTQTWKRTYGYDRVNDDKDIPIIEAKATDEPGVDPFAQRREDKKKHVEKQEKNRLENLKKAAKVGALPSHIQLAATALPITGTKADIPKKSRKKDLEDVAGMASSATASGGKFDEKLPGEKPPKNPGKHRKFLPVVEGKGMGNQEKQQNDKILNALLAKSSEDQMDVGRAITMYKVKKEKQRRKDKEKSSSSNKLKPQKKTLKKSSKKKA

SEQ ID NO: 28771 - protein, 843 aa, Malus x domestica
MEMPGRRSNYTLLSQVPDDQAAAFYETESKNNKGKGDRGFDWETGADFRANQQPNRAGNPYSSAGLQRQSSGSSFAESSISGEYYPPTLSTAAVSEIDGFGYVPDDVFKVSGGGGEFRMKGVDGAVTATGGGGGSSSGKSWAQQTEESYQLQLALALRLSSEATCADDPNFLDPVPDESASRTSGSVDAVSHRFWVNGCLSYFDKVPDGFYLIHGIDQYVWTVCTDLQENGRIPSIESLRSVDPGIGSSIEVVLIDRRSDPSLKELQNRVLTISCTCINTKEIVDHLAKLVCSRMGGSSSVGEDEILSIWRESSDDLKDCLGSVVVPIGSLSVGLCRHRALLFKVLADTIDLPCRIAKGCQYCTRDDASSCLVRFGLDREYLVDLIANPGYLREPDSLLNGPSSISISSPLRFPRLKPVEPTIDFRLLAKQYFSDCQSLNLVFDEAPAGSAVDEDNIHPKKFDRKSTEGKNLISNLSGDTSAHAKIPRTSGDDRNPQLFNPLQNILHTPPMVNDPIPLKCMPPVGHRDGPRVDTITGSRFVEGVQLVPSKPSRELGFDIEDLDIPWSELIIKERIGAGSFGTVHRADWHGSDVAVKILMEQDFHAERFKEFLSEVTIMKRLRHPNIVLFMGAVTKPPNLSIVTEYLSRGSLYRLLHKAGAREALDERRRLSMAYDVAKGMNYLHRRKPPIVHRDLKSPNLLVDKKYTVKVCDFGLSRLKANTFLSSKSAAGTPEWMAPEVLRDEPSNEKSDIYSFGVILWELATMQQPWGNLNPAQVVAAVGFKNKRLEIPRDLNPNVAAIIEACWANEPWKRPSFASIMDSLTPLIKAPVAQPSRADMPLLT

SEQ ID NO: 28772 - protein, 336 aa, Deinococcus radiodurans R1
MTTGLPAVGAKEQEMTNADEQNMGQQEGTDTATTAQDTNTQTVGTQSENTQNTQQASDAQTEQTPAELRDVLPQLTGEVDEDDVLDAQEEQAAGQSARKVDEDGEEYEEEFIDADDLMGLLGEMKEMLEAQSKEIRGLRREMRELRESQGGGFRGGDRGGDRGGFRPREDRGGFGGDRDRGGFRPREDRGERSFGGDRGGDRGGFRPREDRGGFGGDRDRGGFRPREDRGERSFGGDRGGDRGGQGGFRPREDRGGFGDRDRGGFRPREDRGERNFGGDRGGDRGGQGGFRPREDRNFGDREFRPRTDDAQGNQEGGFRPRARADRGWANRRTDEE

SEQ ID NO: 28773 - protein, 346 aa, Picea sitchensis
MFKGRLQEYTQKNSFPLPVYDTVNEGQDHIPRFKCTVTVNGARYDSPPGFNHKKPAQNAAAEAAVKKLVNQGLLPIEEVILPKKPKNVLEDIALKKNMPPPSYKFSKEGEAHCPTFTAIVEINGAFYAGDPANSKKDATNKAACKAIRAIDPHYFQAESIINNGSEHPTEECDVSKSDSKIPADNWTSNNQIVGGSDSHLPANCIEKVTVENAPAVEKVSEKRNVENPCGAGEDPENSKVKNAFGAEKSIPNINHASSVPAKHPQQDPLLARQGQLKEEIADAHPDKQHGSQEVEGKQQGSQEVDLTVSISKRSISESENAEQMSERKKKHKRNTKVKRMKKQSTD

SEQ ID NO: 28774 - protein, 513 aa, Carboxydothermus hydrogenoformans Z-2901
MENKLQELNRKRQESLLGGGEKRIKRQHEAGKLTARERINLLLDPGSFVELDMFVRGEQGEFAKSDMENYGEGVVTGFGTINGRTVYLFSQDFTVYGGSLGELHSAKICKVMDLAMKAGVPFIGLNDSGGARIQEGVYSLSAYGNIFYRNTLASGVIPQISVIMGPCAGGAVYSPAITDFIFMVDKTSQMFITGPQVIKSVTGEEVSPEELGGAMTHNHISGVAHFVGENEEITLSMVRKLLEYLPQNNMEEPPVKAPLPPKYSTEELLDIVPEDPNRQYDVREVILRIVDDSEFFEVHKYFAENAVVGFARLSGRVVGIVANQPKYLAGTLDINASDKIARFVRFCDCFNIPLLTFVDVPGFLPGINQEYGGIIRHGAKILYAYSEATVPKLTVILRKAYGGAYVAMCSRSLGADAAFAWPTAEIAVMGPDGAANIIFRDEIAQAEDPAKVRAEKTAMYREKFCNPYVAAAKGMIDDVIDPRETRDRLIKALLAVSTKRESRPMKKHGNIPF

SEQ ID NO: 28775 - protein, 506 aa, Ralstonia metallidurans CH34
MRYAHPGTPGAIVSYKPRYGNFIGGEFVPPVKGQYFTNTTPVTGEAIAEFPRSTAEDINLALDAAHAAAGAWGRTAVQDRSLILLKIADRIEQNLELLAVTETWDNGKPVRETLNADIPLAVDHFRYFAGCIRAQEGSAAELNEHTVAYHIHEPLGVVGQIIPWNFPLLMAAWKLAPALAAGNCIVLKPAEQTPLGINVLMELIGDLLPPGVLNVVHGFGKEAGEALATSKRIAKIAFTGSTPVGSHILKCAAENIIPSTVELGGKSPNIYFEDIMQAEPSFIEKAAEGLVLGFFNQGEVCTCPSRALVQESIYNRFMDAVMTKVAAIKRGDPLDTETMVGAQASEQQYNKIRGYLEIAREEGAECLVGGDVEVMPGSLAKGYYIKPTLLKGRNDMRVFQEEIFGPVIAVTTFKDEAEAVRIANDTEYGLGAGLWTRDINRAYRVGRAIQAGRVWTNCYHLYPAHAAFGGYKKSGVGRETHKMMLDHYQQTKNLLVSYDTQPLGFF

SEQ ID NO: 28776 - protein, 456 aa, Picea sitchensis
MAAKSLDLHTVCRGFEPLNGGTAFRFNPLQSFKFTDSISVQRIFPSHNKAVGRQIICSVSTPSDFARDNVISIVKRPWETADARLVLEDGSIWKAKSFGAKGTQVGEVVFNTSLTGYQEILTDPSYAGQFVLMTNPHIGNTGVNIDDEESNQCFLGGLVIRNLSTCVSNWRSAETLPEYLRKRNVMGIHDVDTRAITRRLREDGSLIGVISTESSKSDDELLNMARSWDIVGMDLISGVTCSEPYEWKDATSAEWDFNSHGKASDKLHVVAYDFGIKHNILRRIASYGCKITVVPSTWPSSEVLKLNPDGVLFSNGPGDPSAVPYAVENVKQVVGKIPVFGICMGHQLLGQALGGKTFKMKFGHHGGNHPVRNLRSGRVEISAQNHNYAVDPATLPEGVEVTHINLNDGTCAGLAFPEMKVMSLQYHPEASPGPHDSDPAFYEFVKLMRENKHIDK

SEQ ID NO: 28777 - protein, 195 aa, Zea mays
MPVTWRRQKWVRSRCGLIGAAAGDYTGRPMASECRQRMAPEDIRWDGEEPDLNLIGRGAPVHGMKSSSRGGPMSGTGRDRGPQKNSFKKDYPSQNGIGKKSVDYIEILHTETLIKEVERVFSSANPDPLEMERAKKALKEHEQSLIDAIARLAEASDDDRVRSLEYNRGWRNQHGGRYADDMTMDGHMAGDADAM

SEQ ID NO: 28778 - protein, 456 aa, Solibacter usitatus Ellin6076
MATQFDAIVIGTGQAGPSLARRLAATGRKVAVIERKLFGGTCVNTGCIPTKTMVASAYAAQMVRRAAEFGVDVPAPTIDMKRVKARKDAVSAASRVGLENSLKHLENCTVYEGHARFESPVEISVGADRLSAPWMFINVGGRAIVPAMPGVDAIDHLTNSSMMAVDFLPKHLIVVGGSYIGLEFGQMFRRFGSRVTILEMSPRLVHREDEDVSIAMREILEREGIEVRLNAKCIAFSRSGNDLIAHAECAEGSPDIAGSHVLLAVGRRPNTDDLGLEKAGVAVDGHGYITVDDELRTNVPGIWAMGDCNGKGAFTHTSYNDYEIVAANLLDNDPRRVSDRIACYALYTDPPLGRAGMTEAEARKTGRPLLIGKRPMTRVARAVEKGEQQGFMKVVIDKESKKILGAAILGTGGDEVVHSILDIMYAKAPYTVIQRAVHIHPTVSELIPTLLGELEG

SEQ ID NO: 28779 - protein, 204 aa, Deinococcus radiodurans R1
MAGPDLTLLLVRHGATAWNEGGQWQGWTDNPLGDAGRAQARALREELAGQTFDAVYSSDLTRARQTAELALPGRALRLDARLRELNLGDYEGHTLAQMQAHGGYAGWQADPWAQAVPGGESLQDVAARMRGWLTDVQAEFPGGRVIAFSHSIALRTLARDLLGLPLEPQVNYPIPYAERIKNGRCMVLECRGGTWRRAGANAAS

SEQ ID NO: 28780 - protein, 471 aa, Legionella pneumophila str. Lens
MNKGMNAFVFLIAVIAGFGGFLFGFDSSVIADVKDQVISQLALTDWQWAQVVSSSLLGCILGIPISGLVADKLSRRSLLKVVALGFMLGSSLCALAPGLVSILLGRFIIGICIGIASYIAPLFIAEIAPPHQRGTLVLINGLTITFGQAVAYLIGYFLHDYSLMSWRYLFWIGSLPALVLFSGMYFVPHSPRWIMMKYGADATLKTLKQIRPVGYNIQQELTEISNNLVNPAPAYIQMFKKPIVFVLLLGIGLGLFQQFSGINALMYYGPVVFESFGFSPVKNAILATFFLGLVNFIFTVVTLFYVDKLGRRFLLISGTLIASISLYFVSVLSCNSLFVNKFWILGGLSFYVMGYCISLGSLFWVLISEIYPLSVRGLAMSIATVFQWGANFVVSLLFLPIYQFSGQTVTFAMFATFCLLACWFIYYFVPETTSVSLEKLEENLSSGKKVRDIGQPVSKNIKIAKFNLIMD

SEQ ID NO: 28781 - protein, 185 aa, Streptococcus suis 89/1591
MTQKPIIIGVTGGSGGGKTSVSRAILDNFPNARISMIEHDSYYKNQSHLTFEERILTNYDHPLAFDTDLMIYHISELLAGRSVDIPIYDYTQHTRSEKTYRQEPQDVFIVEGILVLEDKRLRDLMDIKIFVDTDDDIRIIRRIKRDMEERGRSLDSIIEQYTSVVKPHVSPVYRANQALCRYRHS

SEQ ID NO: 28782 - protein, 129 aa, Glycine max
  misc_feature (52)..(52): Xaa can be any naturally occurring amino acid
LGELARFWKGGCFIRAVFLARIKKAYQRTPILASLIVAPEFPREMVQNQLSXKRFLGLPFSPGISPPGMCASLAFFDPYRRARLPATFVQAQRDFFGAHPYKRVVPPGAFHPEWAKLPPNSGAGVGAPN

SEQ ID NO: 28783 - protein, 369 aa, Nanoarchaeum equitans Kin4-M
MDEKEIEEILEENKRLKSMVNYLQKELEKFRSPPLVVAEVIKPYGERAIVRLPTGMELLVEKLSKIEIEPGDTVFLNQSNMVIVGKAEKRKKFNIDAFVITEKPNVDWSQIGGLKEQIEEIREAIELPLTKPEIFEKIGIEPPKGVLLYGPPGTGKTLIGKALAKSANATFIYIVGSELVQKYIGEGAKLVKELFDYAREHAPAIVFIDEIDAIAARRIETGTSGEREVQRTFMQLLAEIDGFKPLDKVKVIGATNRLDILDPAILRPGRFDRIIHIPLPDKQGRIEIFKIHTRKMRTKDIDYSLLAELTEGFSGAEIKQVCIEAGYLAIRNKRDYVILEDFIKAIDKVKKMRKKEEYQRFLKGLSYFG

SEQ ID NO: 28784 - protein, 288 aa, Burkholderia pseudomallei K96243
MSRTDAIATPHDVTPQPSGELDADRARRFGGVARLYGADALAAFERARVAVIGIGGVGSWAAEALARSAVGELTLIDLDNVAESNTNRQIHALDGNYGKPKVDAMAERIALIDPACRVVKIEDFVEPDNLDALLGGGFDYIVDAIDSVRTKVALIAWCVARAQPLVTVGGAGGQLDPTRIRIDDLAQTIQDPLLSKVRAQLRKQHGFPRGPKARFKVSAVYSDEPLIYPEAAVCDVDDVAMHTATDAQAPGPTGLNCAGFGSSVCVTASFGFAAAAHALRALAARAGR

SEQ ID NO: 28785 - protein, 337 aa, Beta vulgaris
MAKIKIGINGFGRIGRLVARVILQRDDVELVAVNDPFITTDYMTYMFKYDSVHGQWKHHELKVKDEKTLLFGEKPVSVFGCRNPEEIPWSQTGADFVVESTGVFTDKDKAAAHLKGGAKKVVISAPSKDAPMFVVGVNEHEYKSDLHIVSNASCTTNCLAPLAKVINDKFGIVEGLMTTVHSITATQKTVDGPSAKDWRGGRAASFNIIPSSTGAAKAVGKVLPALNGKLTGMAFRVPTVDVSVVDLTVRLEKAATYEDIKAAIKAESEGKMKGILGYTEDDVVSTDFIGDNRSSIFDAKAGIALNDHFAKLVSWYDNEWGYSSRVVDLIVHMSKTE

SEQ ID NO: 28786 - protein, 1931 aa, Ustilago maydis 521
MQPPKSSSGDIKCSVLERHFAKVVPLLTLIREQFGVELGASSSKNPPNGLSFERWKLLNITLVGIDSLIAAQTPPHRSSQWLSQSGPCTTIHEAVQEAQLQILAKTSTQTSAVARRRYDASNNVLLKGYRRPDDRLESFRITSTGRPGLINLYPNSMVTCLVLNKEWHYLCESIGTERFVWLLVNTSIFVPLLRHGADGTCFVQLTGAALSERTANLGAAANRAQQAGAKRKHGEAGEPTSTTRQRVVIGQAVGAIQTSKPLLTGKRPRKLDRVTSRISARSTSSAPELDIARSQTAASSSVDRKPSEIILVRSRMLYARASRNKNGRVEVGLPSVHVIPRSAIRKELDKVLPSSTAPNKPTARSKPLTRNCIANSKQDVKSPEALFHQRRTRHLAKYVFPRHFGLHNVFTGARDYDTTTQPFRDYTVREVEIKALGAVRTPKALRPVLKVLAKILARHDKINYRALLDRCCPSRVPKGRLTAQERQQIVQDLAEVESLEPTQCQDVPVKPTRKESGCAATSTIQTKVIQVPSDAAPVKAPAKATIELASPALRKPRYTNYAVPTVGQVVHFVTMTIKSLLPRDLFGSLHNQTLLLDTIADFVRLRRYETFNLHQIAQSFRFTDVDWALPAGAVKANRRLTRQEAESRKALVFELLYWLFDGLVIPLLRTTFYITETAAYRNKVLYFRQDDWHVLSRPVLGQLKETIFEPLTRAEALSMMSSRKLGYSHVRLLPKETGVRPIVNLRRRSTKQVHTYQQASQDAAGAKTKKLKLSAALAKQKRESLILGQSINYILQSVFHVLTYEKSRMLTDAGDEDGGGAWRGVDGVGADMLSSSVFGPNEIYARLKMFKQKLLQDRSRAGGVRGKGKLYFVKVDVRCAFDSIDQSKLLEIIEKILCKDGADHDSEGYRIHRFAKVMASATHETRSSSACAGVAPVGKATKRAFVQLARPDSEHIDFFSLASTLAVALHDVVFVDGVSYRYESTSVILKLLRQHITENLIKIGREFYRQRVGIPQGSSLSTLLCSFFYAEMGARDAFLSTLGSENAGAKQRSLLMRYTDDFLLVTTSKKTAKKFYEVMRKGHPDYGCFISAEKTLTNFDLIDSNSTSSPLVARIYKDEFPWCGLTINTRTLGVSTDLTRYAGLDIRDTLTVEYCRRPGAALVEKMIQSVKARCHILFTDTALNGDTRVYGSIYSSFLVAAFKFTAYLAELRRFKRQFTPEFLWKAIQRLVRFTSRYIGSRASSAKFKRQAMNKRQNSARRAPAGRGAGRGRGRGTGRSRGASAAWKVSCTIRPHYVHWLGYSAFRMVLLRQAGARTKHVGMFRRLDRDTRESLIVADGVCTCGHGVMVRSNVDTARAQSPSSAALTNASAREQDGARQHMVANGKRSEKAPSNRDDADAGSPEAKKQKTNESYARTVHDQGGDDETLSSTCHAPNALWSEPSQAHAPQPPLTSASSASSASSSQQTTEQPYERAPTWAALRRSNHPAIAPSRSIYSYERLNHIQEGTYGVVFRARPRAPLPASNTSHKLASSSSAASNPTHSDDSSSTVAPLQVAVKRLKLPPGGLSPSGFPITSLREIQTLALSRNNPFVISLREVCVGKTLDQIFLILEFMEHDLKTLLTSLHKSRSAFAPSEVKTLMHQLLSGVAGLHEGWVVHRDLKSSNLLMDNRGRLKLGDFGLARRFGDPIDAWVPRTQPISRGASDSKADNEKERLESGEQIGGMTDLVCTLWYRAPELIMLNIIHQARETWKDNVRAPSSASSSSLFKLHSKPYALREPLPLYDAKIDMWSIGCIFAELLLANQTGSVLFQGKDEPDQLRKIEQVLGKPNTTIWPDILLWQGLPHLHRPSAKASAAAVQQEQDRIKANLQTAFTSKLTPATLDLLFQLLHWDPSQRISARDALKHKYFTDENPKMAHPDSFGSFPSCCIIP

SEQ ID NO: 28787 - protein, 591 aa, Nanoarchaeum equitans Kin4-M
MVMILIIGFGRLGQYFYNYLKRKGLNVKVYSRSIKEIEENEFSKFKYAILAIPENSYNEILSKLKENNFNGVIIDLASKKDVVIPIIEQYGFKFLSLHPLFGPSIYEEFSKIVVIKESTDKSFLQFLDFDLIEMSLEEHEKINELQVVTHLLLISYYHFARRFPIKTASAEALYRLSERLLEQNPQILLDIQKEKNAKTYRENYIKFLKEVSNNIEDYIPKERVEGFSRALLLNLSKLWNKDIRKQIMVIDKLILDLIKIRNDLAKQIKEIKELRNLPIEDKKWEIEKRNILLEFAKERELNPLYTDQLIELLISWAKHIENPKPWIGVLGPIGSFSDEVALKLNKTRLNIKYYRKISHIFDALENNEIALGIVPIENVLGGSVNETLDSLIKYNVKIVGEYIHRINLCLVGKNVKEVKRIISHPQAIAQSMEYISKKFPNAEIVYSNSTSEAISMLDEYSLAITSKTAAIFYGLKIYDEHIEDNKENKTRFIIIGKKQLPNPKYSALVFSLEDKPGSLKEVLEIFHKHNINLRKLESRPDKREIGKYLFYVESDLLNNKILEEIRAKANWVKHLGNFREINEIEFPKILD

SEQ ID NO: 28788 - protein, 225 aa, Mycobacterium smegmatis str. MC2 155
MAEPLIAPSILAADFARLADEVAAVGDADWLHVDVMDNHFVPNLTLGLPVVESLLKVTDTPMDCHLMIENPERWAPGYAEAGAYNVTFHAEATDNPIAVARDIRAAGAKAGLSVKPGTPLEPYLEILREFDTLLVMSVEPGFGGQKFIPEVLAKVATARRLVDSGELTVVVEIDGGINADTIEQAAEAGVDCFVAGSAVYSAEDPAAAVEALRRQAAGASKHLSL

SEQ ID NO: 28789 - protein, 364 aa, Moraxella catarrhalis
MTNTGTTDMKNIDTSPSNSEHYLPKKILVTGGAGYIGSHTLIELIQAGFVPVVYDNLSNSSFVAVQRVEQIVGKHIEFIQGDVLDKTHLDAVFKAHQFFAVVHFAGLKAVGESTKNPLKYYQNNVVGTLSLLELMAKYGVKNCIFSSSATVYGSSNRLPITEDMPRFCTSPYGQSKLMVEHILEDLVNADDTWNVVCLRYFNPIGAHESGRIGEDPTDIPNNLMPYISQVAVGNLKQLSVFGNDYETPDGTGVRDYIHVVDLAKGHVAALHYLVGQSVGIGFCPINLGTGQGTSVLQLIKAFESNTGQSVPYVITSRRTGDIAAYYASADKAKAILNWTAELDIERMCVDTWRWQSNNPKGYLS

SEQ ID NO: 28790 - protein, 218 aa, Wigglesworthia glossinidia endosymbiont of Glossina brevipalpis
MIEEKLKKQAAWAAIKYIKPGDIVGVGSGSTAEYFIDALGSIKNLIKGTVSSSRISSSKLKDLNIPLFDLNEVSLLNIYVDGADEINQKKHMIKGKGAALTREKIIASAAKKFICIVDSSKFVHVLGRAPLPIEVIPMARTLVSKKIIDIGGSPKYRKGIITENGNVLLDVHNLIILDSLFLEEKINNIPGVVSVGLFAHRAADIAIISGKNGIKIID

SEQ ID NO: 28791 - protein, 314 aa, Capsicum annuum
MGSKYSKATNSINDALNSSYLVPFESYRFPLVDLEEATNNFDGKGGFGKVYRGVLRDGTKVALKRHNRDSGQSIEPFRTEIEILSRRSHPHLVSLIGFCDERNEMILIYDYMENGNLKSHLYGSDLPTMSWEQRLEICIGAARGLHYLHTSAVIHRDVKSTNILLDENFVAKITDFGISKKGTELDQTHVSTDVKGTFGYLDPEYFIKGRLTEKSDVYSFGVVLFEVLCARSAIVQSLPREMVNLAAWAVESHNNGQLEQIIDPNLAAKIRPESLGKFGETAVKCLAPSSEDRPSMGDVLWKLEYALRLQESVI

SEQ ID NO: 28792 - protein, 584 aa, Triticum aestivum
  misc_feature (341)..(341): Xaa can be any naturally occurring amino acid
MSSKPASQSMPEQAAKPKEMGEDDRQRSAAEEVSGEPDQQQESPAPVLDKDAPDLSPDSGVLDVPLAPEAESDESKETKNSDSNENQEKKSSQKSSISDSFISAKVSDGTNSLGKTSGSAKTSGRDFTESGKSSMCRVSASSDLSDESSCSSMSSATTKPHKGNDSRWEAIQVVKSREGVLGLNQFRLLKKLGSGDIGSVYLSELSGTKSHFAMKVMDKTSLASRKKLLRAQTEREILQSLDHPFLPTLYTHFETDKFSCLVMEFCPGGDLHTLRQRQPGKHFSEQAAKFYVAEVLLALEYLHMLGIIYRDLKPENVLVREDGHIMLTDFGLTEQRRERSXRCSVSPTVIRGANPGLDALQRNNAAYCVQPACIQPSCVVPTTCFGPRFFSKSKSKSKSKKEKPKPDIVNQVNLFPEMIAEPTDARSMSFVGTHEYLAPEIVKGEGHGSAVDWWTFGIFLYELLFGKTPFKGSGNRATLFNVVGQPLRFPESPLVSFSARDMIRGLLVKDPQHRLGHKRGATEIKQHPFFEGVNWALIRCASPPDIPKPVELDCRPKQAPAANGKVAPASNQKGSDNYLEFEFF

SEQ ID NO: 28793 - protein, 390 aa, Brucella suis
MAAGRGERAGQSAEGPKQYRLIGAEAVLARTLRAFTDCPLIGTIAVVIHPDDHALYRRAVPEKHENVILVTGGPTRQESTRLGLLALKDEAPQYVLIHDGVRPFIGQDLLERIIANLTPDNGVLPALAVPDTLKRAAADGMVETTISRTGLFAAQTPQAFPYAPILDAHEKAFAINRTDFTDDAAIAEWQEIAVRIIEGSADNTKLTWAKDIEMADKRLRQDHAVFPDIRTGNGYDVHSFEPGDHVTLCGVKIPHEAKLNGHSDADVALHALTDALLATRGAGDIGTHFPPSDSQWKGAASRIFIEHAAKIVREAGGRIANVDVTLISEAPKIGPHRAAMTQALCDMLGIAADRVSIKATTNEKLGFVGRREGIAAIATATVIYPGEVPE

SEQ ID NO: 28794 - protein, 141 aa, Chlamydia muridarum Nigg
MEQTLSIIKPDSVGKAHIGEIVSIFEKAGLRIAAMKMVHLSVKEAEGFYAVHKERPFFQELVDFMISGPVVVMVLQGENAVARNRELMGATNPKEAAEGSIRALFGESIGVNAVHGSDSLENAAIEVSYFFAKTEIVNALA

SEQ ID NO: 28795 - protein, 151 aa, Zea mays
  misc_feature (61)..(61): Xaa can be any naturally occurring amino acid
MKFNIGNPSTGCRRKLEIDDDHKLRTFYERTICQEVIVYAMGEEFMGYVLKIMGGCDEHGXRMEQGVLTSGRVRFLLHIGASCFLGYGMRNAERRMKAVRGCVVSHELSAINLVIVKKAENVLSVLIDTERSRMRGRHRASRIWIVLNLVK

SEQ ID NO: 28796 - protein, 231 aa, Zea mays
MASSSDPWMKEYNEASRLADDISSMIADRGSLPQSGPEIMRHTSAIRRKITILGTRLDSLESLLGRIPPKSITDKEMHKRQDMFSSLKSKAKQMATSFNMSNFANREDLLGQSKKADDMSRVAGLDNQGIVVLQRQIMKEQDEGLEKLEETVLSTKHIALAVNEELTLHTRLIDDLEDHVDVTNSRLQRVQKRLAILSKRTKGGCSCMCLLLSVVAIVILAVIVWLLVKYL

SEQ ID NO: 28797 - protein, 191 aa, Brassica napus
  misc_feature (158)..(158): Xaa can be any naturally occurring amino acid
TDGVNGRCFCNPTLTLKFPFLGFSKLSTDSGIQSSVNNTESELREIRLSLLMEIEKRKQTEEVLEQMQIHWQRLREQLAQVGVFVPIDPTISTNNSNISEELCCQLEAARFVSDSVSRGMAKAEVEMEMDSMLETKNFEITRLFDRVHHYEPVNREMXQRNQEAIGNRKPYYSFVIHLCLSWSYISNLQLC

SEQ ID NO: 28798 - protein, 335 aa, Chlamydia muridarum Nigg
MRIVINGFGRIGRLVLRQILKRNAPIEVVAINDLVSGDLLTYLFKYDSTHGSFASQATFSDGCLVVGERKIRFLAEKDVQKLPWKDLDVDVVVESTGLFVNKDDAAKHLDSGAKRVLITAPAKGDVPTFVMGVNHQKFDPANDVIISNASCTTNCLAPLAKVLLDNFGIEEGLMTTVHAATATQSVVDGPSRKDWRGGRGAFQNIIPASTGAAKAVGLCLPELKGKLTGMAFRVPVADVSVVDLTVKLSSATTYEAVCEAVKHAASTSMRNIMHYTEEAVVSSDFIGCEYSSVFDAQAGVALNDRFFKLIAWYDNEIGYATRIVDLLEYIQGNSK

SEQ ID NO: 28799 - protein, 644 aa, Oryza sativa Japonica Group
MESLALLHAKPGGLPPRAGLRLPLPRARSARVSLPSSPAAPVSLQSPLLLASRSGPTSRDAVVGLGLGCGLLRRRSGASGGGGGGVSCGAQPAAAAAAGAVPAAQPEGKKFLGVEVKTLKKIVPLGLMFFCILFNYTILRDTKDVLVVTAKGSSAEIIPFLKTWVNLPMAIGFMLLYTKLSNVLSREALFYTVIFPFIAFFGAFAFVLYPLRNVIHPTALADKLLAALGPSFLGPVAILRIWSFCLFYVMAELWGSVVISVLFWGFANQITTVEEAKEFYPLFGLGANIALIFSGRTVKYFSNLRKTLGPGIDGWEVSLKGMMSLVVLLGLVITSIYWGVNKFVLNDPSLPKSDRKKKKDKPKLGMKESLKVLLSSRYVRDLATLVVAYGISINLVEVTWKSKLKAQQFPSPNEYSSFMGDFSTATGIATFTMMLLGRIILRKFGWGVAAMITPTVLLLTGVGFFSLILFGQPLTPMLATMGMTPLLAAVYVGALQNIFSKSAKYSLFDPCKEMAYIPLDEDMKVVKGKAAIDVVCNPLGKSGGALIQQFMILTFGSLANSTPYLGGILLVIVLAWLGAASSLDKQFSSLAKEDLKRDMSAKEKVDPSLLKAPEADVLVEHTNGTIESEATATESSPSNSSPSN

SEQ ID NO: 28800 - protein, 376 aa, Xanthomonas campestris pv. campestris str. ATCC 33913
MSKRDYYEVLGVARGASDEELKKAYRRCAMKYHPDRNPGDAAAEATFKECKEAYEVLSDGNKRRAYDAHGHAAFEHGMGGGGGGPGGPDMGDIFGDIFGNIFGGGAAGPRAARRGADVGYVLELDLEEAVAGIERRIEIPTLIECEPCHGSGSEDGKVEVCATCHGRGQVRIQRGIFAMQQSCPHCDGRGTLIQNPCKTCHGAGRVEEDKVLSIKVPAGVDTGDRIRLAGEGEAGPAGTPPGDLYVEVRVREHAIFQRDGDDLHCEVPIRISQAALGDTVRVATLGGEAEIRIPAETQTGKLFRLRGKGVRSVRSRSEGDLYCRVVVETPVNLTTDQRELLKQFEATFTGEDARKHSPKSATFIDGVKGFWDRMTS

SEQ ID NO: 28801 - protein, 369 aa, Acinetobacter sp. ADP1
MIHDDQKPSSSLDLQEIRIQIDSVDQQIQELINRRATLAEAVAKAKFASEENPLFYRPEREAQVLRKVMERNQGPLSDVTMARLFREIMSACLALEAPQSIAFLGPEGTFTQSAALKHFGKDAVVRPLPTIDEVFREVEAGSAHYGVVPVENSSEGVVNHTLDCFRTSQLNVIGEVELRIHHQFLVSHNTRKDSIKQIYAHQQALAQCRQWLDTHYPGVERVALSSNAEAARRIRNEWHSAAIASDIAASMYDLEIFHSNIEDNPENTTRFLVIGREKIPQSGNDKTSLLISAHDRAGALLEILAPFAKHKISLTSIETRPALPEKWAYVFFIDLEGHIEQENVAAAIDDIRPLVKELRILGSYPAAVL

SEQ ID NO: 28802 - protein, 505 aa, Physcomitrella patens subsp. patens
MDGDHVILGLTGNAKLGQTDDNALGHGEKGRAGFDGVDKPIHDPNLNDDDGKPRRKGTVITSAAHIITAVIGSGVLALSWSFAQMGWIAGPIVLLAFAWCTYYTSRLLADCYRSPDPIHGKRNYIYMDAIKANLGRKQQLVCACVQYSNLIGTSIGYTIATATSAKAIQYQNCIHDNGPDDPCLTSTTVYIAIFGVIQIVLSQIPNFGELWWLSYLAAAMSFTYSFIGLGLGISKAATGENSHGSLGGTSVCYPSNGETCFTRPQKTWNVFTALGNMAFAYSFSMILIEIQDTIKSPPSESSQMKKATLLGIITTTFFYMSVAIAGYAAFGDAAPGNLLTGFSTPYWLVDFANTCIVIHLIGAYQVYTQPVYAFVERWCSLRWPNNSFLNLEYNVRLPGRRNFRVSAFRLIWRTIYVIITTIISMLIPFFNSVLGILGAIGFWPLTVYYPVEMYIRQTHVQRWSRKFLLLQLLSFVTLLISIAGLIGGVSGIIQELQHVALFAKT

SEQ ID NO: 28803 - protein, 471 aa, Xanthomonas oryzae pv. oryzae KACC10331
MSSWLRRKSIDQVTVHEAGRQLVRSLSWPHLIALGIGAIVGTGIYTLIGVGADKAGPAVLLSFVAAGIVCACAALAYAEMATMMPAAGSAYTYSYTALGESIAWVVGWSLVLEYSLVVSTVAVGWSGYFVGFLQWLGASLPHELIAGPHAGGIANLPAVVITFLVAGMLMAGTKESATLNAVLVVLKIIALGVFVAIALPTFKSANLQPFMPYGISKAMGPDGVERGVMAAAAIIFFAFYGFDAISTAAEETKNPGRDLSIGIVGSMIGCTLIYVLVALAAVGAMRFTVFGKSPEPLALILRELGHGKAALVIGAVAIIALPTVLLAFLYGQSRIFFVMSRDGLLPRGLSKVNARTGTPVAITLLTAVLVAALAGVARLDEIAALANAGTLAAFTAVAACLLVLRVREPGRARAFRTPLAWVVGPVAILGCLYLFWSLPSNTQGWFLLWNALGVVVYLAYGRRNSRLNSAG

SEQ ID NO: 28804 - protein, 459 aa, Vibrio sp. Ex25
MTQNIKPTHFRSEGDVNTTPARQAWNASMDDERTQALLKRDSEVFLHQAMSTPCLDTLEAAEGIYIQDATGKKYMDFHGNNVHQLGYGHPHVIKRVQEQIAKLPFSPRRFTNETAIECAEKLTQICGGELNRVLFAPGGTSAVGMALKLARHITSNYKVVSLWDSFHGASLDAISVGGEACFRQGMGPLMAGVERIPPAVSYRGAFPVADGSDVHYADYLEYVIEKEGGVGAFIAEAVRNTDVQVPSKAYWKRIREICDKHNVMLIIDDIPNGMGRSGEWFTYQAYDIEPDMLCIGKGLGGGLVPIAAMVTKDKYNTAEQISMGHYTHEKSPVGCAAALATMEAIEQDGLLDKAKADSQFMREKLLEMKAKYPVIGDVRGIGMLWGIELVTDHESKTRAYDEAEAVLYQCLNNGMSFKVSQGNVIQLSPPLIITREQLTEALAIFEEAIAKMCKDFNYI

SEQ ID NO: 28805 - protein, 475 aa, Mesorhizobium sp. BNC1
MFKNYIAGEWVEAEGTENINPSDTSDVVGVYSRATRENVLDAISAAKAAFASWSRSGPLQRHSVLRKAADEIMARKDELGSLLAREEGKTLPEAIGEVVRASQIFDFFAGESLRLSGEIIPSVRPGIGVEITREPVGVIGIITPWNFPIAIPAWKIAPAICYGNAIVFKPADLVPASSWAIVDILQRAGLPAGVLNLVMGKGSVVGQAILESPDVAAVTFTGSTQTGKHVAAASIEHNRRFQLEMGGKNPMVVLDDADLSIAVEAATNSAFFSTGQRCTASSRLIVTEGIHDRFVEAMTQRLSSLVVDNALKPGTHIGPVVDESQLQQDLDYIEVGQKEGARLHFGGRRLERETNGFYLEPALFTEASNDMRIAREEIFGPVAAVIRVKDYEEALAVSNDTPYGLSAGIATQSLKFATHFKQNAEAGMVMVNLPTAGVDFHVPFGGRKRSSYGPREQGRYAAEFFTTVKTSYSLA

SEQ ID NO: 28806 - protein, 762 aa, Bacteroides fragilis NCTC 9343
MNKIISKEHFSEKVFKLVIEAPLIAKSRKAGHFVIVRVGEKGERMPLTIAAADPKAGTITLVVQEVGLSSTRLCELNEGDYITDVVGPLGQATHIENFGTVVCAGGGVGVAPMLPIVQALKAAGNRVITVLAGRSKELIILEKEMRESSDEVIIMTDDGSYGRKGLVTEGVEEVIKREKVNKCFAIGPAIMMKFVCLLTKKYEIPTEVSLNTIMVDGTGMCGACRITIGGKTKFVCVDGPEFDGHQVDFDEMLKRMGAFKTIEREELHKLDECEATKVIDENGRTAPWREALRKAIKAKDRANIERCQMNELDPEYRSHSRKEEVNQGLTKEQAVAEAQRCLDCANPGCMTGCPVGIDIPRFIKNIERGEFLEAAKTLKETSALPAVCGRVCPQEKQCESKCIHLKMGKEAVAIGHLERFAADYERESGQISVPEVGEKNGIKVAVIGSGPAGLSFAGDMAKYGYDVTVFEALHEIGGVLKYGIPEFRLPNKIVDVEIENLAKMGVTFIKDCIVGKTISVEQLEEEGFKGIFVASGAGLPNFMNIPGENSINIMSSNEYLTRVNLMDAASPDSDTPVAFGKNVAVIGGGNTAMDSVRTAKRLGAERAMIIYRRSEEEMPARLEEVKHAKEEGIEFLTLHNPIEYLADEQGRVKQVILQKMELGEPDASGRRSPVPIPGATETVDIDLAIVSVGVSPNPIVPSSIKGLELGRKGTITVNDQMQSSIPTIYAGGDIVRGGATVILAMGDGRRAAAAMNEQLSSK

SEQ ID NO: 28807 - protein, 516 aa, Magnaporthe grisea 70-15
MAPNLTSERQPLLHPAITTGRSDRNTPVLHEPAINKSYLTGDDIPSPDYEPSRAVEDDVLPETSPLGRTLSRHSVYLLIISRVIGSGIFATPGAILRAVGSPGLALLLWVLGAVVAACALSIGLEYGCMLPRSGGEKVYLEFTYRRPRFLASTLIATSVVLLGFTASNCIVFSEYVLFTLGREDAPEFLRKGLAVGLLTAVTVIHGVFPKTGVRLQNLLGYVKIGTIVFMILCGLYVVVLGPSAISASTDNQSSAGRRLFAWEDSIWTGSVWNWGVIATSLFKVTYSFAGLENANNVLNEVKDPVRTLRFATRAALATACFMYILVNLAYLAVVPLDDIKASGELIAALYFERLFGPQVGRVVLPLAVALSAAGNVLVVAFSLSRVKQEVARQGLLPFGNVLSSTRPFGSPLGGLLMNFVVSVLVLVLPPSKEVYSFILEVESYPGQFFALASACGLLYLRRKKPDLKRPFRAWIPAVVLRIMVCLALIAAPFFPPATPTEGGMFYATYAVVGFSM

SEQ ID NO: 28808 - protein, 316 aa, Capsicum chinense
MGSKYSKATNSISDASNSFESYRFPLEDLEEATNNFDDKFFIGEGAFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDIKSINILLDENFVPKITDFGISKKGTELDQTHLSTVVKGTLGYIDPEYFIKGRLTEKFDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 28809 - protein, 294 aa, Sesbania rostrata
MEQYEKVEKIGEGTYGVVYKARDRVTNETIALKKIRLEQEDEGVPSTAIREISLLKEMQHRNIIRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPGILLGSRHYSTPVDIWSVGCIFAEMVNRRPLFPGDSEIDELFKIFRILGTPNEDTWPGVTSLPDFKSTFPKWPPKDLATVVPNLEQAGLNLLSSMLCLDPSKRITARSAVEHEYFKDIKFVP

SEQ ID NO: 28810 - protein, 415 aa, Zea mays
SWEKTVDCYSPGQGLMPASFKVRSVPLDGNSEAFEEVLDPDFGESAIGRVAPVDSGLWWIILLRAYGKITGDYALQERVDVQTGIRLILNLCLSDGFDMFPTLLVTDGSCMIDRRMGIHGHPLEIQALFYSALRCAREMIGVTDGSKNLIRAINNRLSALSFHIREYYWVDMKKINEIYRYKTEEYSHDAINKFNIYPEQIPSWLADWIPVKGGYLIGNLQPAHMDFRFFSLGNLWAIVSSLATQRQAEGILNLIEAKWDDIVANMPLKICYPALEYEEWRIITGSDPKNTPWSYHNGGSWPTLLWQFTLACIKMGRRDLARRAVEVAEKRLSDDKWPEYYDTRTGRFIGKQSRLYQTWSIAGYLSSKMLLDCPEMASILVCDEDFELLEGCACSLNKNARTKCSRRAAKSQVLV

SEQ ID NO: 28811 - protein, 560 aa, Triticum aestivum
MELGAAGMRRSASHNSLSGSDDFDLTHLLNKPRINVERQRSFDDRSLSDVSYSGGHARGGGGFDGMYSPGGGLRSLVGTPASSALHSFEPHPIVGDAWEALRRSLVFFRGQPLGTIAAFDHASEEVLNYDQVFVRDFVPSAMAFLMNGEPEIVKNFLLKTVLLQGWEKKVDRFKLGEGAMPASFKVLHDDKKGVDTLHADFGESAIGRVAPVDSGFWWIILLRAYTKSTGDLTLAERPECQKAMRLILSLCLSEGFDTFPTLLCADGCCMIDRRMGVYGYPIEIQSLFFMALRCALLMLKHDAEGKDFVERIATRLHALSYHMRSYFWLDFQQLNDIYRYKTEEYSHTAVNKFNVIPDSIPDWLFDFMPCEGGFFVGNVSPARMDFRWFALGNMIAIVSSLATPEQSMAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMLKPVLKRSASWTN

SEQ ID NO: 28812 - protein, 370 aa, Psychrobacter arcticus 273-4
MSLNTIPEIIEDIRAGKMVILMDDEDRENEGDIIMAATHVRPDDINFMITHARGLVCLTLSQARCQQLALPLMSDRNEAKFSTNFTVSIEAAEGVTTGISAADRARTIQAAVSSSAKPEDIVQPGHIFPIMAQNGGVLHRAGHTEAGCDLARLAGLEPAAVIVEIINADGTMARRDDLEVFAKEHDLKIGTIADLINYRIANEQTVEEIAAHPFETEYGTFTLHRFREFGADETHLALVKGDVSQGVSTVRVHGFHPLRDLFAAKNDTTGRSGWSVRSALEEISTSERGVLVWIGNHEPTDLGDALDKASLNEAMSTITQQPYRSIGVGAQILRHLGVRDMRLLSSPMKFHALSGFDLNVVDCVHAPKQD

SEQ ID NO: 28813 - protein, 280 aa, Urochloa decumbens
DTVHGHWKHSDITLKESKTLLFGEKAVTVFGIRNPEEIPWGEAGADYVVESTGVFTDKDKAAAHLKGGAKKVVISAPSKDAPMFVVGVNEDKYTPDINIVSNASCTTNCLAPLAKIINDNFGIVEGLMTTVHAITATQKTVDGPSAKDWRGGRAASFNIIPSSTGAAKAVGKVLPELNGKLTGMSFRVPTVDVSVVDLTVRTEKAASYEDIKKAIKAASEGQLKGIMGYTDEDLVSTDFTGDSRSSIFDAKAGIALNEHFVKLVSWYDNEWGYSNRVVDL

SEQ ID NO: 28814 - protein, 81 aa, Physcomitrella patens subsp. patens
SDAEVDSRGRVPEDVPAGFLVVYVGDERRRFVIRAKTLNHATFRVLLEKSAAEFGYKHDGGLIIACDVAFFEHLLWLIETN

SEQ ID NO: 28815 - protein, 728 aa, Arabidopsis thaliana
MDLVQKQKSLQDYTKSLFLELQQLQDESNPDFVSQVVTLFFQDSDRILNDLSLSLDQQVVDFKKVDPHVHQLKGSSSSIGAQRVKNACVVFRSFCEQQNVEACHRCLQQVKQEYYLVKNRLETLFKSKVRATTFSEKGEYYSNRPPTPLLDTINHPMHMKNLSIKELKVLSDELRSDVIFNVSKTGGHLGSNLGVVELTVALHYIFNTPHDKILWDVGHQSYPHKILTGRRGKMKTIRQTNGLSGYTKRRESEHDSFGTGHSSTTLSAGLGMAVGRDLKGMNNSVVSVIGDGAMTAGQAYEAMNNAGYLHSNMIVILNDNKQVSLPTANLDGPTQPVGALSCALSRLQSNCGMIRETSSTLFEELGFHYVGPVDGHNIDDLVSILETLKSTKTIGPVLIHVVTEKGRGYPYAERADDKYHGVLKFDPETGKQFKNISKTQSYTSCFVEALIAEAEADKDIVAIHAAMGGGTMLNLFESRFPTRCFDVGIAEQHAVTFAAGLACEGLKPFCTIYSSFMQRAYDQVVHDVDLQKLPVRFAIDRAGLMGADGPTHCGAFDVTFMACLPNMIVMAPSDEAELFNMVATAAAIDDRPSCFRYHRGNGIGVSLPPGNKGVPLQIGRGRILRDGERVALLGYGSAVQRCLEAASMLSERGLKITVADARFCKPLDVALIRSLAKSHEVLITVEEGSIGGFGSHVVQFLALDGLLDGKLKWRPMVYRTWITNGSTS

SEQ ID NO: 28816 - protein, 280 aa, Urochloa decumbens
DTVHGHWKHSDITLKESKTLLFGEKAVTVFGIRNPEEIPWGEAGADYVVESTGVFTDKDKAAAHLKGGAKKVVISAPSKDAPMFVVGVNEDKCTPDINIVSNASRTTNCLAPLAKIINDNFGIVEGLMTTVHAITATQKTVDGPSAKDWRGGRAASFNIIPSSTGAAKAVGKVLPELNGKPTGMSFRVPTVDVSVVDLTVRTGKAASYEDIKKAIKAASEGQLKGIMGYTDEDLVSTDFTGDSRSSIFDAKAGIALNEHFVKLVSWYDNEWGYSNRVVDL

SEQ ID NO: 28817 - protein, 333 aa, Bifidobacterium longum NCC2705
MGKNITVLGAGAWGTAFGQVLADAGNTVTMWAKEQQIVEGIRDHHHNAVRLPSVEKLPDNMTATGDRAEAVKNADIVVVAIAAQFARVALVEFKGLIPDHAIVVSLMKGIERGTNKRMDEVVRESLDLPADRFAAISGPNLSKEIADRHPAATVVACTNLDNATKVAEACTTSYFKPFVTTDVIGLEMCGSLKNVTALAVGMARGAGYGENTAAMIETRGLAELTALGVAAGADPKTFFGLAGVGDLIATCGSSLSRNYTFGANLGKGLTVEEATKVSNGVAEGVPTTDAVVALGDQLDVPTPLAYQMSRVLNEGISCSEMLAGLFGHEVTGE

SEQ ID NO: 28818 - protein, 478 aa, Xanthomonas campestris pv. campestris str. ATCC 33913
MSEQFDVVVIGAGPAGYHAAIRAAQLGMKVACIDAAIGKDGKPALGGTCLRVGCIPSKALLDSSRQFWNMGHLFGDHGISFNDAKMDVPTMIGRKDKIVKQFTGGIAMLFKANKITPYYGFGQLQPGNIVKVTQHEGGEIELKGTNVILAAGSESIELPFAKFDGDTIVDNVGGLDFTAVPKRMAVIGAGVIGLELGSVWKRLGAEVTILEALPDFLALADAEVAKTALKEFKKQGLDIKLGAKVSKTEITGSGDAKQVVLSYTDAAGEQTLTVDKLLVAVGRKAATKNLLADGTGVKLTERGQIEVDGHCHTGVDGVWAIGDCVRGPMLAHKGFEEGIAVAELIAGLPGHVNFDTIPWVIYTEPEIAWVGKTEQQLKAEGVAYKAGSFPFAAIGRAVAMGEPAGFVKVIADAETDRVLGMHLVGVGVSELVHEGVLTMEFSGSADDLARICHAHPTLSEAIHDAAMAVSKRAIHKAN

SEQ ID NO: 28819 - protein, 278 aa, Triticum aestivum
  misc_feature (142)..(142): Xaa can be any naturally occurring amino acid
  misc_feature (171)..(171): Xaa can be any naturally occurring amino acid
  misc_feature (181)..(181): Xaa can be any naturally occurring amino acid
  misc_feature (189)..(189): Xaa can be any naturally occurring amino acid
MAAAATATAVRLHAAATRRAAPRRPARLAVRADAARAATALTQDDLKRLAAVRAVEQVQSGMVLGLGTGSTAAFAVAEIGALLASGKLSGIVGVPTSKRTFEQATSLGIPLSTLDDHPVIDLAIDGADEVDPDLNLVKGRGXGPFSGEKMVEAASGKFVVVVDETKLVTWXLGGSGLAMPXVEVVQFCXWKHNQVRLQGLFNEEGCEAKLRLNEDGKPYVTDNSNYIVDLYFKTPIRDALGAGKEIAALEGVVEHGLFLNMATSVIIAGSDGVSVKTK

SEQ ID NO: 28820 - protein, 404 aa, Xanthomonas campestris pv. campestris str. ATCC 33913
MATEVKVPVLPESVSDATIASWHKKAGEAVKRDENLVDLETDKVVLEVPSPVDGVLKEIKFEAGSTVTSNQILAIIEEGAVAAAAPAEEKKADATAAAAAPAAAPAPAAAAAAAPVASKSSADSLPPGARFSAITQGVDPSQVDGTGRRGAVTKEDIVNFAKAGGVGKASGARPEERVAMTRVRKTIAKRLMESKNSTAMLTTFNEVNLAKVSAARKELQDEFQKAHGIKLGFMSFFVKAAANALQRFPLVNASIDGDDIIYHGYSDISIAVSTEKGLVTPVLRNVERQSFAEVEQGIADYAAKARAGKLGLDDLQGGTFTITNGGTFGSLLSTPIINPPQSAILGMHAIKERPIAENGQVVIAPMMYLALSYDHRIIDGKDSVQFLVDIKNQLENPGRMLFGL

SEQ ID NO: 28821 - protein, 629 aa, Yarrowia lipolytica CLIB122
MLRLRTMRPTQTSVRAALGPTAAARNMSSSSPSSFEYSSYVKGTREIGHRKAPTTRLSVEGPIYVGFDGIRLLNLPHLNKGSGFPLNERREFRLSGLLPSAEATLEEQVDRAYQQFKKCGTPLAKNGFCTSLKFQNEVLYYALLLKHVKEVFPIIYTPTQGEAIEQYSRLFRRPEGCFLDITSPYDVEERLGAFGDHDDIDYIVVTDSEGILGIGDQGVGGIGISIAKLALMTLCAGVNPSRVIPVVLDTGTNNQELLHDPLYLGRRMPRVRGKQYDDFIDNFVQSARRLYPKAVIHFEDFGLANAHKILDKYRPEIPCFNDDIQGTGAVTLASITAALKVLGKNITDTRILVYGAGSAGMGIAEQVYDNLVAQGLDDKTARQNIFLMDRPGLLTTALTDEQMSDVQKPFAKDKANYEGVDTKTLEHVVAAVKPHILIGCSTQPGAFNEKVVKEMLKHTPRPIILPLSNPTRLHEAVPADLYKWTDGKALVATGSPFDPVNGKETSENNNCFVFPGIGLGAILSRSKLITNTMIAAAIECLAEQAPILKNHDEGVLPDVALIQIISARVATAVVLQAKAEGLATVEEELKPGTKEHVQIPDNFDECLAWVETQMWRPVYRPLIHVRDYD

SEQ ID NO: 28822 - protein, 447 aa, Picea sitchensis
MADSEINYTAMPQAGIKTEESPTKERQATEEIAEKTASTPEKSAAQNHREEGNPMEENPAAEGSTFQSPPPPPPPAPAAACGRCPCGEAASFPNGGGFGLSPPPVPTNYRPIRAPALLTPPNTQAVILAPVPQAQKVPLVSAPFSFQIPRRRISSPADIEHFHNSDSGRAFLGFVVALSESIRGHKISDECFESPAVKAIVEILGIMDGWIDEIPPLQQPARYGNPAFRQWQERLQQGQELMDRVLTQDLHASIPEIYPYFGDSFGNAMRIDYGTGHEANFAAWLFCLARLGVLTENDYQAVVSRVFVKYLGLMRRLQTTYWLEPAGSHGVWGLDDYHFLPFVFGSSQLVDHKYMKPKSIHNQDILDNFSDEYLYLSCVAFVKKVKKGHLAEHSPMIDDISAVPNWGKVNSGMLKMYKAEVLEKVPIMQHFLFGSLLNGSEPLDLSI

SEQ ID NO: 28823 - protein, 239 aa, Vibrio sp. Ex25
MNKTLLAFSLSLLTLSAAQASEWGYGNDKHGPEHWGEIAKDCATTKNQSPINIDNPADAKLEALNLSYTGQVIGLTNNGHTLQAQVNGRNSFTIDSETFELQQFHFHTPSENQIKGRQYPLEAHFVHANADGELAVISVMFDAGDQNAALSKLINAIPQENQTTFFKDTFEINDLLPKTANYYRFNGSLTTPPCSEGVRWFVLKDTQTLSKDQAAKLMEVMGQNNRPLQPLNARVVLSN

SEQ ID NO: 28824 - protein, 561 aa, Oryza sativa Japonica Group
TPRLNTKPRKNLRLRHRHRRRRRHGRHRRRGPHPPPPRGPEEALRGAPTPARHPTPTGSSSHIDVDVATEADLRENGFRSTRRTKLVCTVGPATCGADELEALAVGGMNVARVNMCHGDREWHRGVIRAVRRLNEEKGFAVAVMMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 28825 - protein, 588 aa, Candida albicans SC5314
MPEKELDYIRSTDAAGSTEKDGGIYIDAFDKQDNAPPKKGFAKFIDGFRRADAEELGIDPNLSEAEKIAIMTANSPLTRSLKNRHLQMIAIGGSIGTGLFVGSGSSLHTGGPAGLLIAYILIGTMIYCTVMSLGELAVTFPVSGAFVTYNSRFIDPSWGFAMAWNYAMQWLVVLPLELVAAAMTVKYWDAKTNSAAFVVIFYVLIVAINFFGVRGYGEAEFIFSAVKVLAVLGFIILGIVLCAGGGPQGGYIGGKNWYIEGAPFPNGAKGVITVFVNAAFAFAGTELCGLAAAETENPRKSLPKACKQVFWRITLFYVICLTLVGLLVPWNDERLLGSSSADASASPFVISIRNAGIKGLPSVMNVVIMIAVLSVGNSSVYGSSRTLAALAASNQAPKIFGYIDKQGRPLVGIIAQLLVGLLCFLAASDKQGEVFNWLLALSGLSSIFTWGSINVCLIRFRRALAAQGRDTGELVFTSQVGVIGAIWGAFLNTVVLCLQFWIAVWPLHSSPSAEAFFSAYLTVPVVIVFYVGHKLWTKNWQVYICAKDIDIDTGRRELDLDLVKQEVAEEKAYIASLPFYRRVYNAWC

SEQ ID NO: 28826 - protein, 445 aa, Sesbania rostrata
MASRPIVPQQPRGDAALGAGKQQKKNGAADGRNRKALGDIGNLVTVRGVEVKPNRPITRSFCAQLLANAQAAAAAENNKKQACPNVAGPPPVVEGVAVAKRVAPKPGQKKVTTKPKPEEVIEISPDEEVHKDNNKKKEGDANTKKKSHTYSSVLTARSKAACGLTNKPKEIIDIDAADTANELAAVEYIEDIYKFYKMVENESRPHDYMDSQPEINERMRAILVDWLIDVHSKFDLSLETLYLTINIVDRFLAVKTVPRRELQLVGISAMLMASKYEEIWPPEVNDFVCLSDRAYTHEQILFMEKIILGKLEWTLTVPTPFVFLVRFIKASVPDEALENMAHFLSELGMMHYATLMYCSSMVAASAVYAARCTLNKSPVWNETLKQHTGYSEEQLMDCARLLVSLHSTVGNGKLKVVYRKYSDPERGSVAVLPPAKNLLSEGKSL

SEQ ID NO: 28827 - protein, 428 aa, Medicago sativa subsp. x varia
MKFSEENNVSNNPTNFEGGLDSRKVGQNRRALGVINQNLVVEGRPYPCVVNKRALSERNDVCEKKQADPVHRPITRRFAAKIANTKTTNAEGTTKRSNLAKSSSNGFGDFIFVDDEHKPVEDQPVPMALEQTEPMHSESDRMEEVEMEDIMEEPVMDIDTPDANDPLAVAEYIEDLYSYYRKVESTSCVSPNYMAQQFDINERMRAILVDWLIEVHDKFDLMHETLFLTVNLIDRFLEKQSVVRKKLQLVGLVAMLLACKYEEVSVPVVGDLILISDRAYTRKEVLEMEKVMVNALKFNISVPTAYVFMRRFLKAAQADRKLELLAFFLIELSLVEYAMLKFSPSQLAAAAVYTAQCTMYGVKQWSKTCEWHTNYSEDQLLECSSLMVDFHKKAGTGKLTGAHRKYCTSKFSYTAKCEPASFLLENEL

SEQ ID NO: 28828 - protein, 359 aa, Capsicum chinense
  misc_feature (288)..(288): Xaa can be any naturally occurring amino acid
NMSYRVPFAALLEATSNFDESLVIGIGGFGKVYKGVLYDGTKLAVKRGNPKSQQGLAEFRTEIEMLSQFRHRHLVSLMGYCDEKNEMILVYEYMENGTLKSHLYGSDLPSMSWKQRLEICIGSARGLHYLHTGYAKAVIHRDVKSANILLDESFMAKVADFGLSKTGPELDQTHVSTAVKGSFGYLDPEYFRRQQLTEKSDVYSFGVVLFEVLCARPVIDPSLPREMVNLAEWAMKWQKKGQLEQIIDPTLVGKIRPDSLRKFGETAEKCLADFGVDRPSMGDVLWNXEYALQLQEAVIQDDPEENSTLLIGELSPQVNDFSQVDAGASAALIGTPNLDDLSGVSMSRVFSQLVKSEGR

SEQ ID NO: 28829 - protein, 308 aa, Arabidopsis thaliana
MGELNGVIIPTIDLEEVSDKILNQKIREASERWGCFRVINHGVSLSLMAEMKKTVIDLFQRPYEVKVRNTDVLLGSGYRAPNEINPYYEALGLYDMASPHAVNTFCDQLEASADQREIMVKYAKAINGLATDLARKLAESYGLVETDFFKEWPSQFRINKYHFKPETVGKLGVQLHTDSGFLTILQDDENVGGLEAMDNSSGTFFPIDPLPNTLAINLGDMATIWSNGRLCNVKHRVQCKEATMRYSIASFLLGPMDTDLEPPSEFVDAEHPRLYKPISHEGVRNIRMTKKLHDGEALKLITHAGLDK

SEQ ID NO: 28830 - protein, 372 aa, Salmonella enterica subsp. arizonae serovar 62:z4,z23:--
MKSRAAVAFAPGKPLKIVEIDVAPPKKGEVLVKITHTGVCHTDAFTLSGDDPEGVFPAVLGHEGGGVVVEVGEGVTSLKPGDHVIPLYTAECGECKFCKSGKTNLCQAVRATQGKGLMPDGTTRFSYNGEPVYHYMGTSTFSEYTVCAEISLAKVNPQAPLDKVCLLGCGVTTGIGAVHNTAKVKAGDTVAVFGLGGIGLAVIQGAVQAKAGRILAVDTNPEKFTLAGEMGATDFINPNDYDKPIQDVIVELTDGGVDFSFECIGNVNVMRAALECCHKGWGESIVIGVAGAGQEIKTRPFQLVTGRVWRGSAFGGVKGRTQLPGMVEDAMNGNIRLDPFITHRLPLEQINDAFELMHQGKSIRTVIHFGDK

SEQ ID NO: 28831 - protein, 123 aa, Wigglesworthia glossinidia endosymbiont of Glossina brevipalpis
MSINKQQILDAVSEMSVLEISELVSMMEKKFGVSSINNNNINVNKVDESVEEKSEFDVLLLEIGKNKISVIKSVRSALSLGLKESKDLIESELPITLKTGLNKKDAESLKKEIETSGARIELK

SEQ ID NO: 28832 - protein, 459 aa, Arabidopsis thaliana
MGSIVEPWAAIAENGNANVTAKGSSRELRHGRTAHNMSSSSLRKKSDLRLVQKVPCKTLKNILSNLQEVILGTKLTLLFLAIPLAILANSYNYGRPLIFGLSLIGLTPLAERVSFLTEQLAFYTGRTVGGLLNATCGNATELIIAILALANNKVAVVKYSLLGSILSNLLLVLGTSLFFGGIANIRREQRFDRKQADVNFFLLLMGLLCHLLPLLLKYAATGEVSTSMINKMSLTLSRTSSIVMLIAYIAYLIFQLWTHRQLFEAQQDDDDAYDDEVSVEETPVIGFWSGFAWLVGMTIVIALLSEYVVDTIEDASDSWGLSVSFISIILLPIVGNAAEHAGAIIFAFKNKLDISLGVALGSATQISLFVVPLSVIVAWILGIKMDLNFNILETSSLALAIIITAFTLQDGTSHYMKGLVLLLCYVIIAACFFVDQIPQPNDLDVGLQPMNNLGEVFSA

SEQ ID NO: 28833 - protein, 532 aa, Mycobacterium smegmatis str. MC2 155
MPPLTSEIDPHSDTFKSNYEVQTAAVAALNEQLAIVAGGGGERYVKRHHDRGRLLARERIELLLDRDAPFLELSSLAAWGTDFNVGAAIVTGVGVVSGTECMIIAHDPTVRGGTMNPYTLRKNLRALEIAKVNRLPVLYLVESGGADLPTQSELFVHAGRIFRDLTELSSMGIPSVAMVFGNSTAGGAYVPGMCDYAVLVDKQAKVFLGGPPLVKMATGEDADDESLGGADMHTRVSGLGDYFAVDEVDAIRIGRDIVAHLNWRKLGPGPSRPADEPLYDSEELLGIASGDSRVPFDPREVIARIVDGSRFSEYKPRWGTSLATGWASIHGFPVGILANTRGVLFSEESKKATEFILLANQTDTPLIFLQNVTGFMVGTEYEQGGIIKDGAKMINAVTNSTVPHITLNMGGSFGAGNYGMSGRAYDPRFMFSWVNAKLAVMGAQQLAGVLSIVGKAAAQAAGREFDHEADAKRTKEIEEQIDRESHAFFNSARIYDDGVIDPRDTRSVLGIALSAAHSNVVAGRRGFGVFRM

SEQ ID NO: 28834 - protein, 365 aa, Wigglesworthia glossinidia endosymbiont of Glossina brevipalpis
MNYKPLNIKWRPKIFNDIIGQDHVLRFLKNSFLDKKIYYSYLISGIRGIGKTTLARLIAKSLNCFYDINFNPCRICKNCEESEKNCFVDLIEIDAASHTKIENIKEVLDNIKYLPSKGRYKIYIIDEVHMLSKYSFNALLKILEEPPNHVKFILATTELNKIPETILSRCLHLQLKEISETDILYNLKKILKLEKIYYEEEALKIISKSSQHSMRDALTLAEKASILGENNILYNVVSDMLGCISFMELIDLFEIISLNKKEKLIFFFKKIENKSINWDDFLINMILIVHKVLFFKFNDTYKDPKKINTKKTKFYKLSKLISTNDLYKYYDIFLQGRKELSYSTEQKITVEITILRAFYFINENL

SEQ ID NO: 28835 - protein, 76 aa, Zea mays
TAPEKAEAVVDFVADKMNRAWVGFGSAPEGSMKSRIHSFGLKLLSRVRPSEVLLKSVTKDVSALEIVHPARSAVLL

SEQ ID NO: 28836 - protein, 178 aa, Physcomitrella patens subsp. patens
MGFVAWWYAWTHALLYMSPYVYSAIGIAISIGVSVLGASWGIYVTGSSLIGAAIKAPRITSKNLISVIFCEAVAIYGVIVAIILQTKLEAAKQPFHPDSMRAGYSLFTSGIIVGFANLLCGLCVGLIGSSCALSDAQNSTLFVKILVIEIFGSALGLFGVIVGIIMSSQATWPAAVVA

SEQ ID NO: 28837 - protein, 626 aa, Oryza sativa Japonica Group
MSGVASLGLRSSGSYGSLQQSNGQSPAPAPSPPLAARKAGKMSFGGAGAGGRGLLFARICKLTSRRRRMLLLLLVAAAVLFCFLFSSLVSKDEDAPPGIETMLGISDQVRSFVNPVWTSSGRPITQGDSLNGNGLNTASQTEKQSDSDSSHKKLQGLSWSFPPSIVLEHHPCENFSFFPPPIDRKRTGPRPCPVCYVPVEQALALMPGAPSASPVLRSLNYLSGDNLISKESNHGSLFGGYPSLEERDKSYDIKDSMTVHCGFARGKIPGVNTGFDIDRADLSEMWQCQGIVVASAIFGNYDIMQQPKNISVFSKDTVCFFMFLDEETEAAIKNTTTIDNSKRIGLWRVVVVRNLPYSDARRNGKCLPDLKAIVMLLVKANDAMLNVPKLLLHRLFPNVRYSIWIDGKLKLVRDPYQLLERFLWRKNVSFAISRHYRRFDVFEEAEANKVGGKYDNASIDYQIEFYKREGLTHYSSAKLPITSDVPEGCVIIREHIPITNLFTCLWFNEVDRFTSRDQLSFSTVRDKIRKRVNWTADMFLDCERRDFVVQAYHRELWEQILRSPPPPQPRLVRQQPRKMLPDNTAKEPGKASGSKRVSAKRTRDKKSGSKRAHRSKVTGGKEFIQL

SEQ ID NO: 28838 - protein, 93 aa, Zea mays
VESGVAERPIADLDAYRDSLTRYVYQTGMFMRPVFAAAKRNPARVVYAEVESERVLRAVQAVLAEGMARPILVGRPGVIASRIERAGIRKKPG

SEQ ID NO: 28839 - protein, 87 aa, Cryptococcus gattii
VCPTEILAFNKALDQFAAIGAEVICVSTDSEFTHLAWSQTQRSEGGLGPDLRLTLLADRNHAAAKAYGVLLPEEGVALRGTFFIDPK

SEQ ID NO: 28840 - protein, 410 aa, Psychrobacter arcticus 273-4
MAEIKAPVFPESVADGTIVEWHVTEGQQVNRDDLLAEIETDKVVLEVVAPDNGVVTRIVKQVDDTVLSDELIAEFEAGASASAEAAPAVDPDQPAAPVQPKQATDGGEPAQASAEADHKDQSPAVRKAAKVSGVDPKNVEGSGRGGRVTKTDMSNPTLKADSSITSDSGRPVAEAVGERTEKRVPMTRLRKTIANRLLAASQETAMLTTFNEVNMKPLMDMRTKYKDQFEKRHGTRLGFMSLFVKAATEALKRYPAVNASLDGDDIVYHGYYDIGVAVSSNRGLVVPVLRDTDRMSMADVEAKIREFGGKAQEGKLGLEDMVGGTFTISNGGVFGSLMSTPILNPPQTAILGMHAINDRPMAVNGEVKILPMMYLALSYDHRMIDGKEAVQFLVTLKELVEDPTMLLLDL

SEQ ID NO: 28841 - protein, 483 aa, Psychrobacter arcticus 273-4
MKDSYDLVVIGGGPGGYEAAIRAGQLGMSVACIEKRVYKGEPALGGTCLNVGCIPSKALLDSSHRYEATKHDLAEHGISTGDVAIDIEQMIARKEGIVKQLTGGIAALLKGNGVDWLQGWGTLVDGKGNDKKVKFTALADDSETTITAKNVILAAGSVPIDIPVAKTDGDRIVDSTGALDFTAVPKRLGVIGAGVIGLELGSVWRRLGAEVVVYEALPSFLAAADKDIAKEAGKMLKKQGLDIRVDTKVTNAEVKGDQVIVTSEAKGESSEESFDKLIVCVGRRAYSEKLLGEDSGIQLTERGLIDVNDQCKTNLDGVYAIGDLVRGPMLAHKAMEEGMMAVERIHGDKAQVNYDTIINVIYTHPEIAWVGLTEQEAEAAGYEVKTGSFNLAANGRALAQSEAQGSIKVVADAKTDRLLGMHAISAGAGDIVHQGMIAMEFVSSIEDLQLMTFAHPTISEAVHEAALSADGRAIHAIQRKKRK

SEQ ID NO: 28842 - protein, 388 aa, Psychrobacter arcticus 273-4
MNLHEYQAKELLKSYGLPIQEGLIAYSGDEAAAAFDKTPTDIAVIKAQVHAGGRGKAGGVKLVKTREEAKQVTDELIGTNLVTYQTDAAGQPVNFVLVAEDMYPVQTELYLGAVVDRSSRRVTFMASTEGGVEIEKVAEETPEKIFKVSIDPLVGLLPFQAREVAFKLGLEGKQISQFVKLMTGAYQAFVENDIDLLEINPLAVRENGEIVCVDGKISIDSNALYRLPKIAALQDKSQENERELKAAEFDLNYVALEGNIGCMVNGAGLAMATMDIIKLYGGKPANFLDVGGGATKDRVVEAFKIILEDSSVEGVLINIFGGIVRCDMIAEAIIAAIKEVDVKVPVVVRLEGNNAELGAKILEESGLKLISAQGLSDAAQKIVDAVKA

SEQ ID NO: 28843 - protein, 343 aa, Psychrobacter arcticus 273-4
MKHKILVTGGAGYIGSHTCIALHEAGYDVVIYDNLSNSSREAVNRVSSLIGQPIEFIEGDVRNTESLRQVFAAQPFFGVIHFAGLKAVGESVAKPLMYYDNNVSGTINLLEIMKEHDVKNFVFSSSATVYGDPETLPIDERSKRSCTNPYGQSKLTVEHILEDLAASDKSWSLIPLRYFNPVGAHSSGSIGEDPNDIPNNLMPYISQVAVGKLDKLSIFGNDYATVDGTGVRDFIHVTDLAEGHVAALNYLKQQPQSLGFLPINLGTGKGTSVLELLRAFSVVSGQNIPFQFVDRRAGDIASCYASADKARELLGWQATLSITDMCQDTWRWQSMNPNGYNLV

SEQ ID NO: 28844 - protein, 294 aa, Psychrobacter arcticus 273-4
MKKITHAVIPVAGFGTRMLPLSKSVPKELLPLGNRPAIHYVVEEAIAAGIKHIVLVGHAQKSAIENYFDINAELDNQLRDKGKDELADSLNWLPDDVTISMIRQGQPLGLGHAVLAARPIIGQHDFAVLLPDVVLDPFNGDMSADNLAFMMDAFAKDNHSQILVDKVADEDVHKYGIAQLNEALSGVSSVDNEIDANISFKVAGFVEKPNVVDAPSRLAVVGRYVFSHHIFDYLANTKASVGGEIQLTDAIDALISEYGVNVTTMRGNSYDAGDMRSYMQAFMYFAQQQLADEE

SEQ ID NO: 28845 - protein, 309 aa, Vibrio vulnificus CMCP6
MNHINRVAIIGECMVELKKVNGELQQGFGGDTLNTAVYLSRLTQQSGVSTSYVTGLGQDPFSREMLAAWQDEGINTDMVYLSQDKLPGIYAIETADNGERSFFYWRNDSAAKYWLRDRAILTLAKELCQHQMIYLSGISLAILSQDCREALIKLLALCRSDGVKIAFDNNFRPALWSNVADAQAFYQQILQVTDMAFLTFDDEMLLWGDTHEDQAIERTKGFGVSEIVIKRGGDECFVVTEAGRHAVAPLKIDHVVDTTAAGDSFSAGYLAKRILGGDCQQAAFAGHTVAGHVIQHRGAIIPREAMPTI

SEQ ID NO: 28846 - protein, 483 aa, Magnaporthe grisea 70-15
MEFLTHLAETPSRSTAHGHFQPPLTHNDFQHRITLRTGEKENTQSRQAINNVAVVGAGYSGVVAAAHLSRYGFNVRVFERGSNVGGNWLFDSRVPRDPAFPSDRPETPLQDVTHAPPGPCYAGLRNNVPTTLMRSTIVDWPAGTPEFVTHREVEAYIGSIVDEAGIEDLIELDTAVLHVWKSPSGKWHVRTKGMDDGDGFPESVWTFDAVVAASGHYHVPRVPEIPGLAAWKKLFPQSITHSKQYRGPETSGFAGKNVLIVGAGVVKFEPLDQTPDSQKHLPGAVHLSDGTVLRDIDHVVMATGYITSYPYLGPRMQRPWLELQDARKTNDQEVIVTADGLITHNLHKDIFYIPDPTLAFVGVPYHISTFSFFDVQAQVIARVFSGHAQLPPRADMAAEFARRWVAQDGDEQVDPVSLGKTFHSLYGREDAYTDELVAWVNTQVEAAGGEPMQTLGAAWRTRYRELVETSLVTRKNWSVSKSA

SEQ ID NO: 28847 - protein, 448 aa, Xanthomonas campestris pv. campestris str. ATCC 33913
MRVAIFGTGYVGLVTGTCLAEVGHHVICVDIDQAKVDGLNRGVIPIYEPGLEPMVKANHASGRLRFTTDAAEAIAHGEITFIAVGTPPDEDGSADLQYVLAVARTVGRHIDGPSVIVNKSTVPVGTADKVRAAIQEELDARGVDHEFDVVSNPEFLKEGDAVADCMRPDRIVIGAKKPAAIARMRRLYAPFNRNRDRIVEMDVRSAELTKYAANAMLATKISFMNEIANIAERVGADVEHVRNGIGSDPRIGWHFIYPGAGYGGSCFPKDVQALAKTAQQYGMQPTLLNAVESVNNAQKGHLFELVQRHYADGNGSIAGKTFAVWGLAFKPNTDDMRAASSRRLMAQLWEAGAKVRAYDPEATHEAKRIFGERDDLAFCDDAFAALEGADALVVVTEWKQFRSPDFGKIKQALKDDVVFDGRNLYDPQEIEAAGLAYYAIGRGRSLHA

SEQ ID NO: 28848 - protein, 782 aa, Oryza sativa Japonica Group
MNPSARISQVAMAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIALVSWLGLPYSFTIFNFGAQKTVYNWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 28849 - protein, 157 aa, Wigglesworthia glossinidia endosymbiont of Glossina brevipalpis
MRVGHGFDIHKFGKIYKPLILGGVHIPYCKGVVSHSDGDVIIHSIIDSLLGASSLGDIGILFPNNDIKYKNINSCILLQVVWNCIKKKYKIGNIDVTLFLEYPKISSYTNKICLCISNCLKCKTDVINIKSKTMEGLGEIGKKKGIASEAVSVLLEI

SEQ ID NO: 28850 - protein, 282 aa, Gibberella acuminata
MQQRLRSLKRPLLLAAAATTTVAVGGGYYATRNRTHIVDKPLVPLKRDSTGRIVPPTFSATKSRAEALAELRRSAQPDKDTEYDLLVIGGGATGTGIAIDAITRGLKVALVERDDFSSGTSSKSTKLVHGGVRYLEKAVWNLDYGQLQLVMEALRERKTFLNIAPHLSSSLPILLPLQKWWEAPYFWAGTKAYDLLAGSQGLESSYWMSKNKALEAFPLLRKENMVGALVYYDGQHNDSRMYVALALTASHYGATVLNHVEVTGLDKDANGKIIGAQVRDVL

SEQ ID NO: 28851 - protein, 633 aa, Zea mays
MSGHLDRFARPCFEGRSSHDECRDHKSDFEVSEDEKKTRMGSLKKKAIDASTKIRHSLKKNRRKSGSRVLSVSIEDVRDLEELQAVEAFRQALLLDELLPARHDDYHMMLRFLKARKFDIDKAKQMWMDMLHWRREYGTDTILEDFEYTELDTVLQYYPHGYHGVDKEGRPVYIERLGKVDPSKLMNVTTMDRYVRYHVKEFERSFLIKFPACSVAAKRHIDSSTTILDVQGVGLKNFSKTARELIQRLQKIDNDNYPETLYQMFIVNAGPGFRLLWNTVKSFLDPKTTAKIHVLGNKYQSKLLEIIDASELPEFLGGTCTCPEYGGCLKAEKGPWKDPNILKIVQSGEVHCARQIVTISNGEEKFITYAKPKHHSMRGSDTSTAESGSEADDAISPKALRSYIQHPKLTPVREEVKIVRATSFSTRLPEYDVPVVDKAVDATWRREQPRKIPFMPQDADSSVKTMSRPSDSSWDKIVATLMACLMAIVMLVRSVKDLVTRRLPYKGGSEEIHSTLYPDPIQKEEFRPPSPIPGFAEADLFAVVLQRLGELEEKVQMLQEKPSEMPCEKEELLNAAVRRVDALEAELIVTKKALHEALIRQEELLAYIDRKEIAKAQWSCFLLQRKKKAMLCY

SEQ ID NO: 28852 - protein, 418 aa, Arabidopsis thaliana
MTKKAVLIGINYPGTKAELRGCVNDVRRMYKCLVERYGFSEENITVLIDTDESSTQPTGKNIRRALADLVESADSGDVLVVHYSGHGTRLPAETGEDDDTGFDECIVPCDMNLITDDDFRDLVDKVPPGCRMTIISDSCHSGGLIDEAKEQIGESTKKEAEDEDESEESSSRFGFRKFLRSKVEGAIESRGFHIGGNKKDEDVAEEIETKEIELEDGETIHAKDKSLPLQTLIDILKQQTGNDNIEVGKIRPSLFDAFGDDSSPKVKKFMKVILGKLQAGNGEEGGLMGMLGKLASGFLEGKLNDEDYVKPAMQTHVGSKEEVYAGGSRGSVPLPDSGILISGCQTDQTSADATPAGKPTEAYGAMSNSIQTILEETDGEISNREMVTRARKALKKQGFTQQPGLYCHDGYANAPFIC

SEQ ID NO: 28853 - protein, 329 aa, Wigglesworthia glossinidia endosymbiont of Glossina brevipalpis
MSNFSITVIGAGAYGTALAVSFSKKNRKVFLWGRNKKHMQSLKKDRCNKKFLPKINFPNDLKIEISLKKAIKYSNTIVIAVPSIGFKNILIKIQPFLNKNVFLICGTKGLEPRTGRLLQEVVYDILGRETCLSIISGPSFARYLAIGLPTSMVLANNCIKTCKFLANKLKNKFLNIYSISDLVGVQIGGVIKNVIAIASGMSDGIQMGPNAKTAIITYGLEEMYKLGKVMGANEYTFMGMSGVGDLVLTCTDDESRNRKFGILLAQGYSIENAKSKVGCIIEGYNNIKEILILSCKHKINMPIIKQVYKILYMHQPVKKSILNIFLNKK

SEQ ID NO: 28854 - protein, 301 aa, Clostridium acetobutylicum ATCC 824
MNILVTGGAGFIGSHVVKSLLEHGHKVSVIDNMVHGNSSNLPDEVNIYKYDISEAEIENAFKIERPEVVIHNAAQISVADSVKDPLYDAKVNVLGSINILEMCRKYAVRKVIYPASAAIFGEPKYLPIDEKHPLNMISSYGVSKHTVEHYLNVYKKLYNINYTVLRYSNVYGPGQDSSGEGGVVSIFAEKLTKGEPLCIYGNGNQIRDFVYVKDVTEANILALNSLDNDIYNVSTNTKTTINDLAKLMCEAYGKEVEIMHKGERAGDIFESYMSYDKIYNACGWKPKYDLKLGIKETIQSF

SEQ ID NO: 28855 - protein, 303 aa, Clostridium acetobutylicum ATCC 824
MRVKKAIIPAAGLGTRFLPATKAQPKEMLPIVDKPTIQYIIEEAVQSGIEEILVITGRNKRAIEDHFDKSFELESELESHNKKELLKVVKDISNLANIYYIRQKEPRGLGHAINCARTFVGNEPFAVLLGDDVVNAKVPCLKQLINCYNEYKTSILGVQRVPNSEVSKYGIVNGMHIEDGVYKVKDLVEKPKQEEAPSDLAILGRYIITPSIFDILDNTKPGKGDEIQLTDALKTLMKTEAMYAYVFSGRRYDVGDKLGFLQATVEYALKREELKKPFMNYLFTIKDNPNFKSLYDELNKKSK

SEQ ID NO: 28856 - protein, 555 aa, Psychrobacter arcticus 273-4
MNDTKDNKVYSSARHSKYWQQLQTLAESPWSLAALFAQDNTRTQHFSMQAGALYMDYSKQCIDDAVLENLLNLANSCELAARIQSLLQGAMVNTSEERAALHTALRLPATASLQLDTQDVVADVHQSLLQVERLSERVRSGTWRGFSGQAITDVVNIGVGGSDLGPLMATTALDEWADTCVEVHFVSNMDGTQLDNLLKHLNPETTLFIISSKSFGTVDTLSNAKTALSWLLATAKLRAGTEDSVRRRHFIGISANGQKMSAWGIHPEHQLQLWEWVGGRFSLWSAIGLAIAIRIGMSGFKELLAGAHSMDDHFAQADFAKNVPVLLGLIAVWNSTFLQVNAHTVLPYDGRLSYLPSYLTQLEMESNGKSVTQHGDRIDYDTCPILWGEIGSNAQHAFYQLLHQGTQQVSCDFIACVRRYSDEAKNTPLQQQHELSLANCLAQSRVLAFGNAAIAESDGQVACDADKYKYYRGNQPSTTLLLDELTPHSLGALIALYEHKVYVMASIWDINPFDQWGVEMGKQMAESVHDAMQQERGAQFDTSTNQLLKHIKELS

SEQ ID NO: 28857 - protein, 224 aa, Zea mays
MPKPHSEAGTAFIQTQQLHAAMADTFLEHMCRLDIDSAPITARNTGIICTIGPASRSVEMLKEMIKSGMNVARLNFSHGTHEYHAETIKNVREATESFASDPILYRPVAVALDTKGPEIRTGLIKGSGTAEVELKKGATLKITLDNAYMEKCDENILWLDYKNICKVVEVGSKIYVDDGLISLQVKEKGADFLVTEVENGGSLGSKKGVNLPAAAVDLPAVSEK

SEQ ID NO: 28858 - protein, 476 aa, Psychrobacter arcticus 273-4
MSTDAMDKNIPQSEPNSLSHLARESAVCVLIGHSIEAVTSAVVLASLGQRVHLYADKELLAQQLQQYSFEHHLQALWQMYTQQHHIMSYALPNAADKLIQCYETANHNNSLFTNESQEINESQEINEPKTVALYWLFLDSIDSVWIEDDWLTAFNHSHQQAQPLMMSGIKQLGTIAALSQRLKRAWVYYLPFVFLKDGDAYSSMLNPSLWLLGEKTPNSRHHLGMLQPLMQHARATHYADIATIEFARSSIMAMLATRVSFMNEMSRLADSQKVDIQQVSHIMGLDERVGNSYLQAGWGFGGHTLPAELLMLQQSSNEQSLAMRLLQSVIHINEDQKELIFRKFWQYFDGFIDNKTVMIWGGSYKAGSGRTAGSAIHPLLALLWSYNIRTLVYSDKAQTELAALYGQQPLLELMDSPYQQLDKAQAVFIVSWSPEDQLDVTSLNQQAIPVFDAQNVLTSLQIDSLVGDYMGIGRAK

SEQ ID NO: 28859 - protein, 653 aa, Salmonella enterica subsp. enterica serovar Paratyphi B str.
MNRFIMANSQQCLGCHACEVACVMAHNDERHVLTSQRYQPRITVIKHQHQRSAVTCHHCEDAPCARSCPNGAIAHINDSVQVNAQKCIGCKSCVVACPFGTMQMVLTPVAPNQFKASAHKCDLCQGREQGPACVENCPADALQLVTEDSLTRLAKTRRLRTARQEIRPWHTVDTQHSGTASSKVERMQATPPRGEPDKLAIEARKTTFEEIYLPFRAAQAEREAARCLTCGEHSICEWTCPLHNHIPQWIELVKAGDIDAAVELSHQTNCLPEITGRVCPQDRLCEGACTLRDEYGAVTIGNIERYISDRALSKGWRPDLSDVQKSDKRVAIIGAGPAGLACADVLARHGVSATVYDRHPEIGGLLTFGIPAFKLDKSLLARRREIFSAMGIRFELNCEVGKDISLETLLESYDAVFVGVGTYRSMKADLPNEDAPGVYDALPFLIANTKQVMGLPALPDEPFIDTAGLNVVVLGGGDTAMDCVRTALRHGAANVTCAYRRDEANMPGSKKEVKNAREEGANFEFNVQPVELVLDTHGRASGIRFLRTRLGEPDGQGRRRPVPVPDSEFVMPADAVIMAFGFHPHGMSWLESHGVKVDNWGRIAASVESEFRYQTSNPKIFAGGDAVRGADLVVTAMAEGRHAAQGILDWLAK

SEQ ID NO: 28860 - protein, 268 aa, Oryza sativa Japonica Group
GADGKLSRRYAAAPVCKWLTPNEDGVSMAALALMNQDKVLMESWYYLKDAVLDGGIPFNKAYGMTAFEYHGTDARFNRVFNEGMKNHSVIITKKLLDLYTGFDAASTVVDVGGGVGATVAAVVSRHPHIRGINYDLPHVISEAPPFPGVEHVGGDMFASVPRGGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 28861 - protein, 587 aa, Candida albicans SC5314
MAKKKSTGPQPSLSSSPNGRAKVTAETITTTTTTTTDTTNSYSLLNIWVISLALKILLFIGYHSTDFDVHRNWLAITNKLPISQWYIENTSQWTLDYPPFFAYFEYLLSLLVPRFVANDGCLDIVEIGQYGLPTIYFQRLTVIISELVLFYALQTIVKTSPTLSAKRRMYVATASLALSPGLILIDHIHFQYNGMMYGILLLCINSARLQQYLLCGFWFSVLLCFKHIYLYLAPAVFIFLLRGYCLKFNWNKRKNFFINIFNFIQWINLFKLGSIVILVFIIAFGPFYNVLPQLISRLFPFSRGLTHAYWAPNIWAVYSFLDRILIQIYKKIPMSKYPLLKIFQFDPNSLNNDQLLKTSTRGIVGDIEFFILPNITPKLTFLLTLFYQIMALIPLFIQPTYRRFVGALTLCGYASFLFGWHVHEKAILLVIFPMTLLVARDQKLLTPFNLLVSCGYGSLFPLIFTCNEWLIKVVYTYTWYIIFYFNFRKVVRPSKNNIIGNGIGNGNGKGGGIILDRMVNLYILLFNVVVIITSLFDLFKHKYPVLQNFEFLNLMIYSVYCAIGIISSWNGFCWLYFIDDGIWNQDQ

SEQ ID NO: 28862 - protein, 308 aa, Brucella suis 1330
MILCCGEALIDMLPRETTGGETAFQPFAGGSVFNTAIALGRLGVPTGFFSGISSDFFGDVLRDTLARSNVDYSFAAISNRPTTLAFVRLVDGQARYAFYDENTAGRMLSRNDMPYVDETISAMLFGCISLISEPCGSVYETLLAREAPNRVMFLDPNIRANLITVRETHLTRMKRMIALADIVKLSDEDLDWFGEKGSHDEIAAEWLKLGPKLVVITKGAHGAVVYTNHATVPVPGVKVDVVDTVGAGDTVNAGILASLHSQGLLTKDALANLSEDQIHSAVALGVRAAAVTVSRAGANPPWAHEMRD

SEQ ID NO: 28863 - protein, 611 aa, Pseudomonas aeruginosa UCBPP-PA14
MDQNAILLALGGIGAAALLSQWLAWRLRLPAILFLLLSGIVAGPLLGWLDPDEMFGPLLFPLVSLAVALILFEGSLTLHFSEWKEIGTVVHRMVTIGALSTWGVIALAAHYLLDFSWEMALLFGTLTLVTGPTVIVPMLRVVRPKAAVANILRWEGIVIDPIGALLAVVVYSFIISSGEGEGWLHSLQTFGGVILCGSLFGILGGWALGIVLRRHWLPDYLHNLATLAAVLGVFIASNRVMHESGLLAVTLMGMGLANMKGVDVRQILHFKENLSVLLISGLFILLAARLDINALLGLGPAALLVLLLIQFVARPLNVALSTWGSPLSWRERALLSWIAPRGIVAAAVSAIFAIRLSAEGHAQAALLVPLTFLVIIGTVVLQSATARPLARLLKVAEPSPSGYLIVGANPVGRAIGKALKSLGSRVLLTDSSWENIRAARMDNLPTYFGNPTSQHAEAHLDLVGIGHLLGVSPAGELNTLAAMRFRHEFGHRQLFGLPTSQEAKRTDKHRSSDEHRGRPLGQRPLTYAQFASLLSRGAEIRTTLLTDTFGWNDYQALHGESATLLFARDPNGRMHVATPQSTLAPGTGWTLLSLIEAEPSVSKSQATEIAD

SEQ ID NO: 28864 - protein, 301 aa, Arabidopsis thaliana
MKLNEEYVKFLGEGAYSFVDLFKYTKSDGSSFHAAVKSSDDENSLLKEFHILSELKGCPRIIQCFGNDLEEGFDDKGNRVYKLLLEYASEGSLSDFMNNCVDRKLPDLMIRDFTRMILQGLVSIHSHGYVHCDLKPENVLVFPCGDSYEVKISDFGLSLQVGEVPDHWKIEYPFVGTLNYMPPESLHDGVANKTLDLWSLGCLVLEMYVCKKPWIGFIPEDFVYILSNGNPPEIPESLPCDARAFIQKCFSRNPKERGTASELLSHRFLRQEKSKLKMISPFNLLKFKKFLNKLLRLKNFL

SEQ ID NO: 28865 - protein, 380 aa, Vibrio sp. Ex25
MKNISKLLVGFSFALPVLFLLLSKAGTADTMDKMKTSENAEIAILAGGCFWCTESDLEQLTGVVDVVSGYSGGHVENPTYRQVSSGKSGHIEVIEVKYDPKVVSYEQVLDYFFRHIDPTDDKGSFVDRGPQYRPAIFYHNAEQKQIAEQFIMEIDKAMIYPKPLKTELIEFEKFYPAEEYHQDYYKKSSLKYKYYRYASGRDKYLDEVFGDDRKEPPKTLRQLIEEKKLLSKVKEYSKPAKSEIKSNLTELQYYVTQEEGTERPFDNEYWDNKEAGIYVDIVTGEPLFSSTDKYKSGTGWPSFTKPINPGYIVEKTDYKLIYPRTEVRSKFGDSHLGHVFKDGPKPTGLRYCMNSAAMKFVPVSEMKTQGYEEYLYLFDK

SEQ ID NO: 28866 - protein, 495 aa, Candida albicans SC5314
MTTNPALAAAQASHNNIPTKQMNHSTSSSNGNGSNNSSVVGLHYKIGKKIGEGSFGVIFEGTNIINGVPVAIKFEPRKTEAPQLRDEYRTYKHLQGCDGIPNAYYFGQEGLHNILVIDLLGPSLEDLFDWCGRRFSVKTVVQVAIQMLTLVEEVHRHDLIYRDIKPDNFLIGRRGATDENNVHLIDFGMAKQYRDPRTKQHIPYREKKSLSGTARYMSINTHLGREQSRRDDLEALGHVFFYFLRGQLPWQGLKAPTNKQKYEKIGDKKRTTPAVTLCDGLPQQFAEYLDSVRSLPFDAEPPYEEYRMLLLSVLDDLGQACDGDMDWMHLNGGRGWDATINKKPNLHGYGHPNPPNERERRHRDQRRTRQHQQSQQVQQQQLQAQAQAQQLQQLQQAQQAQQQQQSQQHQPLSAAQLHQQKLQHLVNRPLPPIKQESQSAIQSGNGHHELLNNNLGDQHGGKHEGYSSRPDQYQQQQMVAEEEENKGFWSKLCCH

SEQ ID NO: 28867 - protein, 255 aa, Saccharomyces cerevisiae YJM789
MGLFANVRPVKSVEGEKGKPIDMVIVRENTEDLYIKIEKTYIDKATGTRVADATKRISEIATRRIATIALDIALKRLQTRGQATLTVTHKSNVLSQSDGLFREICKEVYESNKDKYGQIKYNEQIVDSMVYRLFREPQCFDVIVAPNLYGDILSDGAAALVGSLGVVPSANVGPEIVIGEPCHGSAPDIAGKGIANPIATIRSTALMLEFLGHNEAAQDIYKAIDANLREGSIKTPDLGGKASTQQVVDDVLSRL

SEQ ID NO: 28868 - protein, 501 aa, Nostoc punctiforme PCC 73102
MKTHLPQIHNPNGVILAMHLNELETTENLKEVEEAWLTLEKSILYYQGRPVGTVAAYDASVEALNYDQCFVRDFVSSALIFLIKGRTDIVRNFLEETLKLQPKEKALDAYKPGRGLIPASFKVVSENGQEYLEADFGEHAIARVTPVDSCLWWIILLRAYVVATEDFSLAYQPEFQNGIRLIMEICLANRFDMYPTLLVPDGACMIDRRLGIYGHPLELQVLFYTALRASRELLVCQGNSDIVAAIDNRLPLLCAHIRQHYWIDINRLNEIYRFKSEEYGKGAVNLFNIYVDSVPYYELDKWLPKKGGYLAGNVGPSQLDTRFFSLGNLMAIISDLATEEQAQAIMTLIEDRWDDLVGDMPMKICFPALEHEEYRIVTGCDPKNIPWSYHNAGSWPVLMWMLAAAAVKTNKISLAQKAIQTAQGRLSTDQWPEYYDGKKGRLIGKQARKYQTWTITGFLLAKELMANPTYLPLISFGKLPAEQVSRACEFEIASVDPYMPR

SEQ ID NO: 28869 - protein, 352 aa, Xanthomonas campestris pv. campestris str. ATCC 33913
MLPVHRVLRHLGLASARRTGGGARMSAAKNQVVCFGEALIDMLALPPAGPDEARTFAQYAGGAPANVAVAVARLGGAAHFVGMLGRDMFGDFLLESLQQAGVVTDGIVRTDEAKTALAFVALDAAGERSFSFYRPPAADLLFRAEHFAADGFAQAAVLHVCSNSMTEPAIARCTLDGMRRARADGAIVSLDLNLRPMLWPQDVDPAPLLWEALALADVVKLSREELDYLAGTLDSDASAVTQKLWQGHARWLLVTDGGGPVHWQTRVDSGQVPAFHVQVRDSTAAGDAFVGGLLFQLAARASTLEQLCADPAAIAEVIRFAAAVGALAVTRKGAFAAMPSVDEVHSLIQEQS

SEQ ID NO: 28870 - protein, 406 aa, Yarrowia lipolytica CLIB122
MAEQIEKKVVDLLVDNAENDAADAVVQAAAGLAEKAAEGIVNAVKGPIEEAIEAPVAGEEKESKEESKEESKEESKGESKGESKEDFKEESKEAAPATEEKPAAESKAETKEEPKTEEPAAPAKPKEPVTDAEAPILKQVEFYFSDQNLPTDKFLWKAVHSNDGWVPIHTIASFKRMQQFANPEAEDPLAVIVSALRKSPSLLEVSEDGTKVKRVKALQAPDDKSKDEANARTVYAKGFLPEDKVPTKDTPASELGAPLTREEELALQIEIEKFFEGYGKIVQVRLRRRTEQQNRFKGSVFAEFEKLEDATKFLALDPKPTFQGRELKTMSKPAYCEMKKAELGFTDGANGKRGPRKFNGFKDNESRKRGNDDDDNGDNKRQRGNPRRGRGGRGRGRGGRGRGGRD

SEQ ID NO: 28871 - protein, 178 aa, Hordeum vulgare
MANKHLSLSLFLVLLGLSASLASGQVLFQGFNWESWKHNGGWYNFLMGKVDDIAAAGITHVWLPPASQSVAEQGYMPGRLYDLDASKYGNKAQLKSLIGALHGKGVKAIADIVINHRTAEHKDGRGIYCIFEGGTPDARLDWGPHMICRDDRPYADGTGNPDTGADFGAAPDIDHLNL

SEQ ID NO: 28872 - protein, 148 aa, Pisum sativum
MASKRILKELKDLQKDPPTSCSAGPVAEDMFHWQATIVGPADSPYAGGVFLVTIHFPPDYPFKPPKVAFRTKVFHPNINSNGSICLDILKEQWSPALTISKVLLSICSLLTDPNPDDPLVPEIAHMYKTDRTKYEATARSWTQKYAMG

SEQ ID NO: 28873 - protein, 517 aa, Sorghum bicolor
MDVPLPLLLGSLAVSVVVWCLLLRRGGDGKGKGKRPMPPGPRGWPVLGNLPQLGSHPHHTMCALAKKYGPLFRLRFGSAEVVVAASARVAAQFLRTHDANFSNRPPNSGAEHVAYNYQDMAFAPYGSRWRALRKLCALHLFSAKALDDLRSIREGEVALLVRELSRFQHQHAGVPLFQVANVCATNTLARATVGRRVFAVDGGEEAREFKDMVVELMQLAGVFNVGDFVPALARLDLQGVVGKMKRLHRRYDDMMNGIIRERKAAEEGKDLLSVLLARTREQQSIADGEDSRITETEIKALLLNLFTAGTDTTSSTVEWALAELIRHPDVLKKAQEELDAVVGRNRLVSELDLPRLTYLTAVIKETFRMHPSTPLSLPRIAAEECEVDGFRIPAGTTLLVNVWAIARDPEAWPEPLQFRPDRFLPGGSHAGVDVKGSDFELIPFGAGRRICAGLSWGLRMVTLMTATLVHALDWDLADGMTADKLDMEEAYGLTLQRAVPLKVRPAPRLLPSAYAAE

SEQ ID NO: 28874 - protein, 577 aa, Oryza sativa Japonica Group
MACIIFQKEIIQSLTVSPPRRTATASSTPSPSPCSGAPVAAPSRRSRRVTRLGSRATPPSPRPRRPERVTIADSDLSSSTPNKGGNKPKVRRVQSAGLLADSVLKRDSERLKDLYTLGKKLGQGQFGTTYQCVEKATGKVLACKSIAKRKLVSEEDVEDVRREIQIMHHLAGHPSVVSIVGAYEDAVAVHLVMELCAGGELFDRIVQRGHYSEKAAAQLARVIIGVVEACHSLGVMHRDLKPENFLFVNHKEDSPLKTIDFGLSIFFKPGENYSDVVGSPYYVAPEVLMKHYGREVDVWSAGVIIYILLSGVPPFWDESEQGIFEKVLKGDLDFSSDPWPAISDSAKDLVRKMLNRDPRKRLTAHEALCHPWVCVDGVAPDKPLDSAVLTRLKQFSAMNKLKKMALRVIAENLSEDEIAGLREMFKMLDTDNSGQITLEELKTGLRRVGANLKDSEITTLMEAADIDNSGSIDYGEFIAATMHLNKVEREDNLFAAFSYFDKDSSGYITQDELQKACEEFGIGDAHLEDIIKDIDQDNDGRIDYNEFVTMMQKGNNPLGKKGQGQLSFGLREALKLG

SEQ ID NO: 28875 - protein, 363 aa, Oryza sativa
  misc_feature (332)..(332): Xaa can be any naturally occurring amino acid
MGIYLSTPKTDKFSEDGENDKLKLGLSSMQGWRANMEDAHSALLNLDNETSFLGVFDGHGGRVVAKFCAKYLRSQVLRSEAYSAGDLGTAVHRAFFRMDEMMRGQRGWRELSALGDKINKIGGMIEGLIWSPRGSDSNNGQDDWSFEEGPHSDFAGPTCGCTACVALIRNNQLVVANAGDSRCVISRAGQAYNLSRDHKPELEAERDRIVKAGGFIHMGRINGSLNLTRAIGDMEFKQNKFLPPEKQIVTANPDINVVELCDDDDFLVLACDGIWDCMSSQQLVDFIHEHIQKESSLSAVCERVLDRCLAPSTIGGEGCDNMTMVLVQFKKXPITQNKKADVGEQSVKGVEEAEINAAEENGS

SEQ ID NO: 28876 - protein, 411 aa, Arabidopsis thaliana
MNALAATNRNFRHASRILGLDSKIERSLMIPFREIKVECTIPKDDGTLVSYIGFRVQHDNARGPMKGGIRYHPEVDPDEVNALAQLMTWKTAVADIPYGGAKGGIGCSPRDLSLSELERLTRVFTQKIHDLIGIHTDVPAPDMGTNAQTMAWILDEYSKFHGHSPAVVTGKPIDLGGSLGREAATGRGVVFATEALLAEYGKSIQGLTFVIQGFGNVGTWAAKLIHEKGGKVVAVSDITGAIRNPEGIDINALIKHKDATGSLNDFNGGDAMNSDELLIHECDVLIPCALGGVLNKENAGDVKAKFIVEAANHPTDPDADEILSKKGVIILPDIYANAGGVTVSYFEWVQNIQGFMWEEEKVNLELQKYMTRAFHNIKTMCHTHSCNLRMGAFTLGVNRVARATQLRGWEA

SEQ ID NO: 28877 - protein, 102 aa, Chlamydia muridarum Nigg
MVQIVSQDNFADSIASGLVLVDFFAEWCGPCKMLTPVLEALAAELPYVTILKLDIDASPRPAEQFGVSSIPTLILFKDGKEVERSVGLKDKDSLVKLISKHQ

SEQ ID NO: 28878 - protein, 218 aa, Brassica napus
  misc_feature (25)..(25): Xaa can be any naturally occurring amino acid
MGRAKKPQKFAVMKKTISHKALKQXVKRLIESLYFFINAALFVFFSYKEEVLNPNKKDLTELPRNVPNVPSGMFFSHNTNMVPPYRVLVDTNFINFSIQNKIDIEQGMMFCLNAKCTPCITDCVMAELEKLGQKYRVALRIAKDPRFERLPCVHKGTYADDCLVDRVTQHKCFMVATCDRDLKRRIRKVPGVPIMYLAGRKYSVERLPEATLGRAPRS

SEQ ID NO: 28879 - protein, 219 aa, Triticum aestivum
RSPGRPTRPPTRPRTRGVKFGHVTFFWNGNRSGYFNPNLERYEEIPSDTGIPFNVQPRMKAVEVAEKARDAILSGKFDQVRVNIPNADMVGHTGDLEATIVGCKAADEAVKIILDAIEQVGGIFVVTADHGNAEDMVKRDKSGKPIRDKDGNVQPLTSHTLNPVPIAIGGPGLAPGATFREDLPDAGLANVAATLINLHGFEAPHHYEPTLIQVSPVPF

SEQ ID NO: 28880 - protein, 338 aa, Salmonella enterica subsp. enterica serovar Paratyphi B str.
MIIERARELAVRAPARVVFPDALDERVLKAAHYLQQYGLARPVLVASPFALRQFALSHRMAMDGIQVIDPHSNLSMRQRFAQRWLARAGEKTPPDAVEKLSDPLMFAAAMVSAGEADVCIAGNLSSTANVLRAGLRVIGLQPGCKTLSSIFLMLPQYAGPALGFADCSVVPQPTAAQLADIALASADTWRAITGEEPRVAMLSFSSNGSARHPNVANVQQATELVRERAPQLLVDGELQFDAAFVPEVAAQKAPDSPLQGRANVMIFPSLEAGNIGYKIAQRLGGYRAVGPLIQGLAAPMHDLSRGCSVQEIIELALVAAVPRQADVSRERSLHTLVE

SEQ ID NO: 28881 - protein, 267 aa, Nostoc punctiforme PCC 73102
MIKNKTFNSAGKLTALLFLITLFLTPCVIVNAGERGVLMKFGEVQNQILGEGLHLIIPVVNTVKKLSIRVQKQEISAEASSKDLQNVFADVALNWHIIPQEANVIFQEIGDEQAVVMRIINPAVEEVLKAVIAKYTAEEIITKRGEVKGAVDDALSTRLGNYHVAVDDISLVHVHFSERFGEAVEAKQIAEQEAKRAEFIALRATKEAEAKVNLAKGEAEAHRLLRDGLTPEILQRQAIEKWNGKLPLIVNKEAPKLLNLSEFLKFD

SEQ ID NO: 28882 - protein, 254 aa, Acinetobacter sp. ADP1
MRIAGRLAAEVLDMIKPHIQLGVSTLELDRICHDHIVNAQQAIPACLGYGAAPGRPAFQHTICTSVNHVVCHGIPSSEKILKKGDILNIDVTVIKDGYHGDTNMMYVVGGETSILANRLCNVAQEAMYRGMETVRAGSFIGDIGYAIQKYVESERFSVVREYCGHGIGTVFHDEPQVLHYGQKGTGMQLEAGMTFTIEPMVNAGVWQTKLLGDKWTVVTKDHKLSAQFEHTILVTETGLEVLTARPEEDLSRFM

SEQ ID NO: 28883 - protein, 411 aa, Lupinus luteus
MNALAATNRNFKLASRLLRLDSKLEKSLLIPFREIKVECSIPKDDGTLATYVGFRIQHDNARGPMKGGIRYHPEVNTDEVNALAQLMTWKTAVANIPYGGAKGGIGCDPAELSNSELERLTRVFTQKIHDLIGVQIDVPAPDMGTGPQTMAWILDEYSKFHGHSPAVVTGKPIELGGSLGRDAATGRGVLFATETLLNEHGKSISGQRFVIQGFGNVGSWAAQLISEKGGIVVAVSDITGAIKNSKGLDIPSLIKHSKEHKGVKGFHGGDPIDPKSIFSEDCDVLVPAALGGVINRENANDIKAKFIVEAANHPTDPEADEILKKKGVVILPDIFANSGGVTVSYFEWVQNIQGFMWDEEKVNNELKRYMTKGFKDVKEMCKTHDCDLRMGAFTLAVNRVARATVLRGWEA

SEQ ID NO: 28884 - protein, 244 aa, Nostoc punctiforme PCC 73102
MVANRRGQRVPNVTFHTRKDNQWVDVTTDQLFANKTVVVFSLPGAYTPTCSSTHLPGYNELAGIFKENGVDDIICISVNDAFVMNEWSKDQEAENITLIPDGNGEFTEGMGMLVDKSDLGFGKRSWRYSMLVRDGVINQMFIEPDEPGDPFKVSDAETMLRYINPQAVKPEVVSLFAKVGCPFCARAKAMLKEHGINYEEITLGKDITTRSLRAVTGATTVPQVFIDGKLIGGSEALEAYFAAK

SEQ ID NO: 28885 - protein, 471 aa, Acinetobacter sp. ADP1
MPRKKEVVSGNFVRYDAVILGSGPAGEGAAMKLAKSGKRVAIVDIREQLGGNCAHVGTIPSKALRQTVSSIIRYQRDPMFQKVGEWKKFTMKQVLSHAHRVIQQQVATHTRFYDRNNIDVFYGRAYIQDQNTVLVFTPEGIKESIIFEQLVIATGSRPYQPQGLDFKHKRVFDSDKILDLDYPIHKIIIYGAGVIGCEYASIFIGLNHKVDLINTQHKLLSYLDDEIADALSYHLREQGVLIRHNEQIDHLETHDDYVVLHLQSGKKIKADAILWCNGRSGNTDGLGLENVGLKPNGRGQLAVNEKYQTEVENIYAAGDVVGWPSLASAAYDQGRCAGANMSGEENVKPVTDIPTGIYTIPEISCFGKTEQQLTEEKIPYEVGQSSFRHLARAQITGDTVGELKILFHRDTLEILGIHCFGNNASEIIHIGQAVMQSPNNSLKYFMETTFNYPTMAEAYRVAALNGLNRLF

SEQ ID NO: 28886 - protein, 679 aa, Thiobacillus denitrificans ATCC 25259
MNEGLLFALVAAGLALLYGIISIKWILALPSGNDRMREIAAAVQEGASAYLNRQYTTIGIVGVILLIAIFLSLGWQTAVGFALGAVLSGLTGYIGMNVSVRANVRTAQAATNGLNAALNVAFKGGAITGLLVVGLGLLGVAGYYAVLTLVLGESTEAATHALVGLAFGGSLISIFARLGGGIFTKGADVGADLVGKVEAGIPEDDPRNPAVIADNVGDNVGDCAGMAADLFETYAVTIIATMLLGGLLITGSPEAVIYPLVLGGFSIIASVIGTFFVKAREGGKIMNALYRGLIVSGVLAAIAFYPITTWMMGEGVTIGGELVTSLNLYFASLIGLALTAAMVWITEYYTATEFSPVRHIAQASTTGHGTNVIAGLGVSMKSTAAPVLAVCAAIWGAYELAGLYGIAIAATSMLSMAGIIVALDAYGPITDNAGGIAEMAGLPDSIRDITDPLDAVGNTTKAVTKGYAIGSAGLAALVLFADYTHALSTHGGPALSFDLSNHMVIIGLFIGGMVPYLFGAMGMEAVGRAAGSVVVEVRRQFKSIPGIMEGTGKPEYGTCVDMLTKAAIKEMIVPSLLPVAVPIIVGLALGPQALGGVLVGTIITGIFVAISMTTGGGAWDNAKKYIEEGNHGGKGSEAHKAAVTGDTVGDPYKDTAGPAVNPLIKIINIVALLIVPLIM

SEQ ID NO: 28887 - protein, 212 aa, Physcomitrella patens subsp. patens
MRSSGVARAKGRPSGNGKPSSSFHIEQQIRQLELDAYLSLLRAFSAQSEVITWSKEGLMSDMRKELRVADEQHREMLGKVGQDETLQRIRTWRQTGEDPGMVAHHREPSPSPSVSQNRKKQKAAPHLALPSASGGRGPNHKGAGPSTDSRVEAWVGRRLRIRWPDDNIHYEAVVVDFNREEMLHCLAYDSGTPDESFEWVDLKGMDKNDVQW

SEQ ID NO: 28888 - protein, 731 aa, Pyrobaculum aerophilum str. IM2
MSDWIELRVQESKARDANRPVVRIDPEVMERAGIVVGDVVEIVGRRRTAAKVWNGLPEDRGKGVIRMNSILRKNADVSLNETVKVRRVEPKPAAFVKLAPVSMTIAVDANFLQYIKQRLREYVLVEGDMLQIHVLSQPLTFQVVQTKPSNTVLIITEDTQIQIFEKPVSGVKIPHVTWEDIGDLEDAKQKIRELVELPLRHPELFKHLGIEPPKGILLIGPPGTGKTLLAKAVANEANAYFVAINGPEIMSKYYGESEARLREIFEEAKKNAPAIIFIDEIDAIAPKREEVTGEVEKRVVAQLLTLMDGLQERGQVIVIGATNRPDAVDPALRRPGRFDREIWINPPDFKGRYEILLIHTRNMPLAPDVDLRKLAEMTHGFSGADLAALAREAAMSALRRAIQSGLIDLNQPSIPPEVFEKIKVTMTDFTSALREIVPSALREIHIEVPRVRWEDVGGLENVKQELREAVEWPLKYPDKFKKFGLRPPKGILLFGPPGTGKTLLAKAVATESGANFIAVRGPEIFSKWVGESEKMVREIFRKARMAAPAVVFIDEIDALATARGLGGDSLVTERVVAQLLAEMDGIKALENVVVIAATNRPDLVDPALLRPGRFDRIIYVPPPDFKARLDILLIHTRSTPLAKDVDLEELARRTEGYSGADLELLVREATFLALREDINAKEVSMRHFEEAMKKVRPSITPDMLKFYESWLEKARQLTVSAKAKATPPLYL

SEQ ID NO: 28889 - protein, 278 aa, Chlamydomonas reinhardtii
PVRWRKGEGIGSGSFGQVYLALNCDTGDLLAVKEVPAGLAGGDGGGAGGGGREAVAQLEREVALLSALRHPNIVRYVGTQRSGAGGGGGGGGGAPLYIFLEYVPGGSLSSQLARFGPLPEPLVALYTRQLLLGLAYLHAQRTVHRDVKGANLLLEKTGVLKLADFGMAKQLMEQVSFTRSFKGSAYWMAPEVIKQQGYGVQADIWSVGCTVLEMATGKPPWSQCTSQVQAIFKIASSPDLPAIPDHLSPQASEFILLCLQRDPSSRPTAEELLRHPFV

SEQ ID NO: 28890 - protein, 486 aa, Deinococcus radiodurans R1
MGRSISTSRCSRREVAMNPVLRSAAVLSLTAVLAACGQTTPPIAAVSQTAPTPQITQAGQPQDSYAARRAALPAQAPEPLSGQLGASSLQQTYPGGQPLHAQVLNKSVPLILVHGLMGWGTDEMMGMPYWGGLYNVVGDLRGQGYTVSAASVGPISSNWERAAELFAQIKGGCVDYGAAYSARYGFNRFDKAKCYPGIYPQWDAAHPINLLGHSMGGQTSRMLVKLLEDGSPADADGNNLFRGGRVGWVKAVITVSTPNSGTPATDNLQAMVPVLKDLLKNAAAGLGVSSQSMVYDFDLGQWGLRRQAGESFDAYFDRVMASHFGKNDSNAAYDLSSDGSAELNQFIGRSTHTIYASWATSATSKGLVTGWAYPMPVMFAPLSALAWPYPWPMRQTIGNMTGSSPLGKVQYDASWWENDGLVPVKSQGAPLGQSEVAYAGGPVQPGQWYDLGKLSGWDHTAIVGIPGLQDVRPFYRNQAAWLASLP

SEQ ID NO: 28891 - protein, 162 aa, Brassica napus
  misc_feature (4)..(4): Xaa can be any naturally occurring amino acid
  misc_feature (11)..(11): Xaa can be any naturally occurring amino acid
  misc_feature (14)..(15): Xaa can be any naturally occurring amino acid
  misc_feature (21)..(21): Xaa can be any naturally occurring amino acid
  misc_feature (27)..(27): Xaa can be any naturally occurring amino acid
  misc_feature (39)..(39): Xaa can be any naturally occurring amino acid
  misc_feature (51)..(53): Xaa can be any naturally occurring amino acid
  misc_feature (56)..(57): Xaa can be any naturally occurring amino acid
  misc_feature (60)..(60): Xaa can be any naturally occurring amino acid
  misc_feature (63)..(64): Xaa can be any naturally occurring amino acid
  misc_feature (66)..(66): Xaa can be any naturally occurring amino acid
  misc_feature (86)..(86): Xaa can be any naturally occurring amino acid
  misc_feature (94)..(94): Xaa can be any naturally occurring amino acid
  misc_feature (99)..(99): Xaa can be any naturally occurring amino acid
  misc_feature (103)..(105): Xaa can be any naturally occurring amino acid
  misc_feature (109)..(109): Xaa can be any naturally occurring amino acid
  misc_feature (112)..(113): Xaa can be any naturally occurring amino acid
  misc_feature (115)..(118): Xaa can be any naturally occurring amino acid
  misc_feature (120)..(123): Xaa can be any naturally occurring amino acid
  misc_feature (127)..(128): Xaa can be any naturally occurring amino acid
  misc_feature (131)..(133): Xaa can be any naturally occurring amino acid
  misc_feature (135)..(136): Xaa can be any naturally occurring amino acid
  misc_feature (138)..(138): Xaa can be any naturally occurring amino acid
  misc_feature (140)..(140): Xaa can be any naturally occurring amino acid
  misc_feature (142)..(142): Xaa can be any naturally occurring amino acid
  misc_feature (145)..(145): Xaa can be any naturally occurring amino acid
  misc_feature (147)..(147): Xaa can be any naturally occurring amino acid
  misc_feature (149)..(151): Xaa can be any naturally occurring amino acid
  misc_feature (153)..(153): Xaa can be any naturally occurring amino acid
  misc_feature (155)..(155): Xaa can be any naturally occurring amino acid
MQAXIRSFGSXGNXXRSSLLXHLRVVXPAIQPSVLSTRXESTQPARMEEHXXXSTXXSDXMNXXGXSADGSWLWCTTDDSGYDAAXSMTQHNVXALDDXKPGXXXPRAXIIXXRXXXXKXXXXGTSXXNYXXXGXXWXAXNXVIXGXQXXXVXAXKTLHRGR

SEQ ID NO: 28892 - protein, 222 aa, Acidithiobacillus thiooxidans
MNLHEYQAKRLLAEEGIPVPRAIPAFSVREAVNQARELGGPAWVVKAQVHAGGRGKAGGVRVVHSIAGVEKAAQELLGKPLVTAQTGVQAQHVAALLIEEPSSIARELYLALMVDRAQARITFLATREGGMDIEELAVTRPDALKKLVVNPSTGFLPFQARQLGFEFGLDTSQVQQLTRIMQGMYRLAQKLDALMVEINPLAVTSDGRLLALDAKLVMDDNA

SEQ ID NO: 28893 - protein, 679 aa, Gibberella zeae PH-1
MASKPDDDGFLAPYVSRSDAQRPLSIVSSRMTDIASEDGDGPEVQNNRLSIPQSTDMGSRPDTARTGASSSRGPWQSQSLRNKTYLAGVQAKRGSVESSTAGSTSQPPSLSSRSHVPSLQSHAFFRPMSSQKLQAQRGGSHRPSTMSQMSAAASPSSPTSPTSPTSPRSDEHGESSSSQMRQSIISNPIAQLQRQMSNEENMRPPPSRGTEMTEQETLDRITANTSPSHGHYPAGSLTDSVRPLQGMSSDTGHFQHSIIVDKSYKDLSNLPSPIKTPRSFRSSFLMPGRSNDGQLSQNRSTEGAEKLSSAASSPQFRPVDSHNEQQHPRVPYKPSQKSDLGRVHQYFDGNTVFCLGGRWQNTRGRPINIATGIFVVVPCALFFGFEAPWLWNNVSPAIPIVFAYLAYICFSSFIHASVTDPGILPRNLHQFPPVDDDDDPLQLSPPTTDWALIKSAESTTAAMEVPVKHCRTCNIWRPPRAHHCRLCDNCIETHDHHCVWLNNCVGKRNYRYFFTFVTSATVLAAYLIATSLTQILLYRNRQGISFGQAVDHFRVPFALVFLGFITFLYPAALMGYHIFLMARGETTREYMNSHKFAKKERFRAFSQASVFKNFIVVLCRPRQPTYYQFKAHYHEGDQRLGIRRDKRPRSSSQGLEMHDVNPGSSGFQGPVSLRNDTPH

SEQ ID NO: 28894 - protein, 397 aa, Physcomitrella patens subsp. patens
MWGSLMGWPRWTRWGHPRTGDASVAGMTWKWRCRKGTIPPTKGGTWHHFPPSHTHATANTATVAAGAGIGFRVQRFRGRRPIRSHAWNWRSVVAPRIDQVQRLIEIGNELQVSVRIAKWRWCLVLLLRPGSGSNSPGSGSPPYASRDFVCDLCFKFGEGPTYHCKACKYDLHPACCTLQPTLRSCTHPHPLTLMPANYHASSKKKCDGCRNSLADCEWSYRCEACDFDVHARCAKLRAKIFTYLHPIPLKLLIKSPYPPGRLQCDLCGERMPTQGWVYHCTNCKFDLHPSCAMLPPDPLCPVHPHRLSSCGYRTYHGKSYVCDMCLEFGGGLGFRCDKCNFNIHPKCLKSLFAPDSSLGAEGEAAPLHGCNTAPKFKLTAYGVHIIRKDDGAKSSSV

SEQ ID NO: 28895 - protein, 559 aa, Zea mays
MAEAAAAGSLSRRRMQDEEGAAAGSLSRRRMQDEEGAAAIEADAGHRRRSEAEEAEDDVESSDYMSEDEGTEDYRRGGYHAVRVGDSFKQGTYVVQSKLGWGHFSTVWLAWDEAHSRYVALKVQKSAQHYTEAAMDEIKILKEIADGDPDDSKCVVKLLDHFKHSGPNGNHVCMVFEFLGDNLLTLIKYTDYRGIPLSMVKEICRHVLIGLDYLHRTLSIIHTDLKPENILLVSTIDPLKDPRRSGVPLLLPSTRTDEPPPKVPAQSGNGGLTKNQKKKIRRKAKRAAAATSDGTSAVASADTDGSDDQRDMSTTNEGSPGTMKRATRDRRGSKGAKKMAMEADLKCKLVDFGNACWTYKQFTNDIQTRQYRCPEVILGSKYSTSADMWSFACICFELTTGDVLFDPHSGDNFDRDEDHLALMMELLGMMPRKIALGGRYSRDFFNRYGDLRHIRRLRFWPLNKVLMEKYEFTEINAHGMADFLVPILDFVPEKRPTAAQLLQHPWLDVGPLRQQPKTLPDSAQNSDDGVSEKQKKESEEREAMALELGNIAIDGAGGK

SEQ ID NO: 28896 - protein, 101 aa, Arabidopsis thaliana
  misc_feature (83)..(83): Xaa can be any naturally occurring amino acid
MASSMLSSATMVASPAQATMVAPFNGLKSSGGFPGTRKGNNDITFITSNGGRGNWMPGWASIGKEKVETFFYLSDLTDFQLAXGGDFLIRNQGVPWGGIQV

SEQ ID NO: 28897 - protein, 379 aa, Clostridium acetobutylicum ATCC 824
MIYLDNAATTFPKPDEVYNEVLDCMKNYAANPGRGSYDMAIKASHKVTETREIIAKLFNISDLFNVIFTCSATEALNIGIKGLLKRKNHVITTCMEHNSVLRPISHLKKKGVECSIVRADQYGFISPKEIEKLIRSDTKLIVVNHVSNVTGTIQNIDEIGEIAHKNGVCFMVDAAQSAGVLNIDVEKSHIDMLAFPGHKGLMGPQGTGGLFIREGIKLTEFKSGGTGSNSFSVDQPEFLPDRFESGTLNTPGISGLNAGIKFINSIGLKNIEKHEMELTEYLIRNLKNKDYVKIYGHELQNRGAVVSFNIDGIDSSDVAAILNVKGICVRNGYHCAPLVHEIIGTKNRGTVRVSPGYFNTIEDIDKLIEAVVEINKGKI

SEQ ID NO: 28898 - protein, 566 aa, Solibacter usitatus Ellin6076
MSGELTGEALQKLRHDLRTPINHILGYTDMLVEDAAEIGISAFVEPLRKIRAGGRTLLELIQSSLGEGMLAVNAEAMAAFESRFRSRAQTLLISARELEEEFQRAASEDARTDIQRVVAALERLIAMSSGTGESEDAAPPETERVALPDGRGSLGLESGGRILIAEDNPANRDILRRRLEKDGHVVTETQDGREALEQLERGDFDLLLLDILMPRLDGFETLAYIRRNERFHDLPVIMISALDEIQSVVRCIEMGAEDYLPKPIDPVLLRARIGASLEKKRLRDRERQKTAELELALHRLKETQDQLVVQEKMASLGALTAGVAHEIKNPLNFVTNFAVLSVDMMKEVLELIAPVRAQMAPKDGEYLDDLLSDLTGNLDRIRDHGKRADSIVRGMLAHSRGGSGQREEIDLNVLVAEAVNLAYHGLRAQDPAFNITLESEYDGNIPPVHVVPQDLSRVILNIANNGCYAAHQRKLKAGDGYRPTLRTSTAQTAGTVEIRIRDNGTGIPAAVLQKIFNPFFTTKPTGQGTGLGLSLSYQIVVEQLKGTVKVRSKENEFTEFQISLPK

SEQ ID NO: 28899 - protein, 348 aa, Burkholderia xenovorans LB400
MPNPTRAFLLGPLLKGVSRSFYLTLRVLPAGMRDPIGLAYLLARAADTIADTSLIAPQRRLTLLLSLREQVNGATDDAALFQRMAAEVAGQQVQSDEKVLLESLGPALDVLSQLNEFDRKAVREIVSTLTEGMEFDLRTFPDERSGQIAALREYDELDRYTYLVAGCVGEFWTTMTYAHMPGTLKERADVMARRGVRFGKALQMTNVLRDCGKDLRIGRCYLPQTMLDRYGLSPQDLLRPDNSVRARPLMIELLRKTVDHFREALDYTLAIPASAVRLRLASLWPILIGLETLILLADNDAWLDPQKVSKVRRNKVYQIIASSLLLVPSNGLVRHAVERRIRQIEARF

SEQ ID NO: 28900 - protein, 373 aa, Aspergillus oryzae
MALTNTSAINATMRAVVWQGDAYNVAVVDLPRPTIINQTDVIVRMSRAAICGSDLHIYRGTTEGMPAPFGLGHEGFGYVSDVGSGVGSLRVGDPVIVPFTVDEGHLHTELTTGLYGAFGNGGDLGGTQVPTLNYTDPSTNDSVSLLNDYVMLSDIFGTGWASLDYAGFEAGDTVAVFGAGPVGLMAAYSAILRGASTVYSVDYIPERLQLAESIGAIPINFRDADPVEQILALEPNGVTRSIDAVGYEQVNRNLTVQSDVIIRNMLAVTSTGGGLGTVGVYTHESNNTSTAPRASTVNTHVDFSLARFFYGEFTWGAGPSKPIDLAPELLHLVTSGKARPGFIVSDVINIEDAPEAYARFERHNTTKVIISFD

SEQ ID NO: 28901 - protein, 510 aa, Xanthomonas axonopodis pv. citri str. 306
MMNALASAKSLNNDPHSIFKPRYDNFIGGQWVAPHSGQYFDNTTPINGKVFTSIARSTAPDIEAALDAAHAAKDAWGKTSTTERSNVLLKIADRIEQNLELLAYAETWDNGKPVRETLNADVPLCVDHFRYFAGAIRAQEGGISEIDSDTIAYHFHEPLGVVGQIIPWNFPLLMACWKLAPALAAGNCVVMKPAEQTPASILVLMELIGDLLPPGVLNVVNGFGLEAGKPLASNPRIAKIAFTGETTTGRLIMQYASQNLIPVTLELGGKSPNIFFADVMAEDDDFLDKAVEGFVLFAFNQGEVCTCPSRALIQESIYDAFMEKALSRVAAIKQGNPLDPNTMVGAQASSEQLEKILSYIDIGKQEGAEVLIGGERNTLDGDLAEGFYVKPTVFKGHNKMRVFQEEIFGPVVSVTTFKDEADALAIANDTLYGLGAGVWSRDASRLYRMGRAIQAGRVWTNCYHAYPAHAAFGGYKQSGIGRENHKMMLDHYQQTKNLLVSYSPKALGFF

SEQ ID NO: 28902 - protein, 273 aa, Nostoc punctiforme PCC 73102
MNVAIIGCGYVGYQVAQYWQQKMNFVVSTTTTSPERVPALQSVSQRVFVTSGNDLDSLKSVLHNQDVVLLSVGAKGAEVYEETYLQTAQNLVSCLQQNPSVKQLIYTGSYAVYGDRNGVWVDEETPLAPANLNAQILRKTEDILLSASSENLRVCIFRLGGIYGPGRELLKIFSRYSGTNRPGGEDITNWIHLDDIVGAIEFARNRRLQGIYNLVDDAHLTSRDLLDSLFEKHNLPKVIWDTTVKSTRPYNAWVSNEKLKEAGYQLIHPQMIF

SEQ ID NO: 28903 - protein, 550 aa, Oceanobacter sp. RED65
MLTSLPEYQALSQHYSDVQQTSMRQWFEQNPNRFTEYTLQAAGITLDYSKNRVACETMQKLADLARARFIPEAIEAMFKGDLVNPSEGRPALHTALRNFSDGPVMVDGKDVMPEVRKTLTRMKEFCWRIRNQHWRGFSNKPFTDVVSIGIGGSFLGPKLASQALKPYWGKKINCHYLANIDGSNLTEVLQGLNPETTLFIVQSKSFGTQETLKNAIECRQWFLDNGGQESDLPRHFTAVTANVEKAKAFGINEKNIFPMWDWVGGRYSLWSAIGLPLMLTIGHENFKQVLQGAHEMDVHFRTAPLEQNMPVIMAMLGVWYINFFNAQSHAILPYDHYLRGLPAHIQQLDMESNGKSVDIHGSKLNYQAGPIIWGGVGSNGQHAYHQLLHQGTQFVPCDFIMPLQTHNPVDSFHELLISNCLSQSQALMQGKTLEEAKEELRKEGKSEREIAVLAPQKVIPGNRPSNTIFFDKANPKIVGALIALYEHKVFVQGKIWDINSFDQWGVELGKQLGNQVHAAIQAEGDTNIDNHFDASTLGLIKAFRSMKHKL

SEQ ID NO: 28904 - protein, 297 aa, Oceanobacter sp. RED65
MVKKAVIPVAGLGTRMLPATKAIPKEMLPIVDKPLIQYIVEECAAAGITEIVLVTHSSKNAIENHFDTSFELESTLEKRVKRQLLEEVQSITPDGVTIMHVRQGHAKGLGHAVLCALPVVGEEPFAVVLPDVLIDQYESDLKTQNLAQMIKTFDATNVSQIMVEAVPQEKVSNYGVVDLNGESLEAGNSQAMTAIVEKPKVDEAPSNLAVVGRYVLSEKIWDLLKYTPPGAGDEIQLTDAIADLMKQERVDAFYMNGKSHDCGSKLGYMKCFVEYGLKHQADGEAFGEWLGHRHSPA

SEQ ID NO: 28905 - protein, 164 aa, Bifidobacterium longum NCC2705
MAETFNVVVEIPRGSKNKYEVDHETGRVFLDRTLFTAMGYPDDYGYIDGTLGEDGDPLDALVMIPNSVFPGCVVECRAVGLYHMVDEAGGDDKVLCVPADVRFDDIKDIDDVNEYHKAEIKHFFEQYKALEPGKEVLPGDYWTGADAAEKEIIAARQRLADSEK

SEQ ID NO: 28906 - protein, 842 aa, Pseudomonas aeruginosa UCBPP-PA14
MNNKNLALKAPLSGPVMPLNRVPDPVFSSGTLGEGIAIDPLNDCLHAPCAGLVSHLARTRHALSLRADNGAELLLHVGLDTVQLQGEGFEALVEEGARVIEGQPLLRFDLDRVARGSRSLITVMILTNGDGFQVRPLTTNPVEVGAPLLQLSPEKAEQRPANPAPGEGSAQRQVRGRARVAHHGGLHARPAALLRKTAQGFSSQAELHFAGQVASVDSLVGIMGLGVAEQDEVEVICRGEDSEAALGALLAALASATAGAPKEAPRAIAPGEAARPAAVAGTLAGVCASPGLASGPLARLGAISLPADDGRHRPEEQHLALDQALQRVRDDVQGSLQQARLGGDENEAAIFSAHLALLEDPGLLDAADMLIDQGVGAAHAWHRAIQAQCEILQALGNLLLAERANDLRDLEKRVLRVLLGDTAPLRVPAGAIVAAREITPSDLAPLVDAGAAGLCMAEGGATSHVAILARSKGLPCLVALGAGLLELEEGRQVVLDAGQGRLELSPDARRLEQVALQVAQREEQRRRQQADAQREALTRDGRRIEIGANVASPREAAEAFANGADGVGLLRTEFLFLERRAAPDEEEQRNAYQEVLDAMGQRKVIIRTIDVGGDKHLDYLPLPVEENPALGLRGIRLGQARPELLDQQLRALLRVEPLERCRILLPMVSEVDELRAIRGRLGELATQLGIERLPELGVMIEVPSAALLADQLAEHADFLSIGTNDLSQYALAMDRCHAGLADRIDALHPALLRLIAQTCAGAARHGRWVGVCGALASDPLATPVLVGLGVEELSVGPNLVGEIKTRVRQLDAAECRRHAQALLDLGSARAVRDACLQHWPLA

SEQ ID NO: 28907 - protein, 257 aa, Physcomitrella patens subsp. patens
MAGTGRFFVGGNWKCNGTVESLKKLVDELNSAKLEEDVDIVVSPPYLYISQVLGSLTKRIEVAAQNCWTGKGGAFTGEISADQLVDGGVKWVIQGHSERRHVIGETDAMIGQKSAYALSKNLGVIACVGEKLEDREANRTTDVVFEQLQAYADAVSDWSNIVVAYEPVWAIGTGKVASPQQAQEVHAAIRQWLKEKISPEVSSKTRIIYGGSVNGANSAELATQEDIDGFLVGGAALKGLEFATICNAVTAKKAVAA

SEQ ID NO: 28908 - protein, 226 aa, Streptomyces tendae
MTAPTAPSTDTYLGTNVRLLPQTDQLRALHTAIRDRDASHEDFVRYSRRIIRLLIEAGMDLLPFEPHEVRTPTGAAYQGLRFASGLCGVTVVRAGESMEGELRDVCPGIRIGKILIQRDETTKEARLYYTSLPADIARRHVLLLDPVMATGGTALAALRVLTDLGVPEENIVFVNFITVPEGITAFCGQYPRVRIVTSAIEERLTEDAWMLPGIGDFGDRYFGTDD

SEQ ID NO: 28909 - protein, 345 aa, Oceanobacter sp. RED65
MPKTILVTGGAGYIGSHTCVELLEAGYDVVVLDNLSNSNPKSLDRVQEITDKTLQFIEGDVRDREVLQAIFNKHDVYGVIHFAGLKAVGESCEMPMHYYDNNVYGSIVLTQEMEKAGVKNLVFSSSATVYGDPERLPLTEDMPLSATNPYGRSKLMIEDMLRDLEVADQLTEQEIKWNIAILRYFNPVGAHKSGNIGEDPNGIPNNLMPYITQVAIGKLKELQVFGGDYDTHDGTGVRDYIHVVDLAKGHVKAIEAIGHTVTGAKAINLGTGNGLSVLDLVKSFEKQNSVSIPHKITDRRPGDVAACYADSSLAQQLLDWRTEYNEEQMTKDSWHWQQKNPTGYK

SEQ ID NO: 28910 - protein, 320 aa, Oryza sativa Indica Group
MTRRFWSSHHGSTKLCHCHYSGNFSRYLIAIAISVGLPDSVGGVLSGPVSNVATRWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDKHAVGGCGDITVWLGDLNYRLQGISSIPARKLIEENRQSKLRGKDQLLQEAEKGEVFNGYCEGTLLFKPTYKYNIGSSNYDTSYKIRVPSCTDRILFKVDHTSGLDAVLNSYEALDCIRSSDHKPVRAHLCLKVHGDSA

SEQ ID NO: 28911 - protein, 352 aa, Bacillus licheniformis ATCC 14580
MKVFNIASIPGDGVGKEVVPAAQRVLKAVSDVHGGLSFRFTEFPYSCEYYLEHGEMMPDDGLEQLKEFDSIFLGAVGNSKLVPDHISLWGLLIKIRREFEQVINIRPAKYLQGIKSPLANPKDFDLLVVRENSEGEYSSIGGRIFRDEDEIAIQNAVFSRKGAERAMRFAFELAAKRKKHVTSATKSNGIVYSMPFWDEVFENTAKDYPDITADSQHIDALSAFFVTRPEKLDVIVASNLFGDILTDIGAAIMGSIGVAPAANINVNGKYPSMFEPVHGSAPDIIGKGIANPIGQIWTAKMMLDHFGEEELGARLLDVIEDVLKSGYLTPDIGGSSTTDDVTEEIIKRVRTI

SEQ ID NO: 28912 - protein, 291 aa, Yarrowia lipolytica CLIB122
MYSTATQSSPSLAGVKNIVLVLSGKGGVGKSSVTTQLALTLAAQGKKVGVLDIDLTGPSIPRFFGMEDKQVYQSSAGWVPVYTDASRNLCLMSLGFLLSSRGDSVVWRGPRKTAMIRQFIRDVVWGELDYLLIDTPPGTSDEHISIAEELRFCDQILGAVIVTTPQGVALADVRKELSFCKKIGFPILGIIENMSGYVCPHCSECQNIFSKGGGENLAKQYECKFLGTVPIDPKFVLMVENAKGGLQEIYGETDMAKIFAGICDKAFSEENEEEAKETAEEEKSRAATNGQ

SEQ ID NO: 28913 - protein, 519 aa, Xanthomonas campestris pv. campestris str. ATCC 33913
MNTAGIGGYFRQGLFGRDLLASVVVFLVALPLCMGIAIASGMPPATGLITGIIGGLVVGFLAGSPLQVSGPAAGLAVLVFELVREHGAAALGPVILVAGAIQLVAGLCRAGVWFRMTSPAVVAGMLSGIGILIVASQAHVLMDAAPKARGLENFAALPAVLWQAISEGTGRTALLVGLATIGIILAWDKLRPQRLRFLPGALIAVVVVTATVQLQGLNVNKVDVPTNLFSAISIPRLSDIFGVFNHTLLVSAVTFAFIASAETLLSAAAVDRMHQGARTQYDRELAAQGVGNMLCGFLGALPMTGVIVRSAANVQAGAATRVSTILHGSWLLVFAMLLPWLLRMTPVACLAGILVYTGVKMIKIGQVKELATYGRGTAAIYLATTFAIVATDLLTGVLIGFGLSLFRLALHSSRLKVEVREHADKKDEMHLTLQGSATFLKVPAMARTLESVPPNTVLHLDVAKLHHVDHACIELLRDWSRNAASRGCELAVDWNELDRRVEGQRKVDPVPTQEPRKAA

SEQ ID NO: 28914 - protein, 756 aa, Acinetobacter sp. ADP1
MDDQSLKQAALYYHENPTPGKISVTPSKQLVNQHDLALAYSPGVAAPCLEIERDPSTAAKYTARGNLVAVVTNGTAVLGLGNIGPLASKPVMEGKGVLFKKFAGVDVFDIEIAENDPDKIVDIVAALEPTFGGINLEDIKAPECFYIEKKLRERMNIPVFHDDQHGTSIIVGSALLNALQLVNKKIEDIKIVASGAGAAALSCLDLLCALGARKENIIVADSRGLLTTSRDGLDESKKRYVQDITATQLHEVITGADMFLGLSAAGILTKEMVKGMAENPIIFALANPDPEILPEHAHEVRPDVIMATGRSDYPNQVNNALCFPYIFRGALDVGATTINEDMKIACVHAIARMAHVEADAATYGEKSASFGRDYLIPRPLDQRLILEIAPAVAQAAMDSGVATRPIEDFSAYRQKLSEFVYNSAFIMKPIFSQAKADPKRIAYAEGEDYRVLRTAQIVVDDGIAFPVLVGRTAVIEANIKKLGLRLENGVNIEIVDQENNPLYEEFWKDYYQIMQRKGVTVEYAQREARRRSTLIAAMLVKFGKADGMLCGTYSSYDIHLDFVSKVIGLKEGMNNFFTLNALMLEDRNLFIADTYVNTNPTAEQLADMTILAAEEVRRFGITPRVALLSHSSFGSNQEDPSAQKMREVYRLLNERAPELEVEGEMHGDAALDESIRHSAFPGSNFKGSANLLIMPNLDAANISFNLLKATSGNNVTIGPILLGAAKPVHILTPTATTRRVLNMTALTVAEIQQSEG

SEQ ID NO: 28915 - protein, 392 aa, Prochlorococcus marinus str. NATL1A
MTDKSQISIRALSIKPSLTLEISAKAKALKAEGKNICSLSAGEPDFDTPEFIVDATLKALKDGKTRYGPAAGDPELREAIAQKQSDINKVPTKTDNVLVTNGGKQAIYNLFQVVLNPGDEVLIPTPYWLSYPEITLLAGAKPIKIKSSTKDKFKIDINSLEEHVTAKTRLLIINSPSNPTGCVLTEQEMKTISDFLRRHPRILLMSDEIYEFLISPNQVHHSFAKIAPDLKNRIFTVNGFAKAWAMTGWRIGYLTGNAEVIKKAIALQSQSTSNVCSFAQKGAIAALQGSKDCVHEMANIYNKRRLLITERLKKIKHISFVPPNGAFYVFPEINLEEIDSISFCKLALEKVGLAIVPGIAFGDDKCIRISYAASNKMIEDGVNRLERLLNDF

SEQ ID NO: 28916 - protein, 234 aa, Haemophilus ducreyi 35000HP
MSVSENLSTVRQQIQQICRQFERENVRLLAVSKTKSIEAIEAAIAAGQTAFGENYVQEAIEKISYFNQQNKSKRLEWHFIGPLQSNKTRLVAENFDWLQTLDRLKIAERLNLQRPADLAPLNVLIQINISDEASKAGITPQQMMNFAEAINALPHLCLRGLMAIPKPAVDIAQQKAVFQQMQQLFDCLKAEFAQVDTLSMGMSDDMLSAIECGSTMVRIGTAIFGVRDYSAKAV

SEQ ID NO: 28917 - protein, 442 aa, Coccidioides immitis RS
MALRIAARRLGSRAARRPYAFESFVQCRFASTAGASNLPQDVKKQIFGEGCYLWDMENRRYLDFTAGIAVTSLGHSDPGVTKAINEQARTLLHASNLYHNNWTGSLSKLLVAQTHSSGAMRGATQAFISNSGTEANEAAIKFARKVGHSLDPSGAKYEFVSFHNSFHGRTFGALSATPNPKYQAPFAPMVPGFRYGKYNDIEQLPRLITEKTCGVIVEPIQGEGGVHCATPEFLTALRARCDEVGAILIFDEIQCGLSRTGSLWAHSHPSLVPTNGAQQPAHPDILTTAKALGNGFPIGATLISDNVGKHIKTGDHGTTFGGNPLACRVAHHVFTRLASRELQDTVLKRSEVFVAGLKALREKYPDAISEIRGRGLILGMQLTGDYASRVGDIVTAARERGLLVITAGEGCLRFVPPLVISEEEIQEGLQILGNAMEKVFQK

SEQ ID NO: 28918 - protein, 190 aa, Brucella suis 1330
MFIQTETTPNPATLKFLPGKVVMPEGTADFRDPASAENTSPLAAKLFAVPGVTGVFFGYDFITVTKEDGEWQHLKPAILGTIMEHFMSGAPAMAGNANADAAAAHGEEEFFDEADTEIVETIKELIETRVRPAVAQDGGDITFRGFENGTVFLHMKGACSGCPSSTATLKHGIQNLLRHFVPEVQQVEQI

SEQ ID NO: 28919 - protein, 552 aa, Pichia pastoris
MTDTKELATLLENLLKLQKSGSLGEIVGQAQRIYHDISDLSVLSGLSTPEVLSPHTSPDVPERVPSEVNLDNSNLATDVNEKEKYFDDFANDYIEFTYKNPTTYHLVQSVAELLKKSGFEYLPEAADWSKLFDPEKTGAYFTIRNGTSLAAFTIGSFWSPAKGVGAIGSHIDALTTKLKPVSNKSKVDGYELLGVSPYAGALSDVWWDRDLGIGGRVIYKNESSGKLSTTLVNSTPHPVAHIPTLAPHFGTPSNGPFNKETQAVPVVGFSDGNDEEKPTEDEQKSPLIGKHSLKLLRYISKLAGVPVSSLIDFDLDIFDVQKGTRGGLSNEFIYAPRVDDRICSYSALQALIRRHKDPESFVTDDSFNLVALYDNEEIGSLSRQGAKGGLLESTISRAIAALKISEPGTLQRLYANSVILSADVTHLLNPNFTEVYLEHHKPLPNTGIALALDSNGHMATDLLGKVVVEQLAKLNDDKVQYFQIRNDSRSGGTIGPSISSSTGARTIDLGIPQLSMHSIRATVGYKDVGLAVKFFQGFFKNWRKVVDGIEEF

SEQ ID NO: 28920 - protein, 459 aa, Escherichia coli O157:H7
MNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 28921 - protein, 465 aa, Chlamydia muridarum Nigg
MNEAFDCVVIGAGPGGYVAAITAAQAGLKTALIEEREAGGTCLNRGCIPSKALLASAEIVAQIRHADQFGIHINGFSIDYPAMVQRKDTVVRSIRDGLNGLIRSNKITVFSGRGSLISSTEVKILGETPSVIKAQSIILATGSEPRAFPGVPFSQQSPRILCSTGVLNLKEIPQKMAIIGGGVIGCEFASLFHTLGSEVSVIEASQQILALNNPDISKTMFDKFTRHGIRFMLGASVSSIEDMGDRVRLTINGNIEEYDYVLVSIGRRLNTENIGLDKAGVICDERGVIPTDSTMRTNVPNIYAIGDITGKWQLAHVASHQGIVAARNIAGHKDEIDYSAVPSVIFTFPEVASVGLSPTSAQQQGIPVKVTKFPFRAIGKAVAMGESDGFAAIISHETSQQILGAYVIGPHASSLISEITLAIRNELTLPCIYETIHAHPTLAEVWAESALLAVDTPLHMPPTRK

SEQ ID NO: 28922 - protein, 459 aa, Escherichia coli O6
MNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMLTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 28923 - protein, 719 aa, Nicotiana tabacum
MADVTSMGEITAIAARIGVDLSQIDLDSIHLPPGEDCGIPSDDDDLMEEDPLEFDAGFGNILVVDNLPVVPKEKFEKLEGVVRKIYSQLGVIKEDGLWMPVDPETHKTLGYCFIEYNTPQEAELSKEKTHGYKLDRSHIFAVNMFDDIERFLKVPDEWAPPEIKPYVPGENLQQWLTDEKARDQFVIRAGNDTEVLWNDARQLKPELVYKRSFWTESFVQWSPLGTYLATVHRQGGAIWGGATTSNRLMRYAHPQVKLIDFSLAERYLVTYSSHEPSNPRDSHAVVLNISDVRTGKVMRDFQGSADEFAVGGTGGVTGVSWPVFRWSGGKQDKYFARIGKNVISVYETETFSLIDKKSIKVENVMDFSWSPADPILALFVPECGNQPARVSLVQIPSKEELRQKNLFSVSDCKMYWQSNGDYLAVKVDRYTKTKKSTYTGFELFRIKERDIPIEVLELDNTNDKIPAFGWGPEGSPICCYPSVTTPRPDIRFYSVPVWALTPGLVSKLTTLKGKQANALYWSPGGRFLILTGLKGFNGQLEFFDVDELETMASAEHFMATDVEWDPTGRYVATSVTSVHEMENGFNIWSFNGKLLYRILKDHFFQYLWRPRPPSFLSKEKEEEIAKNLKRYSKKYEAEDQDVSLQLSEQDREKRKKLKEEWEAWINEWKRLHEEEKMERQKLRDGEASDEEEEYEAKEVEVEEIINVTEEIIPFEESQQ

SEQ ID NO: 28924 - protein, 473 aa, Zea mays
MDASSSLSLLALVTMLSLLHSATTDAAAGLPAARTSHRRLLLLHQQDTNLAALPPPARVHVVPVDVHVPSHGTGSFPAASPGPHGGKNGPSEAAPATPATAAAYLSRSMRWLYMVAVPAVALLALAGLACWLLCRKSAVATIGPWKTGLSGQLQKAFVTGVPKLQRSELERACEDFSNIVVSYPHYTVYKGTLSTGVEIAVVSTMITSSKEWTEHSESCFRRKVDALSRINHKNFVNLLGFCEEEEPFTRMMVLEYAPNGTLHESLHAEDFERIAWRGRMRIVMGLAYCVQHMHELSPPVAHPDMQSSSVLLSEDGAAKIADMSVWHEVISQGKTTTNGDEQASSAGLLAGNVYSFGALLLEIISGKLPTPYPAHERSLQMTSALVERVTNDDRSVASLLDPTLGGDHREDELAVIGEVIRACMQSDPRRRPSMREVAARLREAVGISPVAATPRLSPLWWAELEVLSAAEAS

SEQ ID NO: 28925 - protein, 752 aa, Candida albicans SC5314
MSSTLPPFSDLNATWTFIQPGLEYILGAHGEQGVTATVYMNCYTAVYNYCVNKSRRGTTPVSISNNSDNNSYSLAGAEIYKKLEEYLTEFIKNLKRLPNESFLEFYVRKWTRFTIGAVYMNNVFDYMNRYWVQKERSDGRKDVYDVNTLSFIKWKDEMFKPNSKLLIEQILTCIQQQRDNMIVDTNLISSAIKSLVFLSIDIQDLKKPNLIIYVNSFEIPFLEATMEYYAKESAAFLASHNVIDYMKKCETRIGEEVSRSNNYLEERTKKPLLEVLNAALIEKHANEMYDQFLVLLEQNQIDHIQRMYKLLARVQKTLDPLANTLELYIKKEAAAALEEIQTQAENSEAKKKIVEPKVYVHTLISIYNRFNDIVVRAFSKDTKFIKSLDNACRHFVNNNPIATPKPRSPCRTPELLARYADGFLKSNSKDNEMNADNLMIVFKFIAERDSFEEHYRRLLAKRLVNGTSKSEEMEESVIHRLQEENSIEYTSKMTKMFTDIKASDDLKIKFKDGMNVLFDFSPMVLARSTWPFHSSQDYNDLKLAPELKVTIDSFKAMYLQQGKGKQIEWLWNHGRAELKAHLTKGKGGKPFNFIVSQIQLMVLLAYNYSKTYTLDDLVKIVGIKKELLQNHVTPFVKYKLLKEEGDQLVIVDHYPSKKNKVSFIGAITKTKEEDVEEITKEVQQSRTIFLEASIVRIMKSKKSMAPNNLLNEVVVQAGNRFNAKNIDVKRAIDSLIDKEYLKRNGDDYEYIS

SEQ ID NO: 28926 - protein, 471 aa, Zea mays
  misc_feature (217)..(217): Xaa can be any naturally occurring amino acid
  misc_feature (244)..(244): Xaa can be any naturally occurring amino acid
MEHQSSDHDEITHADYPPYKVGRSTTWDSDDYGSNCALHHTIGLPDFSHELWCFQMVTCYPAFIHNLDDAHERIGTSIATTLRVRGMRVADTPTPAVLGRHACLACAAAVLKACDPDEAVVEAGLQSAFPEPPSKQDTVIMLNMATATRPEIVVLALRWFLGNVEVWKKVIIYKVKLKLLCKKRHWRETEALWVKMLRHGMQPGNTIFSTIISCVRXGLLSKVVEWFDKMPEFGCSPDWLTYSXVNKVHSTSGNFNGALNVFEEMKATGVKPNLVMCNTMLDVMGHVLQPWVVKTIHREMVNKQVQPSRTAYYCLLHAYTRALTGEDAMAVYQLMKDEAMGVMLYNMLLSMYADIGYVDKAEEIFRDLSVPMDDHSKPDKWRYSSMVMQYSSTANVLGVEVILNEMVEAGLKPNIFVWTSLSRCYGKAGRTDDVVRSFGMLQDLARRTCLRRGSYLRRGTCLRGRVVSLHH

SEQ ID NO: 28927 - protein, 340 aa, Thiobacillus denitrificans ATCC 25259
MNLDELQAVARAIVAPQKGVLAADESGPTIKKRFDTIAVESTEKSRRRYREIMFTAESIERYIGGVILYDETLRQSTRDGTPFPQLLAGRGIIPGIKVDQGAKPLALCPGEKVTEGLDGLRERLVEYHGLGAQFAKWRAVIDIDAHDLPSPFGIHANAHALARYAALCQEVGLVPIVEPEVLMDGAHDVERCEAVTARALEAVFAELDAHGVGLEGVLLKPNMVVAGKKSTRQAGVQEVAEATLRCLRRHVPAAVPGIVFLSGGQSAEEATAHLSAMNAMGPHPWQVSFSYGRALQAPVLAAWRGHEANAAAAQAALLERARLNGLARDGAYGPEMESAG

SEQ ID NO: 28928 - protein, 231 aa, Rosa hybrid cultivar
EWGVMHLVNHGISDELMERVKKAGQAFFDLPIEQKEKYANDQASGKIQGYGSKLANNASGQLEWEDYFFHCVYPEDKRDLSIWPQTPSDYIVATSEYAKELRGLATKILTVLSLGLGLEEGRLEKEVGGLEELVLQMKINYYPKCPQPELALGVEAHTDISALTFILHNMVPGLQLFYGGKWVTAKCVPNSIVMHIGDTLEILSNGKYKSILHRGLVNKEKVRISWAVFCE

SEQ ID NO: 28929 - protein, 177 aa, Triticum aestivum
LGFRFASQYSDLSMAAEEGEKKMITLKSSDGEEFQVEEAVAMESQTIRHMIEDDCADNGIPLPNVDSKILSKIIEYCKKHVQANASSSTSTAAAAPTEDLKSFDADFVKVDQATLFDLILAANYLNIKGLLDLTCQTVADMIKGKTPEEIRKTFDIKNDFTPEEEEEIRRENQWAFE

SEQ ID NO: 28930 - protein, 369 aa, Glycine max
MSSNSRESQVHPEIAKVEDPYLSAVLLCFSRVLPAVLNAAIDLNLFDIIAKAQSSCDSSFSASEIASLLPNQHPQLANRLERILPLLASYSLLNCSIRTNEDGKRERVYALSPVGAYFAFDKDEGSSLAPLSSLIHRGFHDMWKDVKDAIVDPNNNNHFENVHGIPPYDYMEKNAELNDIFYKAVIHAAPLELKRALKLYKGFEGVSTLVDVGGGAGETLKQILPKYPSMKGINFDLPLVIQKAPPHPGIEQIAGDMFESVPTGDAILVKFVCHNWADEDCIKFLRNFHKALPQHGKVIVFEYIIPEVPNPSYISKHTCTLDNVMFLAHGGRERTQKEFENLCKSSGFSKFHVASSDISSTLGVMEFYK

SEQ ID NO: 28931 - protein, 197 aa, Blastopirellula marina DSM 3645
MSVLVTKEAPDFTATAVTETGEFKDVSLSDYKGQYVLLFFYPLDFTFVCPTEIIAFSDRIEDFKALGVQVLGCSIDSHFSHLAWRNTPRGDGGIGDIQYPLIADLDKSIATKYDVLLPGGIALRGLFLIDTKGVVRHQVVNDLPLGRSVDEALRMVKALQFHEVNGEVCPANWKEGSRTIKPTPSDSKEFFGAEYAG

SEQ ID NO: 28932 - protein, 227 aa, Triticum turgidum subsp. dicoccoides
GGGRMYVTMDRYENDWSVVKRGWDAQVLGEAPHKFQNAVEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNG

SEQ ID NO: 28933 - protein, 339 aa, Zea mays
MSSESDSLASRRSKKPKYSKFTQQELPACKPMLTPGIVIGAFSLIGVFFVPIGLASLSASHNIVEVIDRYDAECVSANDKVGFIQDTKTDKACTRKITVPKPMKGPIHIYYQLENFYQNHRRYVKSRNDMQLRNKGDASTIANCEPEATSEDGGKPIVPCGLIAWSLFNDTYSFSLNKKAVQVNKKNIAWDSDKIKKFGSDVYPSNFQKGGLIGGAKLDEKIPLSEQEDLIVWMRTAALPTFRKLYGRIEADAMASDEITVVIQNNYNTYSFGGTKALVLSTTSWIGGRNNFIGVAYVAIGGVCLFLALAFVILYVIKPRALGDPSYLSWNRENPDHPN

SEQ ID NO: 28934 - protein, 409 aa, Bradyrhizobium sp. BTAi1
MNVLAKQPSPFKPAQRLSAIGVSEILKVTGLAAQMKREGQNVIILGAGEPDFDTPEPIKDAAARAMRDGATKYTALDGSPELKAAIRAKFKRDNGLDFAQDEITVSAGAKQVLFNAMMATLDPGDEVIIPTPFWVTYADIVAIAGGTPVLVPCSEANGFRLSPEDLARAITPRTRWLMLNSPSNPSGAAYSEHQYRPILDVLLKHPSVWLMVDDIYEHIVYDGFRFVTPVAIEPALRNRTLTVNGVSKAYAMTGWRIGYGAGPSALIKAMAVVQSQSTSCPSSISQAAAIEALTGPQDVIADRCRSFQQRRDLVVDALNSIEGISCCVPEGAFYTFASCAGLIGRTTPDGRVVEDDTVFADYLLRAAGVAVIPGSAFGLAPYFRISYATSAAELRDACQRIAAAAARLL

SEQ ID NO: 28935 - protein, 459 aa, Salmonella paratyphi
MNRLPSSASALACSAHALNLIEKRTLNHEEMKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDSFRQLAREYPNLVHEARGKGMLMAIEFVDNETGYRFASEMFRQRVLVAGTLNNAKTIRIEPPLTLTIELCEQVLKSARNALAAMQVSVEEV

SEQ ID NO: 28936 - protein, 424 aa, Chlamydophila caviae GPIC [sequence omitted]

SEQ ID NO: 28937 - protein, 459 aa, Salmonella typhi
MNRLPSSASALACSAHALNLIEKRTLNHEEMKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHEARGKGMLMAIEFVDNETGYRFASEMFRQRVLVAGTLNNAKTIRIEPPLTLTIELCEQVLKSARNALAAMQVSVEEV

SEQ ID NO: 28938 - protein, 550 aa, Desulfitobacterium hafniense Y51
MLYSYDVCKYKNKYHKGGHKLISVNNVSLRYGGRKLFEDVSLKFTPGNCYGVIGANGAGKSTFLKILSGEVEPNSGDVTIAPGVRLSMLKQDHYQYDQYTVLDTVIMGNQRLYAIMKEKEVLYGKADFTDEDGIKAAELEHEFGEMNGWEAESEASTLLQGLGIGTELHEKAMSELTGVEKIKVLLAQALFGNPGILILDEPTNHLDIQSIRWLEEFLIGFEGTVIVVSHDRHFLNKICTHMADVDFGKIKLYVGNYDFWYESSQLALQMTRDLNKKKEEKAKQLKEFIARFSANASKSKQATSRKKMLDKLNIEDIEPSNRKYPYVGFKPEREVGNDILTVEGLTKTIDGVKVLDNVSFILSKGDKVALVGTNEGAYTALLQILAGEMEPDSGSYKWGVTITKAYFPKDNTEYFQDVDLSLVDWLRQFSADKTDTYVRGFLGKMLFSGEEALKSLKVLSGGERVRCMLAKMMLSQANVLLLDQPTNHLDLESITALNNGLTDYKSNIIFTSHDHQFIQTIANRIIQITPEEMLDVRLTYDEFLDNLAIG

SEQ ID NO: 28939 - protein, 459 aa, Salmonella typhimurium
MNRLPSSASALACSAHALNLIEKRTLNHEEMKALNREVIDYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRRPFMPLLPGFRHVPFGNIDAMSMAFSEGKKTGDEIAAVILEPIQGEGGVILPPQGYLTEVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDTLLDGFRQLAREYPNLVHDARGKGMLMAIEFVDNETGYRFASEMFRQRVLVAGTLNNAKTIRIEPPLTLTIELCEQVLKSARNALAAMQVSVEEV

SEQ ID NO: 28940 - protein, 1201 aa, Aspergillus nidulans FGSC A4
MQHEQPAKAQTHQSLGPPILFCQTLSLALPTTAQLFHLTTLISLPSHVVVCTSPALRIASIAISLASSPQLPLEWIRNPTTTAIEAWIANQHPSPLLFVPRQLWAFWGAGSAQTRKPPTLHQYQMTMLLPTQSIPSLGLVALLAFRSRNPKYLEGQGRVTGHRADPAHYSSHGLREQTAELASLALTREPRALPQAMEIFRPVDGSAESVAPLSLSGPDRTQEMGHTPTVHSGGSSVLTALIRDPSSSVSREGQERTGDRNEEGERAHAVGPSAPGNADEEEDTSTEWTSLLAKTPSRPSRNYGGAGDVESQVYAPKETQRTLPSALTTVSTCFQVLAHPKSWDRRTVWRQGVVRPFSLLPSVFLGLLLNILDALSYGMILFPLGEPIFSHLGSDGISMFYVSTIIAQLVFSCGGSIFRGGIGSEMIEVVPFFHQMAFTILNRVGQDNPKSVIATTILAFSVSSVLTGLVFFLMGTCKIGSLIGFFPRHILIGCIGGVGFFLILTGLEVSARLPGSFEFDIPTMQKLFNLAALALWVTPLLLAIGLLVLKRFVRSNYLVGAYFIVVALCFYIVKFIAHIPMDSLRNSGWVFDAPSSSNPWYHFYTLYDFSAVHWPAFVDTIPAMFALTFFGILHVPINVPALGISTGEDNLNVDRELIAHGVTNALSGFAGSIQNYLVYTNSLLFIDSGGNSRLAGVMLAGATAGIMLVGPVIVGFIPVMVVGALIFLLGIELMEEALVDTWGKLHRHEYLTVVIIVATMGVWDFVAGILVGIILACLSFVVQTSRKSAIRATYSGKVAGSTVRRPPIQQRYLKEAGQQTLILKLGGYLFFGTIVDVENTMRGLIEDEAFSRLPIRFIILDLCRVYGVDFSAAEAFTRINRILKKRNVRMMISGLDVGGDVGKSLQNVGLFEPELTVRIFEDLNSALEYCENEYLNVFYSHREALLRRKAAPQNLEVPAIQHRSQSAEGFVGSPRHQYLQRAATTTLSEDESAILPPAAWSAMRQPLPLLLQTFQGLTSRNEDFWFAACPYFVRTTYAMGTTLFREGDVPNAFYLLESGMLRAEYDLPQGRYFELIVAGRPCGELPFFSETRRTATVKAEQDCVTWSLDAENWKALKEEEPDIARELLTVSLKLTTERMDSITSRCCWWVACLGAALLGRRFQFAAAPTMISRNMQSSLQQIFDVSKHLHSEVDAQMSCHL

SEQ ID NO: 28941 - protein, 378 aa, Arabidopsis thaliana
MSDLPLDLVEEILSRVSATSLKRLRSTCKQWNTLFKKRSFSQKHFHIAPKESMVLMLKEYRVCSMNINLNVSPPSVEFQGTLGIKDDSHSNLGQVEIVEVYHCDGLLLCATRDNRLVVWNPCLGETRWIQLKDECRRYSTFALGYENNKFCRRNYKILRYWGWFHDHIPDDGGRFRFEIYDFRSDSWKVLDDVPDDRFPPVSVVSLKGNTYWFGSNKKDFLRSFDFTTERFNHIGLPPSRDHGFMALSVVGEEQLSVLQEIETSKMEIFVTNKVGTEEAALLWSKSFIVDLPIGGHCSEVFASLLINEEKKVALCCNLDFETDGNLIFTIGEDNKYYSEIPYATNKPWWLCRFSEKFTKKWWWFPFIYNYVPSLVQIL

SEQ ID NO: 28942 - protein, 320 aa, Pseudomonas aeruginosa UCBPP-PA14
MTIRQTPINSGFGAKTQASEVMAGQDLSGKTAIVTGGYSGLGLETTKALAYAGARVIVTARRPDVAREALLGLDEVEVQALDLAELACVRRFAEAFSASRRRADIVINNAGVMACPETRVGPGWEAQFATNHLGHYALVNLLWPSLADDARVVAVSSAGHHYSAIRWDDVQFERGYDKWLAYAQSKTANALFAIQLDALGRERGVRAFAVHPGSIATPLQRHVPRAEMIALGWMDEAGNPASPDTLKTPQQGAATQLWAATSPLLAGMGGLYCEDCDIAGVAPDDSRTLAGVREHAIDPEQARRLWRLSATLTGIDAFAS

SEQ ID NO: 28943 - protein, 172 aa, Oryza sativa
  misc_feature (105)..(105): Xaa can be any naturally occurring amino acid
MEHKEAGCQQPEGPILCINNCGFFGSAATMNMCSKCHKEMIMKQEQAKLAASSIDSIVNGGDSGKEPIIAGHAEVAVAQVEVKTLVVQPAEIAGPSEGVTVNPKXGREGPNRCSTCRKRVGLTGFNCRCGNLYCATHRYSDKHDCQFDYRTAARDAIAKANPVVKAEKLDKI

SEQ ID NO: 28944 - protein, 502 aa, Aspergillus oryzae
MVANLFAQGGLTALVLASQNPHIQFSVVDSDARLIAAWNSDRPPVFEPGLENLLFEPNDPPALPTPSPSPKPEASQDEDCLENSSNSTNHGELIALLPRRRKLANVNFSTNMHEAVAAADMVFLCVDAPSSIMNGDKSDIDLSRLEIAIQAIAQVSTGHKIIVQKSTAPCGIVPRLKKLLKETASPSASFDVLSNPDFLVPGAAIRDLLYPPRVIIGHVFSEDMSPEALTALKRLYSPWVPDDRIVTMDAWSSELGKIAANALLAQQISSLNSLSVLCESTNANINYVSETLGLSQRSGLGFGGSSLQSDVLCLVYLARELGLQEVVDYWMAVLRMNEYQRHRVVKRLITRLGDVKEKRVAVLGFVSKGNVMDTRTTTALGLVRTLTSNGVRVNIYDPHVQADRSESTLRLYDCHPEMVTVTESIETACFGCSALVLHTDWEEFRQDQVRWQRISGHMASPRVLLDPHGVFDGFKMQQWGFEVLQVGIRSTKVLSAPKGHGQ

SEQ ID NO: 28945 - protein, 395 aa, Clostridium acetobutylicum ATCC 824
MYFIGGIKMESSKISKGANSIQISGIRKFYNKVIKVQGAISLTLGQPDFPVPDKVKRAMVRAIEDNKTVYTSNAGIDELRNEISKYLKRFNINYSKDEICITAGGTEGILDIFQALLNKGDKVLVPDPSFPAYASCTKLLEGEVITYGLYGSEFSIDFNELENKIKNEKPKFMVLSYPSNPTGTVISKEDNEKLHKIIKDNDIIAVTDEMYSALCYEDDYYSVSQYEDIREKVIVVSGFSKTFSMTGLRIGYVCAESSFMSSILKVHQYTTTCAPSISQYGALEGLKNCDEDVQYMKNEFKKRRDYVYKRLKDMGFEVRLPKGAFYIFPDISRFGMTSEQFCEKLLNEAKVAIVPGSAFGEKGEGFARISYAYSKKELEECMNRIEKWVEVQNNL

SEQ ID NO: 28946 - protein, 392 aa, Oceanobacter sp. RED65
MDLKLSNRVQSIKPSPTLAVTNRAAELRAAGKDIIGLGAGEPDFDTPEHIKDAAKQAMDNGFTKYTAVDGTPDLKKAIIAKFKNDNGLNYEANQILVSCGGKQSFFNLSLALLNPGDEVVIPAPYWVSYPDMVKIAEGVPVIIETDASARFKITPEQLDNAITDKTKLVVLNSPSNPSGMAYTKAEFEALGDVLRKYPNVLIATDDMYEHILWTEEDFNNIVTVNPDLYERTIVLNGVSKAYSMTGWRIGYAAGPQPLIASMKKIQSQSTSSPTSIAQVAAQAALEGNQQCVKDMVTVFKKRHDFMVDALNEIDGIECLNGDGTFYLFPSFKGAQAKLNCETDTDLAEKLLEAGVALVPGSAFGTPGHMRISFATSDSNLEQSIERLKKALG

SEQ ID NO: 28947 - protein, 307 aa, Oceanobacter sp. RED65
MGSMQVKTPRHLLTLLDLTPAELQHITSRATELKRMHRAGEIYEPLKNKVLGMIFEKSSTRTRVSFEAGIAQLGGSAIFLSPRDTQLGRGEPIEDSAKVLSRMCDIIMIRTFGHDIVENFSANSRVPVINALTDDFHPCQLLADMQTYQEHRGSIKGKTVVWVGDGNNMCHSYINAAKQFDFNLVVNCPEGFEPMAELMEANKDRVKIIRDTKEAAKGAHLLVTDVWASMGQEEEQKEREKVFKSYQVSPAVMDLADKDALFMHCLPAHRGEEISHDMLDDPRSVVWDEAENRLHAQKALMEFLLSA

SEQ ID NO: 28948 - protein, 258 aa, Dechloromonas aromatica RCB
MSEAMTMTASTMAAPGLWATLKEDLSCVFQRDPAARSTLEVLTTYPGVHAILAHRLSHRLWQNGWRFPARFLSFLSRTLTNVDIHPGATIGHRFFIDHGACVVIGETAEVGDDVTLYHGVTLGGTSWNKGKRHPTLADGVVVGAGAKILGPICIGERVRVGANSVVVKDVPADRTVVGVPGRIVDTRVGTARPENGISLDHNVMPDPVAKSIACLIERIETLEKELAEIRHEPPPPDHSGDCRTCTAGDLCCEHEAMH

SEQ ID NO: 28949 - protein, 424 aa, Oceanobacter sp. RED65
MAARSNTPDFAYLRPKRCHFAFKATEELSVQHQAIMNTYGRLPVTFSHAKGAYVYDDKGNSYLDALSGIAVCGLGHAHPAVTQAICEQADNLVHVSNLYGINRQNELAEKLTKISGMDNVFFSNSGAEANEAAIKIARKYGNEKGVELPTILVAENAFHGRTMATLTATGNKNAQAGFGPLLDGFERVPYNDLEAAKKAIEKNPNIVAVLIEPVQGEGGVTAGLDDYLTGLRKLCDQNDLLYMLDEIQTGNGRTGQYFAYQHYNWKPDVVTTAKGLGNGVPIGACLAKGKAAEVLQPGSHGSTYGGNPLACSAGCAVIDTITSANLCERVQALGERIRHQLQSHLDNQQVTEYRGKGLMIGIVLNTDEACGAIMKMALDEGLLLNVTAGNVVRLLPPFILTDEQADTVAEKTANVIKAFLAEKQ

SEQ ID NO: 28950 - protein, 466 aa, Arabidopsis thaliana
VSTPNPWHVNLPTLALFLSSPRSSHSLDLWKSALLFNLKLRDRFRIAVDDHRGRATVFSPDGCFSSTIHRWVTRFRNFRRESLPSPPAFYRRRVSKDLTAEEESALFRMLQTVAVPLIGNACHVFMNGFNRVQVYGLEKLHDALLNRPKNKPLVTVSNHVASVDDPFVIASLLPPKFLLDARNLRWTLCATDRCFKNPVTSAFSRSVKVLPISRGEGIYQQGMDIAISKLNNGGWVHIFPEGSRSRDGGKTMGSAKRGIGRLILDADTLPMVVPFVHTGMQDIMPVGASVPRIGKTVTVIIGDPIHFNDILSTEGAQHVSRKHLYDAVSSRIGQRLYDLKAQVDRVYIEQQSMMSHNAKTPSDRAAEIFHRVDWDSFGMGAQFSEESSPSSKPIGQSDDRIVRSPKRRVSPEGGVSLKIKKLMDSTEMMGFAARGLLMNEYKSRVESANVGRPLKAWREYFMNRGL

SEQ ID NO: 28951 - protein, 126 aa, Candida glabrata CBS 138
MSAPNPKAFPLADEKLSQQILDVVQQAANLRQLKKGANEATKTLNRGISEFIIMAADCEPIEILLHLPLLCEDKNVPYVFVPSRVALGRACGVSRPVIAASITTNDASAIKNQIYAVKDKIETLLI

SEQ ID NO: 28952 - protein, 453 aa, Prochlorococcus marinus str. MIT 9313
MEHPFDLIVLGAGSGGLAAAKRAASHGAKVAIVEGDRVGGTCVIRGCVPKKLLVYGSLYREQLEVAPSFGVELSDAQINAGVLLANVRQEVDRLNTLHIDLLAKNGVELVTGWGSFTSPNSVAVSRNGAIDASQELHGDHILIAVGGRPHRPDIPGAELGWVSDDMFMQSSFPDRVVVVGAGFIACEFACILHGLGVEVIQLVRGDHLLRGFDRELSTAVQDGMQEKGIDLRFGENPAALKGQPGDLVLSTQSGERFSCGGVLLATGRRPFLQGLNLDAAGVVLEGRRISVDANQSTNIPHIFAVGDVTDRINLTPVAIDEGRAFADSVFGQKPRQVNHDLVASAVFSQPELATVGLTEEQSIDRYGKDQVKVYRARFRSMAQALPKRGPRCLLKLIVARNTDRILGCHMVGEHAAEIIQMAAIALGMGATKADFDRTMALHPTVSEEFVTMT

SEQ ID NO: 28953 - protein, 378 aa, Aeropyrum pernix K1
MKLYEFEAKEILRMYGVETPPSVLVMPGDDVAAKIREAGLEPPLVVKSQVLVAGRGKAGGIKLVESVEDAVRVAGELWRKPIKGILPGALLVEKAVPHDAELYTSIIIDRSERRPVILASRFGGMDIEEIAREKPESIVRHYVDPFLGLRGYEARMVGKAIGLSGRLLNSYASFLQVLYRVFTALEAELVESNPLAIVGDKVVPLDARIIVDDNSLFRHRELVERRRVEQRGEYTEWEVKARQQGLPFVELEGDIGIIGNGAGLTMATMDLVYHFGGRPANFLDIGGGARAELVKKAVSFLLEFPKAEKIFINVFGGITRGDEVARGIVAAVRESGSSKPLVVRLSGTREEEGRRILEEAGIYAYTDPVEAVKKVVSL

SEQ ID NO: 28954 - protein, 501 aa, Aspergillus oryzae
MELLPKLVILLLAALGIASVSIRRFLNRRQFARRCGCQPVARSFSKDPFLGLDTIPGTIRAIRQHRVLGRSCEIFRAYGNTFTVKELHQSAIVTIEPENIQAVLSLNFKDYTLRHRLELFMPLLGRGIFNTDGQHWASSRALIRPSFAREQVANLSLLERLMQDLFVLLPRDSTTVDLQELFFRYTIDSATDLLFGQSVGALKKSQSGLAFADALQYALKAIPVRDMLGPLNAVYRDRKTDECNRICRDFVQQYVEEAVYAAGPKKEEKESRTTETKRRYILSHELASRTSDKQRMVDELINVLLAGRDTTGSLLGNLFFMLAKNPVIWAKLRAEVAVLQNRPPTYEELRGLRYVQCCVNESLRLHPVVPTNKRKAMRDTVLPRGGGNDGLSPVFVPAGTLVGYNIYAMHRRTDFYGPDAKEFRPERWEDGKLQPRWGYLPFNGGPRICLGQRYALTEASYVLVRMAQEFRGLESRDPGSWEEGLVLTVCPRNGTKVGLIP

SEQ ID NO: 28955 - protein, 458 aa, Xanthomonas axonopodis pv. citri str. 306
MSDPSAPDHLQRSLSNRHLQLIAIGGAIGTGLFMGSGKTISLAGPSILFVYLIIGAMLFFVMRAMGELLLSNLEYKSFIDFSTDLLGPWAGFFCGWTYWFCWIITAIADVIAIAAYAQFWFPGLAPWIPAILCVLLLLGLNLVTVKLFGEMEFWFALIKIIAIAALIVTGAGLVVWGFRSPSGNVASLSNLWNDGGMFPMGIGGFFAGFQIAVFAFVGIELVGTTAAETADPRRNLPKAINSIPVRILIFYVLALIAIMAVTPWRQVVADKSPFVELFVLAGVPAAASLINFVVLTSATSSANSGIFSTSRMLYGLAEEQHAPKGFAKLSRAAIPARGLLFSCLCLLLGAMLVYLIPNLVTAFTLVTTLSAVLFMFVWSLILCAYIAYRRKRPEQHAASAFKMPGGVLMCYVCLAFFAFVIVLLTLQDDTRQALLASPVWFLLLAIGYAVKRRGNRQR

SEQ ID NO: 28956 - protein, 391 aa, Triticum aestivum
  misc_feature (233)..(233): Xaa can be any naturally occurring amino acid
  misc_feature (240)..(240): Xaa can be any naturally occurring amino acid
NKFVQKSRLVPVRNSRDIVDPRVRQLLGDPPVLGTWHNYTDFCYGGDYKTASALVECYEDSVTQLHIMGDPGARGRPLPATFSIDAFFTTLSRLPDLKVLTLTNLGLWGPLPGGKISRLQKLEIVNVSSNYLYGELPRGLSRLGSLQTLVADHNMLGGKLPGWLKDMPLLAVLSLRNNTLQGTLPESLKDMPSLRSLVLVSNNLSGDLPDLDLKNLQVIDMANNALRPKFPPXGAEGGPXGCLAGNSSATALPPDMLASCYLLERLDVSGNRFVGPFPAALLSLPSMEYLSIAGNRFTGRLSGNASCGENLRFVDLSSNLLTGSLPGCLAASSDSGKTVVLFSANCLSSGSGDESQSQHPSPFCRNQALAVGIVPEQEQGGKKKSGGKAGV

SEQ ID NO: 28957 - protein, 716 aa, Oryza sativa
MGKSSKKSAVEVAPTSVSVSEGKSGKKGKRNAEDEIEKAVSAKKQKTVREKVVPSKEEAKKVKKQPPPKKVESSSSEEDSSESEEEVKAQPKKTVQPKKAAQPAKEESSDDSSDDSSSDDEPAKKPVARPNKAALSTNSSSSDDSSDESSSDDEPVKKPAAPLKKPVALATNGSKKVETDSSSSDSSSDEESDEDDKKTAAPVKKPSVAAIQKKTQESDSSDSDSDSESDEDVPTKAPAVAKKKEESSESSDSESDSDSDDEAAKTIIPAKAAAVKKEEESSDSSDSDSESESDSDEPAKPTIPAKRPLTKDTKKGQSKDESEDSSDESSEESDDEPPQKKIKDSTTSGTTKPSPKATKKEISSDDESDEDDSSDESSDEDVKQKQTQAKKQAPVAQESSSSDESSEEDSDMESDEPAKTPQKKETAVSVGSNKSATKLGQEEPKTPASNQNQATGSKTLFVGNLPYNVEQEQVKQFFQEAGEVVDIRFSTFEDGNFRGFGHVEFATAEAAKKALELAGHDLMGRPVRLDLARERGAYTPGSGRDNSSFKKPAQSSGNTIFIKGFDTSLDIHQIRNSLEEHFGSCGEITRVSIPKDYETGASKGMAYMDFADNGSLSKAYELNGSDLGGYSLYVDEARPRPDNNREGGFSGGRDFNSSGRGGRRGGRGDGSRGRGDRGRGRGFGRGDRGHGGRGTPFKQSAGTPSAGKKTTFGDDD

SEQ ID NO: 28958 - protein, 479 aa, Prochlorococcus marinus str. MIT 9313
MALHRSNPRSNDLEEHAIGETVDALVSPLPRTTFPQEYRPALTTFNLLKEELLLDGNSKQNLATFCQTYESQQVAELMALAVDKNLIDKDEYPQTAEIERRCVSMMADLWHAPGEAVGCSTIGSSEAAMLGGLAAKWRWREHRKAAGQSIDRPNMVCGSVQICWTKFARYWDVELREVEMTSGELCMSPERMLEQVDENTIVVVPTLGVTYHGLYEDVQAVSQALDELQQRKGLDIPIHVDAASGGFLAPFCAPDLAPWDFRLPRVKSINSSGHKFGLAPLGVGWVLWRESRDLPEGLVFHVSYLGGDMPTFQINFSRPAGQVISQYYDFVRLGRDGYQAIHGASYANAQYVAQELKKLGPFELINDGNPAGGIPTVVWTLRADQELGFNLYDLSDRLRLRGWQVPAYPFTGELAHQAFQRILVKRDFSREMADLLLTDIRNAITHFESHPVKISLNANEAASTNHLGRSMVECRDAHG

SEQ ID NO: 28959 - protein, 233 aa, Arabidopsis thaliana
MASSSDPWMREYNEALKLSEDINGMMSERNASGLTGPDAQRRASAIRRKITILGTRLDSLQSLLVKVPGKQHVSEKEMNRRKDMVGNLRSKTNQVASALNMSNFANRDSLFGTDLKPDDAINRVSGMDNQGIVVFQRQVMREQDEGLEKLEETVMSTKHIALAVNEELTLQTRLIDDLDYDVDITDSRLRRVQKSLALMNKSMKSGCSCMSMLLSVLGIVGLALVIWLLVKYL

SEQ ID NO: 28960 - protein, 385 aa, Actinobacillus pleuropneumoniae serovar 1 str. 4074
MSLDLSDIRQQITQLDRHLLKLLAERHRLAFDVVRSKEITQKPLRDIEREKALLQALVSHAEAENYQLDPQYVTQIFQRIIEDSVLTQQNYLQNKLNAQKEQNVSIAFLGMRGSYSNMASRQFAKKYQGSLIELSCDSFQQVFDKVSGGEAEFGVLPLENTTSGSINDVYDLLQHTDLAVVGELAYPIKHCVLANGNIELTEIDTLYSHPQVIQQCSQFIQSLNKVHIKYCESSSHAMQMVARLNKPNIVALGNEDGGKLYGLTNIKTDIANQQNNITRFIVVAKQAINVSPQLQTKTLLLMTTSQQAGALADALMVFKQHQIRMTKLESRPIYGKPWEEMFYIELQANIHSENTQQALKALENVTSYIKVLGCYPSEIIEPVKL

SEQ ID NO: 28961 - protein, 329 aa, Pyrobaculum aerophilum str. IM2
MAELFWFEKYRPRSFDEVVDLEEVKARLREFVKAGNMPHLLFYGPPGTGKTTMALVLARELYGEYWRENTLELNASDERGINVIRERVKEFARTAPVGKAPFKLVILDEADNMTSDAQQALRRIMEIYAQNTRFILLANYVSRIIDPIISRCAVFRFSPMPRSLMAERLKFIAKNEGVELREDAINMIYELSEGDMRKAINLLQVAAATNKVVDANAVASAAIAVRPADIIELFNLAISGDFVKAREKLRELMYLKGIAGADFIRAFQRELIRMPIDDDIKAEIAELLADVDYRLTQGADEEIQLTYLLTKLGAIGRRVKPATTQPRKK

SEQ ID NO: 28962 - protein, 172 aa, Zea mays
MAFPKVFFDININGQAAGRIVMELYTDKTPKTAENFRALCTGEKGVGRKGKPLHFKGSSFHRVIPSFMCQGGDFTAGNGTGGESIYGDKFEDENFERKHTGPGNLSMANAGANTNGSQFFICTVKTDWLDGKHVVFGQVVEGLDVVKAIEKVGSSSGKPSKPVVIADCGQLS

SEQ ID NO: 28963 - protein, 387 aa, Clostridium acetobutylicum ATCC 824
MSKSYLMNTYGRFNVTFDKGEGTKLYDKDGNEYIDFVSGVAVNCLGHCNPSIVKAIEEQSSKLMHVSNYYWNENAMELTEILCKNSEFDKVFMCNSGTEAIEAGLKLARKYALLHGDENKKEIIYMDNSFHGRTMGALSVTGQPKYQESFKPLIGAVKSVKFNDLDDIKQKISSKTAAVIVEPIQGEGGIIPAKKEYLKLLRDLCDENNALLIFDEVQCGMGRVGSLFAYQKFEVVPDIVCIAKALGGGFPIGAMLAKESVASSFVPGDHGNTYGGNPLACAVAIAVLKELVDKKVVEINVNEKSKYLFDKLMTLKEKYKVINDVRGMGLLIGVEVACDVKKIINKCFESKLLLITAGKNVVRFLPPLNVSFEEIDKALGIFEESIK

SEQ ID NO: 28964 - protein, 295 aa, Clostridium acetobutylicum ATCC 824
MKKMQEPIEDPLSKLTQYSGKTFVIKYGGSIMKNKKAEEAFIKDVKYLRKLGINIVIVHGGGPEISRWLELSGIESRFVDGLRVTDEKVIEIVQMVLSGKINKKLSLQFNIDGVNAVGLSGVDNKLIEATKKYVYKGNETIDIGYVGKVTKVNSEFIKELLKGGQVPVIAPIGCDNKGNVYNINADYAAAFISSALDAEKLIILTDVEGVYRNINDPQSIIHEIDIKDVNYYIKEEIIKGGMIPKVQCCASAIENGTKNVQLIDGRNDHCLINDILNYRGTIISYRSGVKCQKAI

SEQ ID NO: 28965 - protein, 690 aa, Staphylococcus aureus subsp. aureus NCTC 8325
MLRGQEERKYSIRKYSIGVVSVLAATMFVVSSHEAQASEKTSTNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVIPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMATTSRIIGHDAREEWRKNDGVVPVISSLHPSNQPFVNVTNDEPATRRGIWQVKPIIQGWDHVDFIGVDFLDFKRKGAELANFYTGIINDLLRVEATESKGTQLKAS

SEQ ID NO: 28966 - protein, 561 aa, Pseudomonas aeruginosa UCBPP-PA14
MTHLKITGMTCDSCAAHVKEALEKVPGVQSAVVSYPKGTAQLAIVPGTSPDALTAAVAGLGYKATLADAPLADNRVGLLDKVRGWMAAAEKHSGNEPPVQVAVIGSGGAAMAAALKAVEQGAQVTLIERGTIGGTCVNVGCVPSKIMIRAAHIAHLRRESPFDGGIAATVPTIDRSKLLAQQQARVDELRHAKYEGILGGNPAITVVHGEARFKDDQSLTVRLNEGGERVVMFDRCLVAAGASPAVPPIPGLKESPYWTSTEALASDTIPERLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 28967 - protein, 477 aa, Comamonas testosteroni
MSTVLYRCPELLIGGEWRPGRHEQRLVVRNPATGEPLDELRLASADDLQLALQTTQQAFEHWRQVPAHERCARLERGVARLRENTERIAHLLTLEQGKTLAEARMECAMAADLIKWYAEEARRVYGRVIPARLPNSRMEVFKFPVGPVAAFSPWNFPLVLSARKLGGAIAAGCSIVLKAAEETPASVAAMVDCLNQELPPGVVQLLYGVPAEVSQALIASPVVRKVTFTGSVPVGRHLAELSARHLKRITLELGGHAPVIVCGDADIARTVNLMVQHKFRNAGQACLAPTRFFVDRRIYGDFVDAFGAATQALRVGAGMAAETQMGPVASARRQAAVQDLIARSVAAGARPVASAVPEAGYFVAPTLLADVPLDAPVMSEEPFGPVACAVPFDSLDQAIAQANHNPYGLAGYLFTDSAKAILAVSERLEVGSLAVNGMGVSVPEAPFGGVKDSGYGSESGTEGMEAFLDTKFMHYVA

SEQ ID NO: 28968 - protein, 300 aa, Prochlorococcus marinus str. MIT 9313
MSWKVADIPDQKGRVALVTGANSGLGLETAKALLNKGARVIMACRSLPTGEDVRQVILERNDSTKLDLIELDLADLASVRRAAEQVESQYSRVDLLINNAGVMATPKTLSKQGLELQFAVNHLGHMALTLKLLPLLAKQHGARVVTVTSGAQYMGRIAWDDLQGIKQYDRWAAYSQSKLANVMFALELDKRMRQTASGIASLLAHPGLARTNLQPKSVAANKSWQEGLAYRLMDPMFQSAAMGSLPQLHAATAPTAQGGEQYGPRFNFRGYPKLCSVAPLALREEDRQRLWSISEKLLEI

SEQ ID NO: 28969 - protein, 500 aa, Brassica oleracea
  misc_feature (262)..(262): Xaa can be any naturally occurring amino acid
MGRKMLADGELDKAVAAEEATETHYDFDLFVIGAGSGGVRAARFSANNGAKVGICELPFHPISSEEIGGVGGTCVIRGCVPKKILVYGATYGGELEDARNYGWEINENVDFTWKKLLQKKTDEILRLNNIYKRLLANAAVKLYEGEGRIVGPNEVEVRQIDGTKISYTAKHILIATGSRAQKPNIPGHELAITSDEALSLEEFPKRAVVLGGGYIAVEFASIWRGMGGTVDLFVRKELPVRGFDDEMRALVARNLEGRGVNXHPQTSLTQLIKTDDGIKVISSHGEEFMADVVHLLLARNPNTKRLNLEAVGVELDQAGAVKVDEYSRTNIPSIWAVGDATNRINLTPVALMEATCFANTVFGGKPTKADYSNVACAVFCIPPLAVVGLSEEEAVEKATGDILVFTSGFNPMKNTISGRQEKSLMKLIVDEQTDKVIGASMCGPDAAEIMQGIAIALKCEATKAQFDSTVGIHPSSAEEFVTMRTVTRRIAYKAKPKTSL

SEQ ID NO: 28970 - protein, 372 aa, Thiobacillus denitrificans ATCC 25259
MSKRDYYEVLGVAKNASDEEIKKAYRKLAMKHHPDRNPGDHAAEDKFKEAKQAYEILSDSDKRAAYDQFGHAGVDPQSGMGGGGFGGGGFSDAFSDIFGDIFGGGGGNRRDRVYRGADLRYNLEIGLEEAARGTETKIRIPTLEECGTCHGSGAKPGTQPTTCSACGGHGQVRVQQGFFSVQQTCPRCGGTGKMVSDPCPSCHGEGRVKKHKTLSVKIPAGVDSGDRIRLAGEGEAGVNGGPSGDLYVVIHLKDHPVFKRDGDDLHCEMPISFATAALGGEVEIPTLDGHAKIKIPAETQSGKVFRLRGKGIKGVRSHAPGDLLCHMLVETPVNLSERQRELLREFEALSPGRNNNPRAQSFMDKVKSFFGT

SEQ ID NO: 28971 - protein, 487 aa, Ralstonia eutropha JMP134
MSPSPTLYRNYVDGRFVESAKGFPNISPVNGAVIGTVCEAGADLVDRAVRAARAALAGPWGRTTPAERARVLQAVADGIEKRFDAFVAAEVADTGRPEHQARTLDIRRGVQNFRTFAELAGQAGGECFEMRAADGDVFSYTVRKPHGVVAIISPWNLPMLLMTWKVAPALACGNAVVIKPSEETPGSATLLAEVMHEAGVPPGVFNLVHGFGGGSAGEFLSRHPDIDAITFTGESRTGSTIMKAVADGVKEVSFELGGKNAAVVFADCDFDQAVAGVTRSSFTNTGQVCLCSERVYVERPIFERFVAAMKARAEAMRIGYPDEDGVEMGSLISHGHRDKVLSYFALAREEGATVVAGGGVPQFGDARDNGAYVQPTIWTGLPDSARCVQEEVFGPVCHIAPFDSDDEVVARVNDSRYGLAASVWTRDLGRAHRVTRQFDVGIVWVNTWFLRDLRTPFGGTRLSGIGREGGRHSLDFYSSTTTICVNP

SEQ ID NO: 28972 - protein, 437 aa, Solanum tuberosum
MASSYCLYAILLCSLLFITSTIAQNQTSFRPKGLIIPVTKDASTLQYLTQIQQRTPLVPISLTLDLGGQFLWVDCDQGYVSSSYKPARCRSAQCSLGGASGCGECFSPPRPGCNNNTCGLLPDNTVTRTATSGELASDIVSVQSTNGKNPGRSVSDKNFLFVCGATFLLQGLASGVKGMAGLGRTRISLPSQFSAEFSFPRKFALCLTSSNSKGVVLFGDGPYFFLPNREFSNNDFQYTPLFINPVSTASAFSSGQPSSEYFIGVKSIKINQKVVPINTTLLSIDNQGVGGTKISTVNPYTILETSLYNAITNFFVKELANVTRVAAVAPFKVCFDSRNIGSTRVGPAVPSIDLVLQNENVVWTIFGANSMVQVSENVLCLGVLDGGVNSRTSIVIGGHTIEDNLLQFDHAASRLGFTSSILFRQTTCANFNFTSIA

SEQ ID NO: 28973 - protein, 304 aa, Actinobacillus pleuropneumoniae serovar 1 str. 4074
MIELNGEPFGQMRQTYGGDTLNTATYLARVSTPEQIQVCYVSALGTDKLSQGMLAYWQADGIDTQWVLKDEQRSPGLYLIQLDKKGERTFLYWRNQSAARYLLQHSNFPQVLSELDSVDMIYLSGISLAILPENDRKLLITSLAKLKQAGVEIAFDSNFRPKLWESLEQAQACYRELLPLVDVALVTFDDEAMLWQDEDEQQTIARLSAYGIAKIIVKQGSRGAVVCEHLQQTFVPTIPVEHVVDTTSAGDSFNAGFLAGYLQGKPLAVCCRQGNQLAGIVIQHKGAIIDKSATAHLFAQFNAM

SEQ ID NO: 28974 - protein, 134 aa, Brassica napus
VDPRVRIKPLMAALSFHQFFEGLGLGGCISLAELQSKSTVIMAAFFSVTAPLGIGIGMGMSSGLGYGRESKEAIMVEGMLNAASAGILIYMSLVDLLAPDFVNPRLQSNLWLHLAAFLSLLLGAASMSLLAIWA

SEQ ID NO: 28975 - protein, 720 aa, Mycobacterium tuberculosis H37Rv
MPDNTIQWDKDADGIVTLTMDDPSGSTNVMNEAYIESMGKAVDRLVAEKDSITGVVVASAKKTFFAGGDVKTMIQARPEDAGDVFNTVETIKRQLRTLETLGKPVVAAINGAALGGGLEIALACHHRIAADVKGSQLGLPEVTLGLLPGGGGVTRTVRMFGIQNAFVSVLAQGTRFKPAKAKEIGLVDELVATVEELVPAAKAWIKEELKANPDGAGVQPWDKKGYKMPGGTPSSPGLAAILPSFPSNLRKQLKGAPMPAPRAILAAAVEGAQVDFDTASRIESRYFASLVTGQVAKNMMQAFFFDLQAINAGGSRPEGIGKTPIKRIGVLGAGMMGAGIAYVSAKAGYEVVLKDVSLEAAAKGKGYSEKLEAKALERGRTTQERSDALLARITPTADAADFKGVDFVIEAVFENQELKHKVFGEIEDIVEPNAILGSNTSTLPITGLATGVKRQEDFIGIHFFSPVDKMPLVEIIKGEKTSDEALARVFDYTLAIGKTPIVVNDSRGFFTSRVIGTFVNEALAMLGEGVEPASIEQAGSQAGYPAPPLQLSDELNLELMHKIAVATRKGVEDAGGTYQPHPAEAVVEKMIELGRSGRLKGAGFYEYADGKRSGLWPGLRETFKSGSSQPPLQDMIDRMLFAEALETQKCLDEGVLTSTADANIGSIMGIGFPPWTGGSAQFIVGYSGPAGTGKAAFVARARELAAAYGDRFLPPESLLS

SEQ ID NO: 28976 - protein, 320 aa, Idiomarina loihiensis L2TR
MGLLVDGQWHDKWYDTKKHGGRFVRSESQFRNTVAQGTEFEPESGRYHLYVSYACPWAHRALIFRKLKGLESHIDVSVVHPLMLENGWEFSDAPLNEPLYDADFLYQLYLKADPEYTGRVTVPVLWDKKNQTIVNNESAEIIRIFNSAFNELTGNTSDFFPAGKQKQIEEVNEWVYNDINNGVYRSGFATTQHAYEEAYESLFAALDKVENILSQSRYLAGDVLTEADWRLFTTLVRFDAVYFGHFKTNKKRIVDYPNMWNYLLELYQYPGVEETVVMDHIKTHYYASHKTINPTQIVPKGPEIDFHQAHNRGSKGSSQS

SEQ ID NO: 28977 - protein, 196 aa, Chlamydophila caviae GPIC
MESLFIGKAAPDFSVQAVVNGEVKNVSLKDYRGKYVILFFYPKDFTYVCPTELHAFQDSLEEFENRGAQIIGCSVDDLDTHKRWLNTDKKAGGVKGITYPLVSDTTHELSKLYGVLDSLSGLSFRGSFLIDKEGIIRHLVINDLPLGRSIDEELRVLDALIFYENHGLVCPANWQQGQKAMAPNEEGLKEYFGTID

SEQ ID NO: 28978 - protein, 300 aa, Zea mays
MNGRPDKEYLHWKWKPYGCDLPPFDAVRFLDSVRNKGWGLIGDSILRNQVQSLLCLLSKAEEPVEVYHDNEFKNRRWHFQSYNFTVSIVWAPFLIKSGIFENEDGVSTSEIQLHLDILDANWTTVYWKNGAVVGGHNSQNKNVAELGFEHLYQKTLQNVFNFIVSAKHKPVIFFRTWSPDHFEDGEWFSGGSCRRKLPYNKGEYREGNIERVMRQIELESFNKAVAALRGSADMDRLRLMDTYSLSSLRPDGHVGPYRTPYPFARGSSKSTPVQNDCLHWCVPGPIDAWNDLVMKMALDP

SEQ ID NO: 28979 - protein, 288 aa, Candida glabrata CBS 138
MFLTRRSAIAARRLTSNIKLCAWNSTQSNNTTHFGSKTVPVEEKEKLVGDVFSSVASKYDLMNDVMSLGIHRCWKDHFIHKLDAGKRPNSTEPLNFIDVAGGSGDIAFGLLDYAEEKFHDTESTMDVVDINPDMLKEGEKRAMENKKYYNDPRVNFMVQNGEVLDKIPSDSKDVYTISFGIRNFTNIQAGLNAAYRVLKPGGIFYCLEFSKIENPVMDLAYQQWAKLLPVMGSIVANDYNSYEYLVESIERFPDQETFKSMIEKAGFKSVGYESLTFGVCAIHWGVKV

SEQ ID NO: 28980 - protein, 232 aa, Hyacinthus orientalis
ESFRSDYVLGEGGFGTVYKGYTDENARVGSKSLPVAVKVLNKDGLQGHREWLTEVNFLGQLRHPNLVKLVGYCCEDDHRLLVYEFMFRGSLENHLFRKTAAPLPWATRMMIALGAAKGLAFLHNAERPVIYRDFKTSNILLDSDYTAKLSDFGLAKAGPHGDETPCVNSSNGHIWICSSRSMQRLVIRRRGAMSTAFGVVLLQLLTGPGVGGQDPAPATEQSPPRLGPPPSL

SEQ ID NO: 28981 - protein, 509 aa, Arabidopsis thaliana
MAVLIIFILLCLLSFLCYSLFFMKPKDSRDGRDLPPSPPSLPIIGHLHLILLSTLTHKSFQRLSSKYGPLLHLRIFHVPIVLASSASVAYEIFRDQDVNVSFRHSPPIEESLFLGSYSFISAPYGDYWKFMRKLMVTKILGPQALERSRRFREDELDRFYKTLLDKAMKKESVEIVEEAAKLNNNTICKMIMGRSCSEETGEAERIRGLVTESMALTKKIFLATIFHKPLKKLGISLFKKEIMSVSRKFDELLEKILVEHEEKMEEHHQGTDMMDVLLEAYRDENAEYKITRNHIKSMFVDLFIAGTDTSSTTIQWIMAEIINHPKILERLREEIDFVVGKTRLIQETDLPNLLYLQAIIKEGLRLHPPGPLLPRTVQERCEIKGFHIPEKTILVVNSYAIMRDPDFWEDPDEFKPERFLSISRSGQEDEIRDKFLKYIPFASGRRGCPGTNLAYASVGTAVGVMVQCFDWKIEGENVNMNEAAGTMVLTMAHPLKCTPVPRTLNLLPP

SEQ ID NO: 28982 - protein, 424 aa, Chlamydia muridarum Nigg
MFDVVISDIEAREILDSRGYPTLYVKVITNTGIFGEACVPSGASTGIKEALELRDQDPKRYQGKGVLQAVANVEKVLLPALQGFSVFDQITADAIMIDADGTSNKEKLGANAILGVSLALAKAAAATLERPLYRYLGGAFSHVLPCPMMNLINGGMHATNGLQFQEFMIRPISAPSLTEAVRMGAEVFHTLKKILQNRQLSTGVGDEGGFAPQLASNSEALDLLLAAIEKAGFIPGEDISLALDCAASSFYNTQDKTYDGKSAADQVAVLTELCDRYPIDSIEDGLAEEDFEGWKLLSETLGDRIQLVGDDLFVTNSALIAEGIAQGLANAVLIKPNQIGTLTETAEAIRLATTQGYATILSHRSGETEDTTIADLAVAFNTGQIKTGSLSRSERIAKYNRLIAIEEEIGPEAVFQDSNPFSKA

SEQ ID NO: 28983 - protein, 143 aa, Idiomarina loihiensis L2TR
MALERTLSIIKPDAVAKNLIGAIYNRFESAGLRIVGAKMMHLSKEQAEGFYAEHKERPFFGALVEFMTSGPIVVQVLEGEDAVRKNRDIMGATNPAEALAGTIRADYAETIDENAVHGSDATESAAREISYFFSDEEVCQRTR

SEQ ID NO: 28984 - protein, 492 aa, Prunus persica
MGSSSATSNRLLLSKIATSEGHGENSPYFDGWKAYDRNPFHPTKNPEGVIQMGLAENQLSFDLIEDWIKKNPKASICTPEGVEEFKNVAIFQDYHGFPEFRKAVAMFMSKARGGRVTFDPNRVVMSGGATGANELVMFCLADPGDAFLVPSPYYPAFYRDLGWRTGVQIVPVDCDSSNNFQITKEALAAAYEKAQKNNINVKGLIITNPSNPLGTTLDRDTLESLVEFINQKNIHLVCDEIYAATVFSSPTFTCISEVIQNMNCNPNLIHIVYSLSKDMGLPGLRVGIVYSYNDDVVNIGRKMSSFGLVSSQTQHMLASMLLDEEFVARFLETSSKRLARRHGVFTKGLEEVGINCLKSNAGLFCWMDLRRLLKDRTFDGEMVLWRVIVNEVGLNVSPGSSFKCVEPGWFRVCFANMDDETVEVALKRIRTFVRQGKKAQDQAVQVKSPKRWKSNLRLSFSSSSTRRFDQDSVNVLSPHMMSPHSPLVRAKT

SEQ ID NO: 28985 - protein, 555 aa, Saccharomyces cerevisiae
SEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSISEQHPRYGGVYVGTLSKPEVKEAVESADLILSVGALLSDFNTGSFSYSYKTKNIVEFHSDHMKIRNATFPGVQMKFVLQKLLTNIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVKQAKLT

SEQ ID NO: 28986 - protein, 400 aa, Roseovarius nubinhibens ISM
MSILSDTLARVKPSPTVAVTTLANELKAAGKDVIGLGAGEPDFDTPEHIRAAGKRAIDEGKTRYTAPDGIAELKQAICDKFKRDNGLDYTPKQVSVGTGGKQILYNALMATLNPGDEVVIPAPYWVSYPDMVLLAGGTPVVAEASLESRFKLTPDQLEAAITPKTKWFIFNSPSNPTGAGYSRDELKALTDVLLRHPHVWVMTDDMYEHLAYDGFEFCTPAEVEPALYDRTLTCNGVSKAYCMTGWRIGYAAGPEPLISAMRKIQSQSTSNPCTISQWAAVEALNGSHEFIAANNEVFKRRRNMVVERLNAIEGITCPTPEGAFYVYPSIAGLIGKVTPGGTKIADDETFAKALLEDKGVAVVFGAAFGLSPNFRVSYATSDAALAEACDRIEAFCKGLS

SEQ ID NO: 28987 - protein, 263 aa, Triticum aestivum
GTRLQTIRDRDDVRGSDDTDSDTERDLERARRERIERRMARERIQERMERQRERARQIERVSARGRERTESLILINSNNEAIILQGTFGSDDNQEDSSNTSSGVSLGDYFLGPALDTLLQRLAESDLNRSGTPPAKKEAVAALPTVNIEEVLGCSVCLEDFEMGAEAKQMPCQHKFHSHCILPWLELHSSCPICRFQLPTEETKNPCESASTAGAMNRDGDNAAASSSDTESSNRNGDNHSDSPIFSALSTLFSDPFSSDDDE

SEQ ID NO: 28988 - protein, 525 aa, Pseudomonas aeruginosa UCBPP-PA14
MSQDIHAHRILILDFGSQYTQLIARRVREIGVYCEIHPFDMSNEAIIAFAPRGIILAGGPESVHEADSPRAPQAVFDLKVPLFGICYGMQTMAEQMGGKVQGSDVREFGYARVDVVGKARLLDGIEDHVDDDGVLGLDVWMSHGDKVTEMPAGFHILASTPSCPIAAMADDARAYYGVQFHPEVTHTKQGLRILSRFVLDICGCAALWTPSNIVDDAIATVRAQVGSSKVLLGLSGGVDSSVVAALLHKAIGDQLTCVFVDNGLLRLHEGDQVMAMFAENMGVKVIRANAEDKFLGRLAGVADPEEKRKIIGRTFIEVFDEEATKLQDVKFLAQGTIYPDVIESAGAKTGKAHVIKSHHNVGGLPEDMQFELVEPLRELFKDEVRKIGLELGLPYDMVYRHPFPGPGLGVRILGEVKKEYADLLRQADHIFIEELRAFDWYHKTSQAFVVFQPVKSVGVVGDGRRYAWVVALRAVETIDFMTARWAHLPYELLEKVSNRIINEIAGISRVTYDVSSKPPATIEWE

SEQ ID NO: 28989 - protein, 349 aa, Lactobacillus brevis
MNMTKRDFIDTNTYTKEEIQYMIDLGIKIKESIKNGYYPPLLKNKTLGMIFEQSSTRTRTSAEAAMTELGGHAQYLAPGQIQLGGHETIEDTSQVLGRILDIIGARVERHHTVAEVGKFAKVPVVNFMSDYNHPTQELGDIITMTEHLPKGKKLSDCKIVFVGDATQVCVSTMFMATKMGMDFVQFGPKGFQIKPETLKIGQQNAKVSGGSVTITEDADEAFKDADFIYTDVWYGLYEAELSEEDRMKIFYPKYQVNAELVAKASDHVKFMHCLPATRGEEVTDEVIDSDYSIVWDEAENRKTAMRAIFVYLLNPELRKAQASQAVADKYDAEFSLMLRNAVDDQRNAD

SEQ ID NO: 28990 - protein, 360 aa, Triticum aestivum
  misc_feature (126)..(126): Xaa can be any naturally occurring amino acid
  misc_feature (155)..(155): Xaa can be any naturally occurring amino acid
LRPAIYVITIEYSSYASNALGALPYGRPAGGRTSDFERPPGQVSGINAEPKANDQYLPPFVIVDESGKSVGPIVDGDAVVTFNFRADRMVMVAKALEFPDFDKFDRVRVPKIKYAGMLQYDGELKXLPSKYLVSPPLIERTSGEYLVKNGVRTFXACSETVKFGHVTFFWNGNRSGYFDETREEYVEIPSDSGITFNEQPKMKALEIAEKTRDAILSGKFDQVRINLPNGDMVGHTGDIEATVVACKAADEAVKMVLDAVEQVGGIYLVTADHGNAEDMVKRNKAGEPMLDKSGSIQILTSHTLQPVPVAIGGPGLHPGVRFRSDIQTPGLANVAATVMNLHGFQAPADYETTLIEVVDK

SEQ ID NO: 28991 - protein, 307 aa, Aeropyrum pernix K1
MEHEPPKELLEAGRIAAEAREYAAGLVEAGASCRRVCELVEEKIRSLGAVPAFPCNISLDSVAAHYTPGLRDDCSIGGGSVVKLDVGAAVEGYIADTAVTVDLGGGHRSLVEASVEGLRAAMKVLKPGARFYDIGRAVEQAVRRRGFKVVKNLSGHTIDRYTIHAGLSIPNYGDRTAWIHRIRPGMTFAIEPFATNGRGMVREGSTVNIYAYTGRKPRAMLGGLEERILRHVAEKYRTLPFTPRWLKGMAGDEEVERAVRLLAKLGALHAYPVLIEAGGGLVSQAEHTFYALRGGIVVVTEKGQPTI

SEQ ID NO: 28992 - protein, 347 aa, Nostoc punctiforme PCC 73102
MFQTQLQHPTSKDEMQTTQTLKQIIAGAWITQGIYVVAQLGIADLLKDGSKSYDELATKTGVDARSLYRLLRALASVGIFAEGNSGYFELTPVAESLQSDRTDSLRGYAIKSGQAWEWQPWGHLLESIKTGKPVFKNIFGMERFDYLATDPSASKIYTQAISSISGEQDAAIAAGYDFSFIHNLVEVGGGNGTLIASILKSNLTMQGILFDLPHVVADAKPVIEDLELQDRCQLVGGNFFESVPTSGDAYLLRYIIHDWDDERAIAILKNCYQAMQPDGRLLLVEMVIPQGNEPFFGKLLDLQMLVNYGGRERTQAEYQVLLKTAGFSLTKIYPVAPPISIIEAIRL

SEQ ID NO: 28993 - protein, 444 aa, Bacillus licheniformis ATCC 14580
MLKRIAVIGTGYVGLVSGTCFAEVGNSVVCCDIDAEKIRGLSAGVMPIYENGLKELVDKNVNENRLFFSTDIPKAIEEAEIIYIAVGTPMSETGEADLTFVKSVAEMIGKHLNGYKVIVNKSTVPVGTGKLVQAIIERNSKGEFPFDVVSNPEFLREGTAIYDTMNMERAVIGATSEKAAAIIEELHKPFQTKIVKSNLESAEMIKYAANAFLATKISFINDIANICERVGADVSKVSEGVGLDSRIGSKFLKAGIGFGGSCFPKDTMALLQIAKSVGYPFKLIEAVIETNQKQRAHIVQKLLDVFGDLNGMTISVLGLAFKPNTNDMRSAPSLDVIPMLRSLGAKVKAFDPIAVPEAEKLLGDQAVYSEDLYETIQDTDACVILTEWPEVQNMDIAKLKSALKNPVLIDGRNIFEIEQMRNEGMIYHSIGRPEVQGEGILTNV

SEQ ID NO: 28994 - protein, 451 aa, Candida glabrata CBS 138
MFKVKTLERRNLKQLSLGGGCLGGSAHAGSEELRHECNGNKLIVEDMALAVGSDEHIEPHSGSGSASASSMSGLSIHDHAGDAAKPATLAVDGHSGCNYDLRDLVQLGKLGSGNSGTVMKVLHVPSSRVIAKKTIVIEQNNAIVKQQIYRELTIMRSVAEHRNIVEFYGAHNLSSDSINGSNDVVILMEYMNCGSLDTITRTYKSLQRRGILAANRSYPVQEWFSKPVIISRIAYSVLNGLSYLYENYKIIHRDIKPSNVLINSKGRIKLCDFGVSRKLNNSIADTFVGTSTYMSPERIQGNKYTTKGDVWSLGLMLIELLTGEFPLGGHNDTPDGILDLLQRIVNEPAPKLPSSVIKVLPPDMVNFIDLCCVKVEKDRGSLQELLKHPFIVRFRTKESTDAFKLWTKDIRRWMQEERNYKKETSEHSMLLKKQHNTNDTRHSRHMTSSLK

SEQ ID NO: 28995 - protein, 304 aa, Triticum aestivum
  misc_feature (154)..(154): Xaa can be any naturally occurring amino acid
  misc_feature (218)..(218): Xaa can be any naturally occurring amino acid
  misc_feature (287)..(287): Xaa can be any naturally occurring amino acid
FGENPKRCIHCHRIHATAEQSSGQIVRLVVPDQICNGDGNLDMTAARYSSENALQQLEGRKFSVPSGSQLSSSQNLLKQKHHSDKTSPSNITSDCYSDRNCQFSPSISFAQRNLMVQKQVANLQPGQLINDEGQLGQQTLSRRASYPCENYELXKKGFGKRSKDTLGTSVVVDGSFVSSLSSDNSVEESSFRQLQDAVSQLDVKTKLCIRDGLYRLAXRSAQNRPVFPNAINRHEESRDAKDTQNMETSGKFVDHRSIETQTNPIDRSIALLLFHQPSDQVAGAVDXSSPLKSHNENHKAYAKN

SEQ ID NO: 28996 - protein, 77 aa, Thiobacillus denitrificans ATCC 25259
MDNVQRVIKVVAEQLGVNEADIKSESSFVGDLGADSLDTVELVMALEEEFGCEIPDEDAEKITTVQQAIDYVNSHSN

SEQ ID NO: 28997 - protein, 454 aa, Aeropyrum pernix K1
MGCAPNDLVVVKFGGSVLNGSPGFLAAGRLVLGLLESGLEPVVVVSAVKGVTDALLSSFERRDPGVGGAVGKTYLSIARELGLPPESVRDVSLASAEVSKLLWAAEVLGQWTPRVRDLVVSYGERLSAALMAGLLRRLGVEARWLGGGEAGIVTDGEFGDATPLYGYTEGVIRERLEPMLEEGVVPVVAGFTGATREGDTTLLGRGGSDLTATLLASALGAGRVVLYTDVPGILSGDPRVVGEPRRVGYMSYEEAWEVARLGLRKFHPRTFEPLIAGGLGVEVVVSDLRGRSTRIGPGRGGPPLKVVSLSRGVARLVVRGPSMAGKRGFLSRLAGLLAGRGVNILAIRQPPSETAIELVVDERDLPAAVEELGARSGAAGVRLEVERGFDVVSIVGWGAVEALPEALSAAEKTGGRLLSTGELSPSISILARGRTSPELARLLHRRVVESWVTG

SEQ ID NO: 28998 - protein, 256 aa, Thiobacillus denitrificans ATCC 25259
MEEGRFAQRANLQGRVALVTGASRGIGQAIALALGEAGATVVGTATSDKGAQAIGDYLVAAGVKGAGMTLDVTDAAEVDAVIAAIGKQFGDIGVLVNNAGITRDNLLMRMKDEEWDDILATNLTSVFRLSRAVLRAMMKARSGRIISIASVVGAMGNAGQTNYSAAKAGIMGFTKSLAREVGSRNITVNCVAPGFIDTDMTRALPDAQREALLAHIPLGRLGAADDIAQAVAFLASPAAGYISGTTLHVNGGMYMA

SEQ ID NO: 28999 - protein, 451 aa, Zea mays
  misc_feature (405)..(405): Xaa can be any naturally occurring amino acid
MGQKDSKPSHGYGYSSYDYGSASSGYTSRNTGNSSSSYSVRYAPSSENSVQPETHARLQRKYSKIGDDYRSLSQVTEALAQAGLESSNLIVGIDFTKSNEWTGKISFNRRCLHDIGNTPNPYEQAISIIGRTLSAFDEDNLIPCFGFGDASTHDQEVFSFYPENRPCNGFEEALDRYREIVPTLRLAGPTSFAPMIETAIGIVDSTGGQYHVLLIIADGQVTRSVDTQSGQLSPQERDTIDAIVRASQFPLSIVLVGVGDGPWDMMHQFDDNIPARSFDNFQFVNFTEIMSKSIAADRKEAEFALSALMEIPTQYKATIDLQLLGRRQRITPRIALPPPTRTAYSRSSSFSQQSGVYSRSSSFDQQTSGASQQRSESLKQQKKPAAPKRPDTYASERALEDRIVXLCPICMYKSKDLAFGCGHQATCYECGRNLERCPLCQQNITTRIRLY

SEQ ID NO: 29000 - protein, 176 aa, Oryza sativa Japonica Group
MVYYALYWWADLDNLTNLQPRYGCDDPTYPYYFKLRCENCGEVSAKATCVSLGEVVDLPNGRSTANLVQKCKLCGRDASIVMIPGQGTPLTMEQSQKGDRTCLMVFDCRGCEPIDFAFGNGWKAESLEGTSFDIDCSEGEFADYDEKGECPVGVGKLRSEFRVVKKQESRGKTKYV

SEQ ID NO: 29001 - protein, 480 aa, Zea mays
  misc_feature (45)..(45): Xaa can be any naturally occurring amino acid
MVKICCIGAGYVGGPTMAVIALKCPDIEVVVVDISKPRIEAWNSXSLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKLAANAFLAQRISSVNAISALCEATGANVSEVAYAVGKDTRIGPKFLNASVGFGGSCFQKDILNLVYICECNGLPEVANYWKQVIKINDYQKSRFVNRVVASMFNTVAGKKIAVLGFAFKKDTGDTRETPAIDVCKGLLGDKAQISIYDPQVTEDQIQRDLAMNKFDWDHPMHLQPTSPTAIKQVSCVWDAYEATKGAHGVCILTEWDEFKTLDYQKIFDNMQKPAFVFDGRNIVDPEKLREIGFIVYSIGKPLDAWLKDMPAVA

SEQ ID NO: 29002 - protein, 95 aa, Oryza sativa Japonica Group
MIPGQGTPLTMEQSQKGDRTCLMVFDCRGCEPIDFAFGNGWKAESLEGTSFDIDCSEGEFADYDEKGECPVGVGKLRSEFRVVKKQESRGKTKYV

SEQ ID NO: 29003 - protein, 370 aa, Silicibacter pomeroyi DSS-3
MRTRAAVAVEAGKPLEVMEVNLEGPKAGEVLVEIKATGICHTDEFTLSGADPEGLFPAILGHEGAGVVLEVGEGVTSLKPGDHVIPLYTPECRQCEYCLSGKTNLCQAIRTTQGKGLMPDGTTRFSMLDGTPILHYMGCSTFSNHTVLPEIALAKVRPDAPFDKICYIGCGVTTGIGAVINTAKAEIGCRAVVFGLGGIGLNVIQGLRLAGADQIVGVDLNPDKVAMATRFGMTDFVNPAEVEGDMVAHLVELTRGGADYSFDATGNVGVMRTALECAHKGWGESIIIGVAPAGAEISTRPFQLVTGRVWKGTAFGGAKGRTDVPRIVDWYMDGKIEIDPMITHTLSLDEINKGFDLMHAGESIRSVVVY

SEQ ID NO: 29004 - protein, 425 aa, Silicibacter pomeroyi DSS-3
MKNAEIARRRDAAIARGVGMQTQIYVERAAGSEVWDVEGNRYIDFAAGIAVVNTGHCHPRVMQAVRAQAEAFTHTCHQVLPYESYIRLAERLNDRVPGDFDKKTVFVTTGAEAVENAIKIARAATGRPAVIAFGGAFHGRTFMGMSLTGKVMPYKTGFGAMMPDVYHVPFPVELHGTTTDEALAGIAKLFKTDLDPGRVAAIIIEPVQGEGGFYPAPAALMRGLRALCDSHGILLIADEVQTGFARTGHLFAMEGYDIAPDLTTMAKGLAGGLPLAAVTGRAEVMDAAAPGGLGGTYGGNPLGIAAAHAVLDVIDEEDLCHRANELGSRLKQRLTQVRERVPEIVDVRGPGFMIAAEFNTADGGAPNPDFANAVRAQALSRGLVLLTCGVFGNVIRFLAPLTIPEDVFAEALEILETSILAVKGG

SEQ ID NO: 29005 - protein, 214 aa, Carica papaya
EMMHTMSLIHDDLPCMDNDDLRRGKPTNHKVFGEDVAVLAGDALLSFSFEHLAVATVGVDPSRIVRAIKELAKSIGTEGLVAGQVVDICSEGMTDVGLEHLEFIHVHKTAALLEAAVVLGAILGGGTDEEIEKLRKFARYIGLLFQVVDDILDVTKSSQELGKTAGKDLVAEKVTYPKLMGIEKSRELAEKLNKDAQEQLRDFDEEKAAPLMAL

SEQ ID NO: 29006 - protein, 210 aa, Haemophilus ducreyi 35000HP
MTEPTIKLNYHKTRFLTSAPDIRHLPEDNGIEIAFAGRSNAGKSTALNALTNQKSLARTSKTPGRTQLINLFEVEPQCKLVDLPGYGYAAVPEQMKLQWQKALGEYLQKRDCLAGIVILMDIRHPLKDLDQQMIEWAVSAQLPVLLLLTKADKLSQVARNKTAKMVNEAILPFQGDIQVEIYSALNKIGVDKLSNKLDSWFAPIFQQEGK

SEQ ID NO: 29007 - protein, 861 aa, Chlamydophila caviae GPIC
MKKSLIVVESPAKIKTLQKLLGKGFIFASSLGHVVDLPAKEFGIDIDHDFEPDYQVLPDKQEVISQIRKLASSCDVVYLSPDPDREGEAIAWHIANQLPKNTHMQRISFNAITKGAVNEALKHPREIDMALVNAQQARRLLDRIVGYKISPILSRKLQQRSGISAGRVQSVALKLVVDREKAIEAFVPTEYWNIRVFLQDPKTSKTFWAHLYSADGKKWEKELPKGKTEDEILLINSEAKAQHYVELLEDASYRVTRVEAKEKRRNAAPPFITSTLQQEASRHFRFSSSKTMSVAQTLYEGVELDNEDATGLITYMRTDSVRIDPEALNNVRDYIQDTFGQDYLPKSPNLYATKKMTQDAHEAIRPTDIQLSPDKLQGKLTDDQFKLYSLIWKRFVASQMNPAIYDTLAMTISTNVKIDLRASGSLLKFKGFLAVYEEKIDDDVAEEENLSLPQLHAQDVLDKERVSAEQAFTKPLPRFTEASLVKELEKSGIGRPSTYATIMNKIQSREYTIKENQRLRPTELGKIISQFLETNFPRIMDIGFTALMEDELELIADNKKSWKLLLKEFWDQFLPVVTTAEKEAVIPRVVTDIECSACHKGKLVKIWAKNRYFYGCSEYPECDFKTSEEELAFNKDDYAVDTPWDSPCPVCAGKMKVRHGRFGTFLGCLNYPECRGTISIHKKGEEVEKEESIPCPAIGCSGKILKKRSRYNKTFYSCSEYPDCSVIGNTIDAVVTKYTGTTKTPYEKKTTGKKKSASKSRKTTKTPAKKKKSEGKTTKTTRVGALLTPSPELALMIGDEPVARGEATKKVWKYIKDHNLQSPENKKMLVPDDKFQAIIGPEPVDMFQLPKLLNQHLFKAG

SEQ ID NO: 29008 - protein, 486 aa, Silicibacter pomeroyi DSS-3
MTTLALNDPGLLETRAYVNGVWIEGGARFAVQDPATGDLIAEVADLGAADTAAAIDAAHAAGPGWAALTGKERGAILRRWHDLMIQNADDLATILTAEMGKPWAEARGEILYGASFLEWFAEEAKRVYGETIPGHQRDKRIVVLKQPVGVVGSITPWNFPNAMIARKVAPALAVGCTFVARPAELTPLSALAMAVLAERAGVPAGVFNVIPSQDAAGVGAELCANPKVAKITFTGSTRVGRLLMQQCAPTIKKMSLELGGNAPFIVFDDADLDAAVDGAMIAKFRNNGQTCVCANRIYVQARVYDAFADKLAAKAAQLRVGNGFDTGVTTGPLINSAAVSKVEAHIADALAGGAEVVLGGTRAPLGGTFFAPTVLRDVTRDMLVCREETFGPLAALVRFESEDEVIDMANDSEFGLAAYFYSRDLARVWRMAEALESGMVGVNTGLISTEVAPFGGIKQSGLGREGSRHGIEDYLELKYLCLGGIG

SEQ ID NO: 29009 - protein, 279 aa, Cryptococcus neoformans var. neoformans B-3501A
MMSSSPTSTPHQVPSFLANILLSHISPLDPPSTSSTTFDHHRSPTTQNPSHPQALQTAEPPPNPLYLPPPALPKVEEDLVPPENFALVSSGVYRCGFPKKRNFKFMETLRLKTVLTLVLEEYPKANLEWCQSQDIQFMQFGIPGNKEPFDNIPEDVICAALVAILDRRNHPILIHCNKGKHRTGCLIGCIRRLQAWSLTSIFDEYRRFSAPKSRAVDQQFIDLFDIMPVWEAVCRPKGGGLGNLPDWGMLVLPKGVVEVGRDGKEKKRVERDIFHMRGL

SEQ ID NO: 29010 - protein, 178 aa, unidentified eubacterium SCB49
MEKQRFTISIFTENVVGILHRVSIIFSRRKINVQSIAASESEIKGIYRYTVVIIETKDQVKKVVGQLEKQVEVVKAVFHTDEEVVHQEIALYKVKTGVLASGGSAEKIVRAHNARVLSVETNFTVLEKTGHKEETQQLFDDLEPFGILEFVRSGRVAITKPMRTLSSIVEELEQLIKN

SEQ ID NO: 29011 - protein, 502 aa, Magnaporthe grisea 70-15
MAPPQSAHEFLDFVNASPTPYHAVASSAALLEKAGFELIKERDNWSHSLRPGGKYYLTRNGSSIIAFAIGAKWRPGNPFAMVGAHTDSPTLRIKPVSRKTNSGFLQVGVETYGGGLWHTWFDRDLSIAGRALVRDGEGRFAQRLVKVDRPILRIPTLAIHLNRASEFNPNKETELFPIAGLVAAELNRTGAAAASSKDDGSADAAKDGDYQPLKAMTERHHPYIVDIVAENVGVSVDDVVDFELVLYDTQRSCLGGLNDEFIYSARLDNLNMTFCSVMGLIESVKSQDSLDTDSCIRLISCFDHEEIGSTSSQGADSNLLPAVIRRLCAVPASRFADDASSDKSYHKVEGDDDSATSTAFEQSLATSFLISADMAHSVHPNYAAKYESNHSPEMNKGTVIKVNANQRYATNSPGIVLLQESAKIAAVPLQLFVVRNDSSCGSTIGPMLSAKTGIRTLDLGNPQLSMHSIRETGGSYDVEHSIRLFEAFMSNYSKLEPKILVD

SEQ ID NO: 29012 - protein, 416 aa, Clostridium acetobutylicum ATCC 824
MNNNIFDSKELNLHNGIKVISIKKETALFSLHVGVKIGSIYESNEERGASHFVEHMLFKGTKSLTNEELNKRFENLGGEYNAYTDYNCTVYSVTALYEEMTKAVELISDMIQNPSFDEKEFKKEKKVILSELNSGKDDIEDYCYTKVHEIGFSKSPLKYDTIGTKANVEGFSRNFIFDFYKKYYIPNNCFIVIVSKLEHEQVFDLVEKYFGDWNKGEVKDKDIIVEENIPKIVTSHRKDISQSSIIYMFTAYNLNRFEEAALKILNYKLGESANSILFREIRENKGLAYDIYSDLNLSKNVKTMYIYTAVNNENVKETIDSINNCIEKIKYEEKWLDDNSILLMKKVLKTSLAFTIEDTTDIGNYVLHQCMDGEDIYEFVEDMRYADTIKNEDVRKVALKVLTNPSIYVVKAKGSV

SEQ ID NO: 29013 - protein, 466 aa, Zymomonas mobilis subsp. mobilis
MADHFDLIVLGGGPGGYVAAIRAAQLNLKVALVERVHLGGICLNWGCIPTKSLLRSAEVYHEMQNAEAYGLTSFKPDFDLDKIIARSREVAARLASGVKTLLRKNKVEVISGVGQLTGNQQMRVETTEGEEKILEAKDIIIATGARARQLPNVHSDGKHIWTYHHALKPPAMPKKLLVIGSGAIGIEFASLYADFGAEVSIVEHAPQILPMEDAEVSAYVAKAFKKRGIRILTQSALQNLTPDDEGVTAEIAGADGKVTKERFSHAIVAIGVVANVENIGLDKLGIKLDRGFIAVDGFGRTNVDHVWAIGDVAGAPCLAHKASHQGVIAAEDIAGCDHVHPLNTQNIPGCTYARPQVASVGLTEEKARQQGYNVKIGNFPFIANGKAIAQGATDGFVKTVFDADSGALLGAHMVGAEVTEMIHGYTVARTLETTEAEIMETIFPHPTLSEAMHESVLAAYGRALHF

SEQ ID NO: 29014 - protein, 622 aa, Physcomitrella patens subsp. patens
MARLLVALVLVVVAPSMGAFVVEENSLSVITPESLQGTYQSAIGNFGVPQYGGTLSGFVVLPKVNFKACDVFPADHFRAKPGARPNFALVDRGDCYFATKVWHAQEAGAAAVLVADNKQEELITMDSPEEDPAASQYLNNISIPSALITKDFADKLKKVLNGNELVTMKLDWRESLPHPDERVEYEFWTNSNDECGPKCDAQVEFVRNFKGVAQILERGGYTQFTPHYITWYCPQAFIESKQCKAQCINNGRYCAPDPEQDFSVGYDGKQVVTENLRQLCVFKVTNETSPRQPWKWWDFVTDFQIRCPMEEKKYGPACAEEVIKSLSIDVEAVRKCMGNPDADEENPILRNEQDAQVGQGTRGDVTLLPTLIVNQRQYRGKLDKTAVLKAICSGYQESTDPPVCLSDSVETNECLDNNGGCWKSGTLTACQDTFRGRICQCPLVSGVQLEGDGYTHCEANGSGRCKVLNGGCWEDTKGDIRYSACQDNQHSGCQCPEGFRGNGTAGADDINECKEKTKCQCSECKCTNTWGSYNCECSGGLLYMQEHDTCISKCSDSQSKLGLTVSLIVLAGISVLGLGGYVVYKYRLRSYMDSEIRAIMAQYMPLDSQNDSVQTHSQDNDV

SEQ ID NO: 29015 - protein, 466 aa, Candida glabrata CBS 138
MQTGNEENAVPSWYSVPGKEVHSDKAHEHRVALSDVTGLANSNFMHEKLHSNRCSGEPSSTARNSLEINLNHAVESDQENMVSIYASNTLDTPNSNDVSSLLEDQQLESIRRVTQHMSNTSNGDDSDSTTVANKDSHQGDNSNNTSDDALRNEYSEPPVNDDIRRTLMKAYQTYKLAYLDDSDEDNYDPVMVVELASGIFDYMKQLEIKYRPDPYYMDLQSELKPSYRSTLLDWIVQVDERFQLLPETLFLTINIIDRFLSKAAIKLNKFQLVGAVSMFIAAKYEEINCPTMKDFLYMLDNAYTKEEMIDAERFILNTLDFSIGWPGPMSFLRRISKADDYDYNIRTLAKYLLETTIMDARLIGTPPSWLASGAYFLSKTILSYGNEERDAEERSVYETGWTLKHVFYSGYTQEQVFPLSSLILENCRHAQERHSAIWTKYSDRRYHRSSVMVDKWIEVAESKMNS

SEQ ID NO: 29016 - protein, 101 aa, Glycine max
MSSNPNDPRQPSAARPYVAPQISPQDLPIDYAGFIAVIFGVAGVMFRYKLSSWLALIFCAQSVANMRNVENDLKQVMMAMMFSLMGLITNYFGPPRPGKQS

SEQ ID NO: 29017 - protein, 177 aa, Glycine max
DTSGIRSHTLSMLVNDAPGVLNIVTGVFARRGYNIQSLAVGHAEVEGLSRLTTVVPGTDESISKLVQQLYKLVELHEVRDITHLPFAERELMLIKIAVNAAARRDVLDIASIFRAKAVDVSGHTITLELTGDLDKMVALQRLLEPYGICEVARTGRIALVRESGVDSKYLRGYSYPL

SEQ ID NO: 29018 - protein, 128 aa, Acidobacteria bacterium Ellin345
MAYSEKVLDHYSNPRNVGSMDKNSAEVGTGLVGAPECGDVMKLQIKVNPETNIIEDAKFKTFGCGSAIASSSLATEWVKGKTVDEALGIKNTDIVKELSLPPVKIHCSVLAEDAIRAAIGDWKKKNNQ

SEQ ID NO: 29019 - protein, 501 aa, Oryza sativa Indica Group
MEQYEVLEQIGKGAFGSALLVRHKVEKKKYVLKKIRLARQTDRTRRSAHQEMQLIATVRNPFIVEYKDSWVEKGCYVCIIIGYCEGGDMTEAIKRATGDHFSEEKLCKWLVQLLMALDYLHANHILHRDVKCSNIFLTRDQSIRLGDFGLAKILTSDDLASSDMQALISKITKSIVSPLPTRYSGAFFASFFSLQAAELLKHPHLQPYVLQVHLKSSPARNIIPSHQSPIDKVKKMTFPTESMCRSKGRRNSLGNERIVTFSKPSPERKFTSSIQSVKDYSTTRSVKDLSIDVSLAEELLSRTPVNRSARVIRRASLPLPLPSSETPKRSVSSISILEQLESPDVSVNSPRIDRIAEFPLASSEDPPFLKLHGRRSPTPTPQHCVIDQSITKDKCMVEAFHIIDVDDDDGRSDLSSGRNNAAAAASSRAGSSESTRQRRFDTSSYQQRAEALEGLLEFSAQLLQQERYDELGVLLKPFGPEKVSPRETAIWLTKSFKETGL

SEQ ID NO: 29020 - protein, 313 aa, Silicibacter pomeroyi DSS-3
MILCCGEALIDMIAAPTIGGGHGFLPQPGGGALNTAIALGRLGQRVGLVTALSRDMFGQRLAEALTASHVDLSGAARVDRPTTLAFVQLRDGQPEYAFYDENSAGRMLSATELPPLPPEASALCLGGISLACEPGADAYADLLERHGAGRVVLIDPNIRPALVGDEARYRARLGAMIARADILRLSDEDLGWLCPDAPDLRAGARTLLALGPALVVVTRGAAGATGYLPEGAEVSVPAPRVNVADTVGAGDTFIAGMLSALAEQGLLTPAALAGLRAEALKPALTHGARVAALAVSRPGANPPWAHELAPPPG

SEQ ID NO: 29021 - protein, 473 aa, Prochlorococcus marinus str. NATL1A
MSKTSQDVLRQIKDEGIELIDLKFTDLHGKWQHLTVASDLIEESSFTEGLAFDGSSIRGWKAINESDMAMVPDPSTSWIDPFYHHKTLSLICSIQEPRSGEPYARCPRALAQKALDYLGSTSVADAAFFGPEPEFFIFDDVRYNSGEGSSFYSVDTIEAPWNSGRVEEGGNLGYKIQLKEGYFPVSPNDTAQDMRSEMLLLMGELGIPIEKHHHEVAGAGQHELGMKFAPLINAADNVMIYKYIVRNVAKKYGKTATFMPKPVFNDNGTGMHVHQSLWKGGQPLFYGEGTYANLSQTAKWYIGGILKHAPSFLAFTNPTTNSYKRLVPGFEAPVNLVYSQGNRSAAVRIPLTGPSPKAKRLEFRSGDALANPYIAFSAMMMAGIDGIKNQIDPGDGVDVDLFELPSEELSKIDTVPSSLNDALEALKNDSKYLTEGGVFTEDFINNWIELKYEEVQQLRQRPHPHEFTMYYDA

SEQ ID NO: 29022 - protein, 456 aa, Bacillus cereus G9241
MYSYIFYCIFLCEKEMKITIIGTGYVGLITGVGLAVLGHSVTCFDINNEKMERIKQGDLPIYEAGLYELIHDACENNRLTFTTSKEEAFNDAEFIFIAVGTPSLLDGTADLTYIQNACVDIGTYATKDIIVVTKSTVPVGTNDAMRGWIGETLQNRHELHIVSNPEFLREGSGIYDFFRGDRIVIGADNEEAARKVENLYSELHVKTYVTDIKSAEMIKYASNAFLATKISFINEISNICEKVGANVLDVAKGMGMDKRIGSSFLNAGIGYGGSCFPKDTKALVQIAGNVAHDFRLLKAVIEVNNKQQLLLIEKAKKVMNMNKKRIAVLGAAFKPNTDDIRDAPSLIIIQELMNIGADIVLYDPKAIQNMKNIFGKTIQYSECIDESIRGASAAFIMTEWEAIRAYPLEKYAQLMREPILFDGRNCYTVEDVKKQEIDYYSVGRESICNKDFSFIR

SEQ ID NO: 29023 - protein, 412 aa, Prochlorococcus marinus str. NATL1A
MQSLKKTPRLCLSPFRLGRYINRSVFLATQILPSVDNQHRKDFGPTVSPERLLLGPGPSNADPAVLKALSQPPIGHLDPFYVDLMSEVQELLRYAWQTSNRLTLPMSGTGSAAMEATLANVVEPEDTVLIAIKGYFGHRLADMAGRYKANVETIHKEWGNAFSLQEIEDALKKHTPAVLAIVHAETSTGVCQPMDGIGDLCRKYNCLLLVDTVTSLGGVPLYLDEWKIDLAYSCSQKGLSCPPGLGPFSMNERAENKMSNRKEKVPNWYLDVSLLNKYWGSDRVYHHTAPVNMNFGIREALRLLAEEGLEVSWGRHRTNAKSLWNSLENIGLELHVKEELRLPTLTTVKIPEGVDGKAFTKHLLNNFGVEIGGGLGDLAGKVWRIGLMGYNSTSENVDKIINIFETELPKFR

SEQ ID NO: 29024 - protein, 419 aa, unidentified eubacterium SCB49
MIEIKPYVSLQNVKQAASILNEVVLKSPLQKNQILSEKFEADIVFKREDLQEVRSYKIRGAYHKISSLSPEELERGVVCASAGNHAQGVAYSCKLKKIKGVIFMPTPSPNQKIEQVKMFGGDYIDLILTGDTFDDSYEAAVKYCTKNKMAFVHPFQDIKTIEGQATIGLEMVAQSKKPIDYLFLPVGGGGLAAGVSSIIKEISPNTKIIGVEPEGAPSMSISIKNGINTKLEQIDKFIDGAAVQKVGDLNFEICKENLDQMVTVHEGKVCQTILDLYNKNAIVVEPAGALTTAALDQFSEEIKGKHVVCLVSGSNNDITRTSEIKERALLYSGHKHYFIVKFPQRAGALREFLNEILGPNDDITHFEYSKKHNRHSGPATVGLELHDPKDLDTLIVKMKKKNFYGEYLNDKPDLFQVLI

SEQ ID NO: 29025 - protein, 262 aa, Idiomarina loihiensis L2TR
MTISIKTPEEIEKMRAAGKLAASVLEMIGEHIKPGVTTEELDDICHKYITDHNAYPAPLNYHGFPKSICTSVNHCVCHGIPGPKKLKDGDIMNIDVTVKLDGYHGDTSKMFVVGKPSIMAERLIKVTQESLYKAIEMVKPGIKLGDFAEVIQKHAEGHGYSIVREYCGHGIGSVFHEDPQILHYGEAGTGEELKAGMCFTIEPMVNVGKRHTKLMKDGWTVLTKDRSLSAQWEHTLLVTDNGVEVLTLRSDEPDLARVIEHS

SEQ ID NO: 29026 - protein, 269 aa, Lotus japonicus
MTLPTNHNLFSLVFLVTILCSSLFLTTTASESKGEEYIYTKGARNGPENWGSLKPEWEVCRNGKSQSPIDIKNVEGFSQLGKLKKDYKVAPATLKNRGHDIMLQWDGDAGKLNINGTYYKFVQSHWHTPSEHTLNGSKFDMEMHAVHENSKGERAVIGIWYTIGQPDPLLSKLLDNIKLSGDNKDIDLGILNPGLIKFGSRKYYRYVGSLTTPPCSEGVIWTIVKKVRTVSREQLKALKEAVHDGFEINARPTQELNGRKVWLYTPNVV

SEQ ID NO: 29027 - protein, 456 aa, Haemophilus ducreyi 35000HP
MSKHYDYIAIGGGSGGIASINRAASYGKKCAIIEAKQLGGTCVNVGCVPKKVMFYGAHIADAINHYAEDYGFDVSLKQFDFKKLVASRQAYISRIHSSYQQVLSKNNVDVFNGFARFVDPKTIEVHYPDGSTENLTADHILIATGGRPTIPEVIGAEYGIDSNGIFALTELPKRVAIVGAGYIAVELAGVFNSFGVETHLFVRQHALLRTQDPLIVDTLLAVLAQQNIKLHTQAISKQVVKNADGSLTLTLQDGRQTEVDCLVWAIGREPTTDVINLAAAGVETNSRGFIKVDKFQNTNVTGIYAVGDIIEGGIELTPVAVAAGRRLAERLFNNKPNEHLDYSLVPTVVFSHPPIGTVGLTEPQAIEQYGAENVKVYTSSFTAMYTAVTQHRQPCRMKLVCIGEQEKIVGLHGIGFGVDEMIQGFAVAIKMGAVKADFDNTVAIHPTGSEEFVTMR

SEQ ID NO: 29028 - protein, 84 aa, Cryptococcus neoformans var. neoformans B-3501A
MTARKEQMKQSIQQELAIANAQQLINKINENCFAKCVTKPSTSLSSSQESCLSQCMTLYMAAFDQVSRSYVARISKERGVAPGL

SEQ ID NO: 29029 - protein, 270 aa, unidentified eubacterium SCB49
MEKLPKLGIPVIILLVIGAIVLMKSFVKIESGETGVLYKLSDGVVTDEPPLGEGLHLIAPWNQVIKYEIRQQELFEKMKVLSSNGLEIQIDASAWYQPVPNDVAKLHQTLGEDYLQRVIQPAIRSAARSVVGRYTPEQLYSSKRDAIQDEIFIELKAILDKQYVQLNELLVRDVTLPATIKTAIERKLKQEQESLEYEFRLVTAAKEAEKVRIEAQGKADANRILSASLTDKILQDKGIDATIKLSESPNSKVIVIGSGDSGMPIILGDN

SEQ ID NO: 29030 - protein, 446 aa, Oryza sativa Japonica Group
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 29031 - protein, 330 aa, Kluyveromyces lactis NRRL Y-1140
MLHPLSTEIYFTFNNGNKVPAFGLGTAAQHERVAETKQAVKAAIKAGYRHIDTAWAYGVEEYVGEALQELFEERVVKREDLHITSKVWHTMWNDVDKSLNESLARLKVDYVDLFLQHWPLCTQKVPDPHGVDKIAKEPVDDQGNPLYDEKGDWIETYKQIEKIYLDKNDKRVRAIGVSNFPIEYLKRVLKECRTVPACNQVELHPHLPQRELCEFCSEHKILVTAYSPLGGNGAPLLELPILKGLCEKYNASPNDILTSYHLRQGTIVIPRSLNSTRIASNLEFVPLSEEDVNKLNEFGQKNKKRYINGAVSSVIPGFKEDFLKEQLQQS

SEQ ID NO: 29032 - protein, 162 aa, Hyacinthus orientalis
KIVLQPSLSLANSTLNLANPNPSNQGKGDGWDGGKRQGPQRRTRGRRGSSKAGLQFPVGRIARFLKAGKYAERVGAGAPVYLAAVLEYLAAEVLELAGNAARDNKKTRIVPRHIQLAVRNDEELSKLLGMVTIANGGVMPNIHNLLLPKKAGSSKNAPADDE

SEQ ID NO: 29033 - protein, 397 aa, Populus tremula x Populus tremuloides
MGIKLFMISFMVTSILFSLLYIPTKLTTPIAKYNPVINLNMLKDLKPYPVTFAYLISASRGDAKRLMRVLKALYHPGNYYLIHVDSDAPEKEHREIAEFVSSDPVFGLVGNVWIVGKPNLVTYRGPTMLATTLHAMAILLRTCKWDWFINLSASDYPLVTQDDLIDAFSTLPRNLNFIQHSSRLGWKLNKRAKPIMIDPGLYSLNKSEIWWVIKQRSLPTAFKLYTGSAWTILSRSFAEYSIVGWDNLPRTLLLYYTNFVSSPEGYFQTVICNSEDYKNTTVNHDLHYITWDTPPKQHPRSLGVKDYRRMILSSRPFARKFKRNDPVLDKIDRELLKRYKGQFAHGGWCARSGKRHGTCSGLQNGNYGVLRPGPGSRRLQNLLTKLLPEKNFKRQCR

SEQ ID NO: 29034 - protein, 188 aa, Aspergillus nidulans FGSC A4
MFASRRLTAAASVPRAFSQRALFHRTAPAFVQKGDPIPDLDVLVENSPGNKVNLAKELKGKGVIIGVPAAFSPACSSTHVPGYISHPKLKEAGQVFVVAVNDPFVTKAWGTTLDPTGKSGIRFLGDPTGKFSEALDVTFDSTTIFGNQRSKRYALLVEDGKIKEAFVEPDNTGVKGIISSPAAIPPAC

SEQ ID NO: 29035 - protein, 422 aa, Populus tremula x Populus tremuloides
MRTSKISSGNSGYHVWILAFAMSLLILIALSKSWFYDHASAAASEDLQYFSVIVPSKGRDYPPVLAYWICGTSGDGKRMLRLLKAIYHPRNQYLLQLDAESSDYERAELVVSVQSESLFQAFGNVNVVGKGFAINEMGSSALAAILNAAALLLKLSTDWDWFINLSVSDYPLVSQDDLLHAFTSLPRDLNFINYSNDTAKNEIHKINQIVVDPSLHLQKRSHLYYAVETRTTPDAFKIFGGSPWLILTRAFMEYCVQGWDNLPRKLLMYFSNTASPLESYFHSVLCNSPEFQNTTVSDDLRYNILETTTDGESPYDKMLNGGAAFARPFKEDAAALNMIDENVLNREPNGLVPGKWCLDQGMNKSSEASKPPGEDLCSTWGNINDVKPGSYGIKLAFLLSKIASEEKLTTSQCLQATKMGSS

SEQ ID NO: 29036 - protein, 334 aa, Triticum aestivum
  misc_feature (19)..(19): Xaa can be any naturally occurring amino acid
  misc_feature (249)..(249): Xaa can be any naturally occurring amino acid
DPRVRAGIIPSLNISAGCXGCFFARLWAAAEARLGLPRRPFTRQENTVIQTCVVAAYGIAFSGGFGSYMFAMSSRIAGQATEANDAMNVKDPSLGWMIGFLFLVCFVGLFALVPLRKVMIIDYGLSYPSGTATATLINGFHTPQGAKEAKEQVKTLGRYSLVSFLWGFFKWFYTAGDDCGFESFPSLGLEAYERKFYFSFSPIYVGVGMICPYIINVSILLGGILSWGLMWALIEKKKGSWYPGHARGXRLHGLQGYKVFISIAMILGDGFLHFVKVRLRMTKASWQQPEEEQLPVFGSVRPGEVLDEITASTEYSSGPIPRAWAGWYFPWHGS

SEQ ID NO: 29037 - protein, 379 aa, Populus trichocarpa
MASMYNPETSAVQDQQQYQQNPTLLYDALYCSEENWVEEVREDCFQDELEGESYCSNNSNKLNTFPIFLEQDLSWEDEELSSLFAKEEQNQLCKDLETNPSLARARCEAVEWILKVNEHYSFTALTAVLAVNYLDRFLFSVHLQKEKPWMAQLAAVSCLSLAAKVEETQVPLLLDFQVEDSKYVFEAKTIQRMEILVLSTLKWKMNPVTPISFLDYITRRLGLEHYLCLEFLKRCERMVLSILADSRSMPYVPSVMAAATMLYVIDNIEPSLAAEYQSQLLSILGIDKDKVEDCSKFLMEFALRYHFKLLSNKRKFCSLPGSPSGVVDVSFSSDSSNDSWSVASSVSSSPKPLSKKSRALQSLNNATTSDFSQHSSLVP

SEQ ID NO: 29038 - protein, 519 aa, Arabidopsis thaliana
MGLVIFLALIVLILIIGLRIFKAFMILVWHPFVLTRRLKNQGISGPNYRIFYGNLSEIKKMKRESHLSILDPSSNDIFPRILPHYQKWMSQYGETFLYWNGTEPRICISDPELAKTMLSNKLGFFVKSKARPEAVKLVGSKGLVFIEGADWVRHRRILNPAFSIDRLKIMTTVMVDCTLKMLEEWRKESTKEETEHPKIKKEMNEEFQRLTADIIATSAFGSSYVEGIEVFRSQMELKRCYTTSLNQVSIPGTQYLPTPSNIRVWKLERKMDNSIKRIISSRLQSKSDYGDDLLGILLKAYNTEGKERKMSIEEIIHECRTFFFGGHETTSNLLAWTTMLLSLHQDWQEKLREEIFKECGKEKTPDSETFSKLKLMNMVIMESLRLYGPVSALAREASVNIKLGDLEIPKGTTVVIPLLKMHSDKTLWGSDADKFNPMRFANGVSRAANHPNALLAFSVGPRACIGQNFVMIEAKTVLTMILQRFRFISLCDEYKHTPVDNVTIQPQYGLPVMLQPLED

SEQ ID NO: 29039 - protein, 194 aa, Brassica napus
MAAEKWVYMVTAQTPTNIAVIKYWGKRDEVRILPVNDSISVTLDPDHLCTVTTVAVSPAFDRDRMWLNGKEISLSGSRYQYCLREIRSRGGDVEDKEKGVKIEKKDWERLNLHIASHNNFPTAAGLASSAAGFACLVFSLAKLMNVEEDPSQLSAIARQGSGSACRSLLGGLVKWKMGSKDDGSDSVAVQLLMR

SEQ ID NO: 29040 - protein, 347 aa, Populus trichocarpa
ELNSQQEQNASFLLDALYCEEGRWEDESEEEVLQESTFVNDLFPLSLLEQDLFWEDEELLSLFSKEQEQQASVSVNNVADDPFLSRARQEAVEWMLKVIAHYGFSALTSILAFNYLDRFLSGPCYQRDSRPWMIQLVAVTCLSLAAKVEETHVPFLLDLQVEDTKYVFEAKTIQRMELLVLSTLKWKMHPVTPLSFLDHIIRRLGLKTHVHWEFLRRCEHLLLSVVSDSRSVSYLPSVLATATMMHVIDQVETFNPIDYQNQLLDVLKITKEKVNGCYGLILELSRNRTIANNKSQKRKFEPMPSSPSGVIGAVFSSDSSNDSWAVQGSSVSSSPEPLFKKSRTQDK

SEQ ID NO: 29041 - protein, 439 aa, Shigella flexneri 2a str. 301
MSQAKSNKMGVVQLTILTMVNMMGSGIIMLPTKLAEVGTISIISWLVTAVGSMALAWAFAKCGMFSRKSGGMGGYAEYAFGKSGNFIANYTYGVSLLIANVAIAISAVGYGTELLGASLSPVQIGLATIGVLWICTVANFGGARITGQISSITVWGGIIPVVGLCIIGWFWFSPTLYVDSWNPHHAPFFSAVGSSIAMTLWAFLGLESACANTDVVENPERNVPIAVLGGTLGAAVIYIVSTNVIAGIVPNMELANSTAPFGLAFAQMFTPEVGKVIMALMVMSCCGSLLGWQFTIAQVFKSSSDEGYFPKIFSRVTKVDAPVQGMLTIVIIQSGLALMTISPSLNSQFNVLVNLAVVTNIIPYILSMAALVIIQKVANVPPSKAKVANFVAFVGAMYSFYALYSSGEEAMLYGSIVTFLGWTLYGLVSPRFELKNKHG

SEQ ID NO: 29042 - protein, 353 aa, Populus trichocarpa
MAIPKQQELGQNELSTQQEQNTSFLLDALYCEEGKWEDDSEEEVLQESPSVNNPSGDLFSISLLEQDLFWEDEELLSLFSKEQEQQASVSVNNVASDPFLSRARQEAVEWMLKVIAHHGFSALTSILAINYLDRFLVSPCYQRDNRSWMIQLVAVTCLSLAAKVEETHVPLLLDLQVEDTKYLFEAKTIQRMELLVLSTLKWKMHPVTPLSFLDHIIRRLGLKTNVHWEFLRRCEHLLLYVVSDSRSGCYLPSVLATATMMHVIDQVETFNPIDYQTQLLDVLKITKEKVNGCYGLILELSRTRAIANNKPKKRKFEPTPLQGSSVSSSLETLFKKGRTQDQWVFVDIIGSPR

SEQ ID NO: 29043 - protein, 363 aa, Nostoc punctiforme PCC 73102
MLRAGIVGLPNVGKSTLFNAVVANAKAEAANFPFCTIEPNVGVVAVPDERLNVLAKIASSVQTIPARVEFVDIAGLVKGASQGEGLGNQFLSHIREVDAIVHVVRCFENDDIIHVAGSVDPARDIEIINIELGLSDLAQIERRIDRTRKLARTSKDAQFEVSVLEKLAAALNEGKSVRQVSLNEEETEIIKGLELLTYKPIIYAANVSEDELATGNHFVETVRQIAATENAQVVIVSAQVEAELVELPEEDKADFLASLGVEEGGLKSLIRATYSLLGLRTYFTCGPKETRAWTINAGMSAPQAAGVIHSDFERGFIRAETVAYKDLVTTGSMNAAKEKGLVRSEGKEYVVQEGDVMLFRFNV

SEQ ID NO: 29044 - protein, 274 aa, Lotus japonicus
MALRIYISTLSIAIFSLCTSAYDYSANFSYTGSNGPEKWGTLSPDFAACSNGKAQSPVDIAYPDIVMNMELESLDRDYLSTNATLVNNKFNIGVHFQGQVVGDININGKNYSLKQLHWHSPAEHRAHGRVHEAELHLVHLTPDNNGIAVVAVLYNLGDPDPIISQMEDKFVALAKENRAGNKDAQIPIGTFDFEEINARTHSRYYRYVGSLTTPPCKEGVIWNILGKVRTLSKKQLELLKAPLSQEYIHNARPLQPLNGRKIEMYDHYNHRQGI

SEQ ID NO: 29045 - protein, 398 aa, Thiobacillus denitrificans ATCC 25259
MELSRRVQAIKPSPTLAVTARAAALKATGRDIIGLGAGEPDFDTPQHIKDAAIKAIDGGFTKYTAVDGTPSLKAAIIAKFKRDNGLDYTPKQILVSCGGKQSFFNLVQAVIDPDDEVIIPAPYWVSYPDIVILADGKPVIVEAGIEQGFKITPAQLEAAITPKTRLFVINSPSNPTGAVYSKDELAALGDVLRRHPRVLIASDDMYEHIRLDGAPFVNILNACPDLYDRTLVLNGVSKAYSMTGWRIGYAAGPEAILRAMTNVQSQSTSNPTSISQVAAEAALNGDQGCITPMLDAFKARHRFVVDALNAIPGFKCVDSGGAFYAFPDVRPAIQALLARDVIEQGTDIAFSEYLLESADVAVVPGSAFGAEGYIRLSFATSQANLDKALKRIAQAIAG

SEQ ID NO: 29046 - protein, 497 aa, Zea mays
MVLSHASSGRDDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTEKNKETGWDVPIHVDAASGGFIAPFLYPELEWDFRLPLVKSINVSGHKYGLVYPGVGWVIWRSKDDLPEELIFHINYLGTDQPTFTLNFSKGSCQIIAQYYQLIRLGFEGYRNIMENCQENAAILREGIAATGRFDVLSKDAGVPLVAFSLRDSSRFSVFDVSENLRRFGWIVPAYTMPADAEHVAVLRVVVREDFSRSLAERLVSDVRKILRELDARATHAVRVSTATAEQSGDGVVAKKSVLEIEREVAARWMNAVNKKKTGVC

SEQ ID NO: 29047 - protein, 539 aa, Oceanobacter sp. RED65
MTPIASQVDVHSPQFEANKEAMQSYLSEFRSIEQKVIDKELASAEKFAKREKLLPRERLNRLLDPGSPFMELMSLAGYKMHDDKDGSGAGGGVIGGIGYVQGVRCMIVVNNCAIKGGTISPAGLDKSLRLQEIAQQNKLPVVSLSESGGANLNYATDVFVKGAKAFANQARLSAQGIPQITVVHGNATAGGAYQPGLSDWVVLVRDKAKMFLAGPPLLKAATGEIATDEELGGAEMHAQTPGTGEYLAEDDADGIRIARNIVQSLPWNEQLVQNEKPALYQAPLYDEDELLGIVPADSKQPYDVREIVARIADGSEFLDFKNDFDSQTVCGRIKIEGHAVGIIGNNGPITPQGASKAAQFIQLCEQSNTPLLFLHNTTGFMVGTQSEQQGVIKHGSKMIQAVANARVPKISINVGGSYGAGNYAMCGRGLDPDFIFAWPNSKTAVMGGAQAGKVLRIVTEEKQRKMGMEPDPKVLDTIEEATKQKLEAGSTSLFGTARLWDDGLIDPRDTRRVLGFCLSICKEAQQRKLNSNSFGVARL

SEQ ID NO: 29048 - protein, 450 aa, Ashbya gossypii ATCC 10895
MCCSFFRNCSIMLISQCYWCAVLCTSLVLGPCNPLRPCSRAGYQPARVAQKGGLRNVARAIRTAASPQLPEVPGALGRLRYSGWARAKGALRGYARTERGLRTTQWNCLARSIKLAARRKDAQQTHIYMGAGGSRQQAGRTSKMSELPQDVEPQVLHTQYVAPREAQTQYVAQEAHPHVQDSYYTNSVTTKTHSTRTHDTHDELDGSEDFGRNLLTAALGEFFGTIFFLWPAFVIAQIANHDETTAGPGSHPGQLIMISLGFGLSVMVAVFIFYRVCGGNLNPAVTLTLILAGAVPLVRGLVMMVAQVLGGMVAAGLVKAMTPGPVLFSNALGGGCSRSRGVFLEAFGTAILCTTVLFLAVEKHRATYMAPFGIGMALLVAHLVCVFYTGAGLNPARSFGPAIAHLSFPNYHWIYWIGPFLGSLIAWGVWKLFKVLHYETCNPGQDSDRE

SEQ ID NO: 29049 - protein, 600 aa, Synechococcus sp. WH 7803
MALLVQKFGGTSVGSVERIQAVARRIAACKEDGNDLVIVVSAMGHTTDELTAKARAISSNPPQREMDMLLATGEQVSIALLSMALHALGVPAISMTGAQVGIVTESAHGRARILDVRTDRLRSRLAEGQVVVVAGFQGTSQSSGGTAEITTLGRGGSDTSAVALAAALGADACEIYTDVPGVLTTDPRKVADAQLMPEVSCDEMLELASLGAAVLHPRAVEIARNYGVTMVVRSSWSEDAGTTLTSRSARPIGRDGLELGRPVDGAELVEGQAVLALSHVSDQPGVAAQLFESLSAGGVNVDLIIQSTHEGNSNDITFTVAESELEKARGICADQLQTLGGELVAEAGMSKLSISGAGIMGRPGIAAGLFQTLSRVGINLRLIATSEVKVSCVVEASAGAKALQATQDAFELESDLISLNPLPSGEGDPEVRGIALDRDQAQVSVRHVPDKPGTAGALCNALADAGISLDGIVQSERQHADGSRDISFTLKRDDRAAADRALSHLLAQWPGALLEDGPAIARVSAVGAGMPATAGTAGRMFRYLADAGVNIEMIATSEIRTSCVVAESDGIAALQAVHTGFELGGSTRHQAQGTESPLES

SEQ ID NO: 29050 - protein, 384 aa, Aeropyrum pernix K1
MRAVPYLEGSAKKYALAAVDAEKRGDYEAAIVNLNKAIEYLTEIVRNYPDYPLAHIYRRLIAQYRRKVKDLEKKARMIPASGDEVYVDTQEKDGGGEDEAPEFVLKEKPSVTFDDIAGLEEAKKAIREAIVFPVKRPDLFPLGWPRGILLYGPPGTGKTMLASAVANEIDGEFLYVDAANIMSKWLGEGEKNVKKLFNYARNKAKEGKPVVIFIDEVDALLGVHGSEVGGEVRVRNQFLKEMDGIQDKGSRLHVYVIAATNKPWKLDEPFIRRFQKRIYVPLPSRETRKRMLEMYTRKLRLAGDVDLDRLAEMLEGYTGSDIADIVREAYMATVRELFEKGKVDGEPRPITMSDFQEILRRRRPSVDHRLLKTYEEWTERFAAV

SEQ ID NO: 29051 - protein, 489 aa, Saccharomyces castellii
MSADFGLIGLAVMGQNLILNAADHGFTVCAYNRTVSKVEHFLANEAKGKSIVGATSIDDFLSKLKRPRKVMLLVKAGAPVDALINELVPRLEKGDIIIDGGNSHFPDTNRRYEELKQKGILFVGSGVSGGEDGARYGPSLMPGGAEEAWPHIKDIFQSISAKSDGEPCCDWVGPAGAGHYVKMVHNGIEYGDMQLICEAYDIMKRVGHFTDKEIGDVFETWNKGVLDSFLIEITRDILKFNDVDGKPLVEKIMDTAGQKGTGKWTAINALDLGIPVTLIGEAVFSRCLSALKSERIRASKTLLGPEVPKDLIKDKKQFVDDLEQALYASKIMSYAQGFMLIREAGKTYGWKLNNPAIALMWRGGCIIRSVFLGEITKAYREDPELENLLFNKFFSDAVTKAQTGWRKSIALATTYGIPTPAFSTALAFYDGYRSERLPANLLQAQRDYFGAHTFRVLPECASDNLPLDKDIHINWTGHGGNVSSSTYQA

SEQ ID NO: 29052 - protein, 341 aa, Neisseria gonorrhoeae
MGIKVAINGYGRIGRQVLRSIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 29053 - protein, 162 aa, Triticum aestivum
  misc_feature (135)..(135): Xaa can be any naturally occurring amino acid
  misc_feature (141)..(141): Xaa can be any naturally occurring amino acid
  misc_feature (156)..(156): Xaa can be any naturally occurring amino acid
  misc_feature (158)..(158): Xaa can be any naturally occurring amino acid
MVKSKAIRVHELGGPEVLRWEEVEVGEPGEGEIRIRTTAVGVNFIDIYFRKGVYAAPTMPFTPGMEAVGVVTAVGPGLTGRKVGDVVAYAGNPMGSYAQEQILPAAVAVPVPPSVDHKQAASVMLKGMTAHVLLXRVIKVXSGILSWSNAAAGGCXSXPCQW

SEQ ID NO: 29054 - protein, 307 aa, Pyrobaculum aerophilum str. IM2
MPVKVNIRGQAAAPGSLADSLKDVKLKLVTISGKGGVGKSLVTTSIAVGFAMRGYRVGILDGDVYGPTVPKMLGLSDSTLYVDQKTGRIIPVVGPLGIKVVSIEFALPGDDTAVIWRAPLVNQALRDFISQVEWGPLDVLVVDLPPGTGDAPLTIAQSLQGGLDGSVIVTIPTEISRRIVLKSIDFSRKLNIKVAGVVENMCCFKCPDNGKVYYIFGKDAGKRIAEAAGVPFLGGIPIDPEFSQYLDSGRLHEFLGKDNETAKAVLAISDKLIEMYKDKLSQQTVPKEKPKRISLLKLPGEEEKENY

SEQ ID NO: 29055 - protein, 211 aa, Arabidopsis thaliana
LLRENKRMLDKSIREIERERQGLQTQEKKLINEIKKTAKQGQMGAVKVMAKDLIRTRHQIEKFYKLKSQLQGVSLRIQTLKSTQAMGEAMKGVTKAMGQMNRQMNLPSLQKIMQEFERQNEKMEMVSEVMGDAIDDALEGDEEEEETEDLVSQVLDEIGIDINQELVSAPSGAVAVPAAKNKVVQAEATGAEDSGGIDSDLQARLDNLRKM

SEQ ID NO: 29056 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGSFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 29057 - protein, 649 aa, Arabidopsis thaliana
MGNTCVGPSRNGFLQSVSAAMWRPRDGDDSASMSNGDIASEAVSGELRSRLSDEVQNKPPEQVTMPKPGTDVETKDREIRTESKPETLEEISLESKPETKQETKSETKPESKPDPPAKPKKPKHMKRVSSAGLRTESVLQRKTENFKEFYSLGRKLGQGQFGTTFLCVEKTTGKEFACKSIAKRKLLTDEDVEDVRREIQIMHHLAGHPNVISIKGAYEDVVAVHLVMECCAGGELFDRIIQRGHYTERKAAELTRTIVGVVEACHSLGVMHRDLKPENFLFVSKHEDSLLKTIDFGLSMFFKPGLISLLLILKDPLPDLVFNVNSVILVEQLFLNSIPFLFADDVFTDVVGSPYYVAPEVLRKRYGPEADVWSAGVIVYILLSGVPPFWAETEQGIFEQVLHGDLDFSSDPWPSISESAKDLVRKMLVRDPKKRLTAHQVLCHPWVQVDGVAPDKPLDSAVLSRMKQFSAMNKFKKMALRVIAESLSEEEIAGLKEMFNMIDADKSGQITFEELKAGLKRVGANLKESEILDLMQAADVDNSGTIDYKEFIAATLHLNKIEREDHLFAAFTYFDKDGSGYITPDELQQACEEFGVEDVRIEELMRDVDQDNDGRIDYNEFVAMMQKGSITGGPVKMGLEKSFSIALKL

SEQ ID NO: 29058 - protein, 341 aa, Neisseria gonorrhoeae
MGIKVAINGYGRIGRQVLRAIYDYQIQDQLQIIAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGTLKGVLGYNTLPLVSMDFNHTTEASHFDATLTKVVDGNMVKVFAWYDNEWGFSCQMLNTARRMFGLEVRP

SEQ ID NO: 29059 - protein, 313 aa, Kluyveromyces lactis NRRL Y-1140
MGLIKLLKGFSLQSEADSSATVEKIKEAIDVCDSSECTGDCVNEDADEKDALQKDEGIFAKLKIDHEQPLYGSSTTSKIHFIIPTSQTDWAHDACMEKPGSVQAVMQKWINANSDKYSDIESEGETIRCSVSSLPIDLLDIDVMKNTKNDVLIFPHFLKIKAVKSDLVAELLNEVVPLLLKNERGTLLAKDYIEEIKDNSFILLCSHRTRDKRCGITAPILEKHFNKHLQRHHLYRDNSDFRPGGCRVAYVNHVGGHKFAANVIIYLKKTHQLIWLGRVTPLHAEPLIECLIVPNEPKLPYPEKVRCVAKYKF

SEQ ID NO: 29060 - protein, 334 aa, Idiomarina loihiensis L2TR
MSRTITVIPGDGIGPDIVESATAILDKAGCDFEYEYVDAGLTALEKTGELLPQNTLDAIERNGVTLKGPLTTPVGEGFTSINVSLRKHFSLYANVRPVLSFTGTQARYENIDIITIRENTEGMYSGLGQKVSEDGNEAEAVSKITREGAERIVRFAYETARREGRKKVTAVHKANILKSTSGLFLKVAREIAEEYPDIESTEMIVDAACMRLVMNPEEFDVIVTTNLFGDILSDLCAGLVGGLGMAPGANIGKDCAIFEAVHGSAPDIAGKNLANPTSVILASIQMLEYLGMQEQAEKITKALEDVISSGDRTTRDLGGSHGTTDFTQAVIERL

SEQ ID NO: 29061 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSLQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 29062 - protein, 293 aa, Chlamydophila caviae GPIC
MVVMNMFETYRIMIEAGIESSLEEFGSKGLSVRAPVEYALTSGGKRIRPMLVCMIAKGLDMSRDVLDAALAIEFIHTSTLIADDLPCMDDDDERRGRPTVHKAFDEASALLASYALIPAAYSRIRLNAKKLKSQGVDPKEVDIAYDIISDVTDKNFGVNGVLGGQYEDMFFKNDGPEYVQSIINKKTGALFEIACVSGWLFGGGDPLCVPQIIEFSQTFGLLFQMKDDILDIHQDGQDVGLNYALLFGLDAAKDLLNSSMDKCMILLKHLKQHGLKDTSELEMLIEYMGIRDY

SEQ ID NO: 29063 - protein, 341 aa, Neisseria gonorrhoeae
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGSFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMVKVFAWYDNEWGFSCQMLNTARRMFGLEVRP

SEQ ID NO: 29064 - protein, 225 aa, Brassica napus
  misc_feature (215)..(215): Xaa can be any naturally occurring amino acid
MEKNLEDLKIVAEQWLNQGTEFVQQIPPNQLYAAVGVLLFTILFFFSIRLFRRTKSNTVLLSGLSGSGKTVLFYRLRDGSSHQGSVTSMEPNEGTFVLHTENTQKTKPVHLVDVPGHSRLRSKLEEYLPRAAAIVFIVDALEFLPNCRAASEYLYDILTNASVVKNKIPVLLCCNKTDKITAHTKEFLRKQMEKEIEKLRVSRSAVSTADIANDXTLGIEGEVFP

SEQ ID NO: 29065 - protein, 755 aa, Kluyveromyces lactis NRRL Y-1140
MPALTLTTADSFIPPDVNNPPFYIPLKNIDARYNVIQELGKGSFGSVTLAETMYDMNSSATQISSMYPETLMDQTLIRNVEQENWYYKKKGIVAIKTMMNRLPTLHDYTRVREIKFILQIPAHKNLVTIYEMFIDDSLYHLHIVMECMEQNIYQLMKHRKRRVFSLPTLRSILFQILAGIKHIHDHDFFHRDIKPENILISPSHRYFSKKWLEDDNYSDNYVVKLADYGLARHVNNRSPYTTYVSTRWYRSPEILLRKGYYSKPLDIWAYGCVVVELATFSPLFPGSDETDQIWRILDLLGSPDHSINGKEHFGGSWLDSKPLYQALNYEFPYVEGKTIRDVLPNPQLEDLYDVVTSCLKWNPSERATANEICALPYFKEYVMREASLAKTNNGTASKNKDNTALANKLAANPSISNQWSRILSGLPHNPELGIVPSFNSPQKLPKVQKNNQMNCVTDKSQQQPRRGGVASWFKFSTQKNHVNINPNTNNDEKILTSVNTNTNSQKNQGIVEKKQQEQQVNAHNERLDSSTNANGNSIPDINLIGHANNDNEVFTIELDDSMETMTGSDQISKELNDKIELYQDTTNQMNPPTLDVDDDDDEHDSIDMDHENYRIQVLDEFDTDENLEHEIRATDKDENNEVAVDKMKISNQGEDEDDADSLLNYYQDMMAKKLPLNKNKGNYMHSNGPAGPTLSDQMAIDDSLDLQEQIPRNLLERAVQQRVLDCLLDPSEHASQNLIQTSNSHNHTFQDGLSF

SEQ ID NO: 29066 - protein, 104 aa, Brassica napus
  misc_feature (22)..(22): Xaa can be any naturally occurring amino acid
MASSPRSPQPAELEISRQSRIXAALSKKVIDLDELRMLAAQGVPDGAGVRSTVWKLLLGYLPKDRALWEQELAKKRSQYEAFKDEFLPNTVGGSSTTGGSRRPQ

SEQ ID NO: 29067 - protein, 270 aa, Candida glabrata CBS 138
MSIPMLPAILSKNVGLRSIRCVRGGYLRVVLGASIGMRPYSDLKVNKKDFLTIPNVITITRIATTPMIGYFLLNNQLVPALSLFAYSSITDFLDGYIARRYNMKSDAGTILDPMADKLLMIITTAALALPPGPQVIPIGIASLILGRDILMGFSAIFIRYASLKQKYHFVTWKSFWDFFKYPSAVVKPLTISKWNTFLQMIYLGLAVFIMILDQYDTKVQEANEQKDTTLDINTLKTGFSWLGYIVGATTVISGTSYVFSKSAVTFIKKI

SEQ ID NO: 29068 - protein, 75 aa, Solanum lycopersicum
SANLVFFQNGMLEPWFQSKGLGDANQVLAYFAVSKLGEPPTDGKTDTNPEGLTAAYGKWASAVAARLQNGGLSCK

SEQ ID NO: 29069 - protein, 326 aa, Populus trichocarpa
MAGESLSPNDLLRQEDFRAELSVADEDDTYIDISRTYVGDPDTEEEEYLALLANQEPHRGFSANDTLVIDSWFRNARLEAITWILRTRKTFGFHFHTAYLSMIYFDRFISSRSIDRRYSWVVKLISVACISLASKMEEVQVPSSPEFQTDGVIFESKSVKRVELGILSTLQWRMNYTTPFAFLRYFIMRFSRQDSPPRETISRTVRYILALMKEIHLMSHRPSVIAAAASLVVINNSLTRTTLETQMNSVAYPGFLNIEDVFRCYNLLQQLDVENLRSTANGLPLKARPALFLFEALLAVFKFERGHETQDIVYGNQKEFLCLIIL

SEQ ID NO: 29070 - protein, 49 aa, Helianthus annuus
VLAYFAVSKLGEPHVDGITDANPEGLTAADDTCASVAYSRLNAGGLSCK

SEQ ID NO: 29071 - protein, 161 aa, Synechococcus sp. WH 7803
MATFEGRFTDAQGLRIAVVVARFNDLVTGKLLSGCLDCLHRHGVDVTPESSQLDVAWVPGSFELPVAAQNLARSGRYQVLITLGAVIRGDTPHFDVVVAEASKGIAAVARDTGVPVIFGVLTTDTMQQALERAGIKSNLGWSYGLQALEMGSLMHALESEA

SEQ ID NO: 29072 - protein, 327 aa, Rhodospirillum rubrum ATCC 11170
MTIRDGFLGTIGGTPLIRLPWASRITGREILGKAEFLNPGGSVKDRAALAIITDALERGALAPGGTIVEGTAGNTGIGLTLVGNAIGCKTVIVMPETQSQEKKDALRLCGADLRLVAARPYKDPGNYVRYSETLAKELGGFWANQFDNTANRDGHRATTGREIIEQCEGRLDAFTCAVGTGGTLAGVALALKAHDPAIKVVLADPFGSALYSWITSGELKAEGGSVTEGIGQGRVTANLRDAPLDEAVRIGDAEALEAIFAMVREDGLMLGGSSGVNVAAAMKVALTLPKGSRVVTILCDGAQRYQSKLFNPDFLRSKALPVPDWLA

SEQ ID NO: 29073 - protein, 48 aa, Helianthus annuus
  misc_feature (8)..(8): Xaa can be any naturally occurring amino acid
FGYFAVSXLGEPPVDGITDANPEGLTAAYGKWASVVATRLNAGGLSCK

SEQ ID NO: 29074 - protein, 341 aa, Phaseolus vulgaris
VVGVVLGALPFSSDAQLDPSFYRNTCPSVHSIVREVIRNVSKSDPRMLASLIRLHFHDCFVQGCDASILLNNTDTIVSEQEALPNINSIRGLDVVNQIKTAVENACPGVVSCADILTLAAEISSVLAQGPDWKVPLGRKDSLTANRTLANQNLPAPFFNLTLLKAAFAVQGLNTTDLVALSGAHTFGRAQCSTFVNRLYNFSNTGNPDPTLNTTYLQTLRAVCPNGGGGTNLTNFDPTTPDKFDKNYYSNLQVHKGLLQSDQELFSTIGADTIDIVNRFSSNQTLFFESFKAAMIKMGNIGVLTGSQGEIRKQCNFVNGNSAGLATLATKESSEDGLVSSI

SEQ ID NO: 29075 - protein, 72 aa, Lactuca sativa
LVFFQNGMLEPWFESKGLGDADQVLAYFAVAKLGEPPIDGITDTNPEGLTAAFGKWGSAVADRLRAGGLSCK

SEQ ID NO: 29076 - protein, 261 aa, Triticum aestivum
  misc_feature (96)..(96): Xaa can be any naturally occurring amino acid
  misc_feature (127)..(127): Xaa can be any naturally occurring amino acid
  misc_feature (179)..(179): Xaa can be any naturally occurring amino acid
  misc_feature (200)..(200): Xaa can be any naturally occurring amino acid
  misc_feature (208)..(208): Xaa can be any naturally occurring amino acid
MKLNIANPTTGCQKKVEIDDDQKLRNLYDKRISQEVVGDLLGEEFKGYIFKIMGGCDKQGFPMKQGVLTSGRVRLLLHRGTPCFRGFGRRNGERRXKSVRGCIVSQDLSVINLVIVKKGENDLPVSXPDTEKPRMRGPKRASKIKKLFNLGKDDDVRSYVNTYRRTFLNKKDHIVPYFXGKKVSKAPKIQRLVTPLTLQXRKRARIAXDKKKRIAKKKSEAAEYQKLLAQRLKEQRDRRSESMAKRRSKLSAATKAPAASA

SEQ ID NO: 29077 - protein, 351 aa, Synechococcus sp. WH 7803
MNILVTGGAGFIGSHTCLRLLEEGHQVVSIDNYSNSTVQSLTRIKELTSSVNTQNLKIIDGDIRRSVDLFKAFNCLDGKEIDAVIHFAGLKSVGESMKKPLKYWDINVNGTSNLLMAMSKHGCKTLVFSSSCTVYGTSKQKKINEASTIAPINPYGRTKAAVEQMLLDQFNSDPQWRICCLRYFNPVGAHPSGHIGEDPKGTPGNLFPFLMQVAKKQRKKLNIFGNDWPTADGTCIRDYIHILDLVDGHLAALRFLCEEAPQWLAVNLGTGIGVSVLEFVSAFEQATGLVVPYEFVERRAGDAAVAVADPSVALKKLKWKPVRSLRDICIDGWKWQNANPNGFNNQASIIS

SEQ ID NO: 29078 - protein, 349 aa, Rhodospirillum rubrum ATCC 11170
MMVSAPAPRSQPDRSQPDRRLSVAPMMDWTDRHDRWFLRQITKRTLLYTEMITAQALLHADPGRFLDHHPDEHPLALQLGGSDPRALAEATRLAAPFGFAEINLNVGCPSDRVSSGRFGACLMADPALVAECLSAMAEASNAPVTIKHRIGIDDLDSYDQLVGFVDQVARSGIATIIVHARKAWLKGLSPKENREIPPLRHDVVHRLKADFPGLEVILNGGITTLTQALDHLGSGDPAAPAVDGVMIGRAAYETPYMLAQADGLIFGEATPAPSRHEVALALLPYLDAMTARGEPVKRLTRHILGLFHGQPGARAYRRHLGEAGVRPDATAQVLIDALAHIPALDEAES

SEQ ID NO: 29079 - protein, 558 aa, Listeria monocytogenes str. 4b H7858
MNVARLNFSHGDFEEHGARIVNIREASKKTGKQVAILLDTKGPEIRTNDMVGGKLEFQTGDVVRVSMTPVEGTKEKFSVTYGELYDDVEIGSSILLDDGLIGLEVIEKDEANRELVTKVLNPGVLKNKKGVNVPNVSINLPGITEKDAADIRFGLEQGIDFIAASFVRRATDVLEITKILEEHNATHVQIIPKIENQEGVDNIDEILQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAIVAKSNAEALEKAEEGGILIVKTTDKEMLPAFEKSAAVVVEEGGLTSHAAVVGINLGIPVIVGAKDATSLVKDGEIITVDSRQGVVYNGKTATH

SEQ ID NO: 29080 - protein, 394 aa, Ralstonia eutropha JMP134
MDIQAIRAGTPLTASTIYLDTAAASLPPDVVLDTVRSYLLDTGHVGIYLPAFRKETYARVDVVRGKLAALLNAAADEIAFTKNATESISLVARGIAWQAGDEVLVADTEMLSNLLPWRRLEQTHGIVVKMVAANAEGLLSPDAFAAAITPRTRLLTFSHLPNSTGAVQPAAQICAVARRHGVLSLVNAAQSVGMLRSDVAELDCDFLAGCGRKALRATEGSGFLYVRRALIEHIEPSLVGWWNGAYDRATGALSLVAGARRFEAGCPIVPAILGMGTAIDYAMQIGIDAIEARVRDLTEYAVAKFSSIPGFELYGPADVSNRIGIVPFNVRGVDPASIVAALETQQCIIEAGNFMADAILARYGVSTMARVSLHYFNTHEEIDRVAALIRAAIA

SEQ ID NO: 29081 - protein, 334 aa, Phaseolus vulgaris
MFSTNNTYYYSLVATILLVLTFVFPSEGQLSASFYSSTCSNVSSIVRDSVQQALTSDSRIAASLIRLHFHDCFVDGCDGSILLDVGGNITESEKNAAPNENSVRGFDVVDSIKSTIEASCPAVVSCADILALAAEASVSLSQGPSWTVLLGRRDSVTANQGGANTSLPSPFENLTNVSSKFSAVGLDTTDLVALSGAHTFGRSQCQFFSQRLLNFNGTGSPDPTLNTTYLGTLQQNCPQNGNGATLNNLDPSTPDTFDNKYFTNLLINQGLLQTDQELFSTDGSSTISIVNNFANNQSAFFEAFAQSMINMGNISPLTGTQGQIRTDCKKVNGS

SEQ ID NO: 29082 - protein, 330 aa, Neisseria gonorrhoeae
VAINGFGRIGRLALRQIEKAHGIEVAAVNDLTPAEMLLHLFKYDSTQGRFQGTAELKDDAIVVNGREIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVATGSLTELVSVLERPVTKEEINAAMKAASSESYGYNEDQIVSSDVVGIEYGSLFDATQTRVMTVGGKQLVKTVAWYDNEMSYTCQLVRTLEYFAGKI

SEQ ID NO: 29083 - protein, 499 aa, Idiomarina loihiensis L2TR
MSKKVPLYIDGEFVASKSEQWIPVTNPATQEVIAQVPVATQSEMDAAVESAREAFKTWKEVPVSERARVMMRYQALLKEHQEEIAETLAQETGKTFEDAKGDVWRGIEVVEHAANIPSLLMGETVENVARKIDSYSYTQPLGVCAGITPFNFPAMIPLWMFPLAIACGNTFILKPSEQDPLTPTRLAELFEEAGAPKGVLQVLHGNKEQVDFLLDHPDVRALSFVGSVPVAEYIYRRGTENGKRVQAFAGAKNHCVIMPDANKQQVINNMVGSSVGAAGQRCMAISVAVFVGAAKEWIPEIAEAIAKVRPGAWNDEGAAYGPVISPQAKERVEALITQGEKEGAKLLVDGRNCKVDGLPNGNWVGPTVFSNVTPDMEIYKTEIFGPVLCATEVDSLEDALELVNNNPYGNGTSIFTASGAAARKYQHEVEVGQVGINIPIPVPLPFFSFTGWKRSFFGDLHAYGKQGVRFYSETKTVTARWFESDLEDPAGPNMSINLR

SEQ ID NO: 29084 - protein, 330 aa, Neisseria gonorrhoeae
VAINGFGRIGRLALRQIEKAHGIEVAAVNDLTPAEMLLHLFKYDSTQGRFQGTAELKDDAIVVNGREIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVATGSLTELVSVLERPVTKEEINAAMKAAASESYGYNEDQIVSSDVVGIEYGSLFDATQTRVMTVGGKQLVKTVAWYDNEMSYTCQLVRTLEYFAGKI

SEQ ID NO: 29085 - protein, 419 aa, Pyrobaculum aerophilum str. IM2 [sequence omitted]

SEQ ID NO: 29086 - protein, 330 aa, Neisseria gonorrhoeae
VAINGFGRIGRLALRQIEKAHGIEVAAVNDLTPAEMLLHLFKYDSTQGRFQGTAELKDDAIVVNGREIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAVLNIVPNSTGAAKAIGLVIPELNGKLDGSAQRVPVATGSLTELVSVLERPVTKEEINAAMKAAASESYGYNEDQIVSSDVVGIEYGSLFDATQTRVMTVGGKQLVKTVAWYDNEMSYTCQLVRTLEYFAGKI

SEQ ID NO: 29087 - protein, 211 aa, Arabidopsis thaliana
LLRENKRMLDKSIREIERERQGLQTQEKKLINEIKKTAKQGQMGAVKVMAKDLIRTRHQIEKFYKLKSQLQGVSLRIQTLRSTQAMGEAMKGVTKAMGQMNRQMNLPSLQKIMQEFERQNEKMEMVSEVMGDAIDDALEGDEEEEETEDLVSQVLDEIGIDINQELVNAPSGAVAVPAAKNKVVQAEATGAEDSGGIDSDLQARLDNLRKM

SEQ ID NO: 29088 - protein, 868 aa, Cryptococcus neoformans var. neoformans B-3501A
MSPAPVAPIRQPRGPSTNSFSQAASPPSSTSAGNSGTAAATGPPAPDTDSLRRANTVSNPRHQPSASISASSAASSAFHGVPPSAASTSASSSRGVRGVSRFRSGSLSNALPDPGLVRRASGREVAKEVVLENEGEGEGIEAASWGKGLGRQSSLPSRRGLSLAQAANQGAPEPVPPPRPPRRIAINTTTVSGPTPPVSAHSASHSLSSLSMLHRPTYSSQLSQDEPIPSATSGGVSRTQSLRAQAKHSDVGGLGRSISLKAVGEHTYRQSTSQQASSGQSSGVISSPSSVAFSPPAPPPVSSTAALPPFQLPLPDSSYVSTTTGGADVKRHQSLTQGYGSSSRVRDRLERSPAITLEPREPRDTSGVRVRIDTRFEDEPPTSPIGPSVWSNTLSRTDDGWGSAPLNQSARNASQQLQDAFEAMTLGRNMMAPDGNAMLANDFDPRERLSLETDIMRHPQPSSNNTLPSGGQGLQRINSGAEEPSWVNKLVGGDSTPMVGNVMPRSSSALGWSERARQNETQRFPYGAYNMPFGNGFNMGLKPQMGQMGMPQMGPVGMNGMPMGMPMGMGPMNMGFPMGMNMGFGQMGANGFGQFAPGHPGQAQNQHPGQGYPPPSSSAAPTGHGMGAQDREVIELARKKGLNPATFNCKPQNARFFVIKSYTEEDVQKSLKHEIWSSTVLGNKRLDAAYRETANKGPIYLFFSVNGSRHFCGVAEMTTPVDETKTSKVWAQDKWKGIFEVKWIFVRDVPSAALRHIRLTNTPECKPITNSRDTQELPYEAGTEVLQIFLDHQTKSKTSLLQDFAYYEQLSVNRQNQNSPQNGNSQNQQPSSYQQFQQKPGNAIPPPMSTSHSGPTIPPVPAIPDKFR

SEQ ID NO: 29089 - protein, 388 aa, Clostridium perfringens SM101
MSKKEIVAMILAGGQGSRLGVLTKNLAKPAVPFGGKYRIIDFPLSNCSNSGIYTVGVLTQYKPLKLNEHIGIGDTWDLDRRDGGVSILPPYQKEKGGDWYKGTANAIYQNIEFIERYDPEYVLILSGDHIYKMDYDKMLEMHKQKEADATIAVINVPMHEASRFGIMNTNEDLSIYEFEEKPEHPKSTNASMGIYIFNWKILKKFLEEDELDPSSSNDFGKNIIPKMLNSGKKLIAYPFNGYWKDVGTIESLWEANMDLLKYEDELSLYDSEWKIYSANPVRPAQFIGKDAEIKSSLTVEGCIVHGKVENSVLFQGVYVGKGAIVKDAVIMPNTKIEDNVLIEKAIIGSEAIVCKGCKIGDGNKISVIASKEVVIGSKEIIEECAMVK

SEQ ID NO: 29090 - protein, 55 aa, Glycine max
MRKFDPWPVFFKREWKRNWPFLVGFAVTGALITKLSLGLTEEEAKNSKFVKAHKR

SEQ ID NO: 29091 - protein, 378 aa, Triticum aestivum
  misc_feature (82)..(82): Xaa can be any naturally occurring amino acid
  misc_feature (162)..(162): Xaa can be any naturally occurring amino acid
  misc_feature (223)..(223): Xaa can be any naturally occurring amino acid
  misc_feature (229)..(229): Xaa can be any naturally occurring amino acid
  misc_feature (239)..(239): Xaa can be any naturally occurring amino acid
  misc_feature (247)..(247): Xaa can be any naturally occurring amino acid
  misc_feature (288)..(288): Xaa can be any naturally occurring amino acid
  misc_feature (295)..(295): Xaa can be any naturally occurring amino acid
  misc_feature (335)..(335): Xaa can be any naturally occurring amino acid
  misc_feature (342)..(342): Xaa can be any naturally occurring amino acid
PRPSSPDQIPGGPARSRRRGPARPGRWAGEAPEPRRLSRALSLDGSGVPEEALHLVLGYVDDPRDREAASLACRRWHHIDAXLTRKHVTVPFCYAVSPARLLARFPRLESLGVKGKPRAAMYGLIPDDWGAYARPWVAELAAPLECLKALHLRRMVVTDDDXLAALVRARGHMLQELKLDKCSGFSTDALRLVARSCRSLRTLFLEECTITDNGTEWLHDLAXNNPVLXTLNFYLTYLXVEPADLEXLSAKNCKSLISLKISDCDLSDWIGFFQIATSWQEFAGAEIXEQKFGNXVSFLRSLAPFGLTFMGAKEMPLIFPFPAGPKNWICRYRFXPREDHCXLIAKCQTTRLPECDGKDGLKHINVKVREICCKKKSS

SEQ ID NO: 29092 - protein, 134 aa, Zea mays
  misc_feature (63)..(63): Xaa can be any naturally occurring amino acid
  misc_feature (65)..(65): Xaa can be any naturally occurring amino acid
  misc_feature (76)..(76): Xaa can be any naturally occurring amino acid
YAQLTVEIGQNVPIVRDDLFVTNPTRVGKVIIDSTCHALLLTVNQLVFVTDSIVPVRMYKHPXMXVMPSHMSEDTXDTFIADLSVALYTDQIKTGAHCPFDRLAKYNHVLMIHEQHRDADVYVRAQCMAPGDPY

SEQ ID NO: 29093 - protein, 192 aa, Spiroplasma citri
MDKFNINEKMKRTKIITTIGPSTHSPGAIEELFKTGMTTIRLNFSHGDHAEQGARIVWAREVSAKIGKPISVLLDTKGPEIHWRIKGLLQKSLNIYHQMNNSLMFSPSFCKFLHYHYTLLLSKKTKKQLLKIVKKLKKLQSQHYNLAHGLRETWTSSFCFNERPSIWRLLSSFKQIVTSFKISLVSKVLIKL

SEQ ID NO: 29094 - protein, 81 aa, Solanum tuberosum
LLLNLAWSDLVFFQNGMQEPGFQSKALEEAEPSLAYLAVSKLGKPPTDGKTDTIPEGWMPAYGKWPSPGVPGCRNGGFSSK

SEQ ID NO: 29095 - protein, 598 aa, Pseudomonas syringae pv. tomato str. DC3000
MVSFRAFRFTFVFYGVPPLDATTINSLFLIGALLVAASILVSSLSSRLGIPILVIILAVGMVAGVDGGGIIFDNYATAYLVGNLALAVILLDGGLRTRVASFRVALWPALSLATVGVLITTVLTGMVAAWLFNLSVIQGLLIGAIVGSTDAAAVFSLLGGKGLNERVTASLEIESGSNDPMAVFLTVTLIGMLASGQTGLHWGLLGHLIQEFGIGSFIGLGGGWILLQLVNRINLAAGLYPILVIAGGLAIFALTNAIHGSGFLAVYLCGLVLGNRPIRSRHGILHMLDGMAWLAQIGMFLVLGLLVTPHDLLPIAIPALGLALWMILVARPLSVMVGLLPFKAFHGREKAFIAWVGLRGAVPIILAVFPLMAGLPNAQLYFNLAFFIVLVSLLLQGTSLPWMAKLLKVTVPPDPAPISRAALEVHVTSEWELFVYRLGAEKWCIGAALRELKMPEGTRIAALFRGQQLLHPSGSTTLEVGDLLCVIGHEHDLPALGKLFSQAPQRGLDLRFFGDFVLEGDARLGEVAALYGLKLDGIDPGMPLSQFIVQKNRGEPVVGDQIEWNGTIWTVAVMDGNKIQKVGVKFPEGTRPGPGLFL

SEQ ID NO: 29096 - protein, 181 aa, Candida glabrata CBS 138
MGLFASKLFSNLFGNKEMRILMVGLDGAGKTTVLYKLKLGEVITTIPTIGFNVETVQYKNISFTVWDVGGQDRIRSLWRHYYRNTEGVIFVVDSNDRSRIGEAREVMQRMLNEDELRNAVWLVFANKQDLPEAMSAAEITEKLGLHSIRNRPWFIQATCATTGEGLYEGLEWLSNNLNNKE

SEQ ID NO: 29097 - protein, 69 aa, Coffea canephora
  misc_feature (10)..(10): Xaa can be any naturally occurring amino acid
FQNGMLETWXQSKGLSDPDQVLAYFAVSKLGESPTDGKTDTNPEGLTAAYGKWASAVAGRLRAGGLSCK

SEQ ID NO: 29098 - protein, 208 aa, Brassica napus
MSLLSFPLTSLNISPPLFFTIITTLVSAFVILFLTRHSSNSKRVNLPPGPPGWPVVGNLFQFARSKKQFYEYADDLREKYGPIYTLRMGSRTMIIISDATLAHDVLIQRGPMFATRPKENPTRTIFSSNTFTVNASVYGPVWRSLRRNMVQNMLSSTRFKEFGSLRRSAMDKLAGRIKSEAVENKGLVWVLRNARFAAFCILLEMCFG

SEQ ID NO: 29099 - protein, 510 aa, Solanum tuberosum
MANIDIAGIMKDLPNDGRIPKTKIVCTLGPSSRTVPMLEKLLRAGMNVARFNFSHGTHEYHQETLDNLKIAMQNTQILCAVMLDTKGPEIRTGFLTDGKPIQLKEGQEITVSTDYTIKGNEEMISMSYKKLVMDLKPGNTILCADGTITLTVLSCDPPSGTVRCRCENTATLGERKNVNLPGVVVDLPTLTEKDKEDILEWGVPNNIDMIALSFVRKGSDLVNVRKVLGPHAKRIQLMSKVENQEGVINFDEILRETDSFMVARGDLGMEIPVEKIFLAQKMMIYKCNLAGKAVVTATQMLESMIKSPAPTRAEATDVANAVLDGTDCVMLSGESAAGAYPELAVKIMSRICIEAESSLDNEAIFKEMIRCTPLPMSPLESLASSAVRTANKARAKLIVVLTRGGSTAKLVAKYRPAVPILSVVVPVLTTDSFDWSISDETPARHSLVYRGLIPLLGEGSAKATDSESTEVILEAALKSAVTRGLCKPGDAVVALHRIGSASVIKICVVK

SEQ ID NO: 29100 - protein, 275 aa, Zea mays
  misc_feature (48)..(48): Xaa can be any naturally occurring amino acid
  misc_feature (197)..(197): Xaa can be any naturally occurring amino acid
AGGGGEPAATVKSIFIYPIKSCRGLAVSQAPIISTGFRWDRQWVVVNXKGRAYTQRVEPKLALVQVELPPEAFAEDWQPTPYDHLVIRAPGMDTLKIPLAAEHTTIDDVSVWEWSGSAYDEGAEVSEWFSTYFGKPSRLVRFKEASETRPTDPYYAQGYKIMFTDRFPFLIASQGSLDALNEILKEPVPMNRFRPKXPSINQEDEIPGTEPNETLQTFRSDQVLRPSHKNKRQVYFGVNLVCKESLSGKDEGKIIKVGDPVYVVQAFDSSNEALV

SEQ ID NO: 29101 - protein, 604 aa, Trichodesmium erythraeum IMS101
MLIVQKYGGTSVGSVERIKAVAQRIAKTASDRSVVVVVSAMGKTTDTLVKLANDISPNPCRREMDMLLSTGEQVTIALVSMALQELGVPAISLTGAQVGIVTEAQHSRARILHIQTERIEEHLQLGEVVVVAGFQGISQTRHQEITTLGRGGSDTSAVALAAALQAQRCEIYTDVPGILTTDPRIVPEAQLMSEITCDEMLELASLGAKVLHPRAVEIARNYGMPLVVLSSWSDAPGTRVVSAIPKRPALQDLELTKPVDAVEYDTNQAGISMLRLPDRPGVAAQLFSGIALQNIDVDLIIQSIHESNTNDIAFTVSKDVLKQAAAVADAMLPALGKNAHPSLGEPEVKTEERPIAKVSLVGAGMIGRPEVAAKMFEALAAAGVNIIMISTSEVKVSCVVDAEDCKKTVNSLCQAFDVDVADISSSSTAGESEEVPPPVRGVALDIKQARLAVRQVPDHPGMAAKIFGLLAQQNISVDMIIQSQRCHSVDGVLTRDIAFTVSQPEGETAYQILANTAADFGWGEVVLESSIAKVSVVGSGMISHPGVAAQMFEALAASQINILMITTSEIKISCVVEEEDGVKALQAIHKAFCLSANEVVKVPA

SEQ ID NO: 29102 - protein, 521 aa, Solanum lycopersicum x Solanum peruvianum
MVLNNINSILEALQANPILIFFFIIPLFFLYLFSTSRRKRYPPGPLGWPLIGNMMIMDQLTHRGLAKLAQKYGGVFHLKMGYVHKIVISGPEEARQVLQVQDNIYSNRPKTVAISYLTYDRADMAFADYGPFWRQMRKLCVMKLFSRKRAESWDSVRDEVDSMVKIVTTNAGTSINLGELVFCLTRNIIYRAAFGTSSDEGQDDFIKILQEFSKLFGAFNMADFIPWLGWIGKQGLNVRLAKARASLDGFIDTIIDDHIERKKAIHVINDDGYRESDMVDELLAFYSEETKVNESEDLQNAIRLTRDNIKAIIMDVMFGGTETVASAIEWAMAELMKSPEDLKKVQQELANVVGLNRKVDESDFENLTYLKCCLKETLRLHPPIPLLLHETAEESTVSGYYIPANSHVIINSFAIGRDKNSWEDPDSFKPSRFLKEGVADFKGGNFEFLPFGSGRRSCPGMQLGLYALEMAVAHLLHCFTWELPDGMKPSELNMDDMFGLTAPLANRLVAVPTPRLLCEIY

SEQ ID NO: 29103 - protein, 535 aa, Idiomarina loihiensis L2TR
MAILSSKINTRDAQFAANSESMQTVVNDLQEKAAKIHQGGGPKYQERHLSRGKLLPRDRINKLLDAGSPFLEIGQFAAWECYEDYVPSAGVVAGIGQVEGTECMIIANDATVKGGTYYPLTVKKHLRAQEIAERCHLPCIYLVDSGGANLPRQDEVFPDKEHFGRIFFNQANMSAKGIPQIAVVMGLCTAGGAYVPAMADESVIVKEQGTIFLAGPPLVKAATGEEVSAEELGGADVHTRISGVADHFAHNDEHALALARRSVARLNRGEPTKLDRQPAKPPRYDAKELYGIVGTDLRKPYDVHEVIARIVDDSDFDEFKANYGNTLVTGFARIDGYPVGIVANNGILFSESAQKGAHFIELCAQRKIPLVFLQNITGFMVGKKYEAEGIAKHGAKMVMAVSCAKVPKFTVLIGGSYGAGNYGMCGRAYDPTMMFMWPNARISVMGGEQAAGVMAQVTKDNLARKGESLSEEKEQALKKPIVEQYDKQGHPYYASARLWDDGIIDPAQTREVLALSLAASLNAPIEDSRFGVFRM

SEQ ID NO: 29104 - protein, 312 aa, Pseudomonas fluorescens
MYLVCGEALFDFFSEEDASGQASKVTYKAIAGGSPFNVAVGLRRLGIEAGLFGGLSSDFLGRRLLQVLKDEGVSERFLVEFAAPTTLSMVAVGADGSPQYNFRGEGCADRLLEVAHLPVLGDEVRGLHIGSFSLVVQPIGDTLLSLVKRESGKRLISLDPNVRLNPQPDIQLWRDRVAELAKHADLIKVSDEDLHLLYPGQSPESVLQGWLQHRCQLVFLTRGGDGASVFSRQHGTWSQPAQRVVMADTVGAGDTFQAALIAWLTEHQLDSVQGLQQLTRVQIDAMLGFAIRAAALTCGKTGPDLPYRQQLG

SEQ ID NO: 29105 - protein, 303 aa, Ashbya gossypii ATCC 10895
MTSTSHIRFKQLERLGNGTYATVYKGLNKTTGLYVALKEVKLDSEEGTPSTAIREISLMKELKHENIVRLYDVIHTENKLTLVFEFMDNDLKKFMDSRLDREMPRGLELSLVKYFQWQLLQGVAFCHENRILHRDLKPQNLLINNKGQLKLGDFGLARAFGIPVNTFSSEVVTLWYRAPDVLMGSRTYCTSIDIWSCGCILAEMIMGKALFPGTNDDEQLKLIFETMGTPTEQTWVGVSQLPKYNPQIPLYPNKDIKQLLQATTKEQISDVLVNLIQGLLQLNPSMRLSAQQALSHPLFEEYH

SEQ ID NO: 29106 - protein, 330 aa, Neisseria gonorrhoeae
VAINGFGRIGRLALRQIEKAHGIEVAAVNDLTPAEMLLHLFKYDSTQGRFQGTAELKDDAIVVNGREIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVATGSLTELVSVLERPATKEEINAAMKAASSESYGYNEDQIVSSDVVGIEYGSLFDATQTRVMTVGGKQLVKTVAWYDNEMSYTCQLVRTLEYFAGKI

SEQ ID NO: 29107 - protein, 396 aa, Methanocaldococcus jannaschii DSM 2661
MRNMQEKGVSEKEILEELKKYRSLDLKYEDGNIFGSMCSNVLPITRKIVDIFLETNLGDPGLFKGTKLLEEKAVALLGSLLNNKDAYGHIVSGGTEANLMALRCIKNIWREKRRKGLSKNEHPKIIVPITAHFSFEKGREMMDLEYIYAPIKEDYTIDEKFVKDAVEDYDVDGIIGIAGTTELGTIDNIEELSKIAKENNIYIHVDAAFGGLVIPFLDDKYKKKGVNYKFDFSLGVDSITIDPHKMGHCPIPSGGILFKDIGYKRYLDVDAPYLTETRQATILGTRVGFGGACTYAVLRYLGREGQRKIVNECMENTLYLYKKLKENNFKPVIEPILNIVAIEDEDYKEVCKKLRDRGIYVSVCNCVKALRIVVMPHIKREHIDNFIEILNSIKRD

SEQ ID NO: 29108 - protein, 793 aa, Zea mays
AASAADSSSGCWPKTCGDLNVTYPFWVEEPVRPPCGPPSFQLMCNGSRAFLSRSVYQAYQVLGIFPENNSFHVVDHNFPLVTGCPAPTMNISLPGAFVFSRANKELLFLGKCTGFPPAESAGFRSLPCDNSSFVRLGDGRNFSSQSIQGGVPQGCLFTVLPTLGAPDGNGDDYVASMKNGFLVDWEAVPGDCPKCMARGGECTYGGPDAEFACDCSGGKQKLEFFLCKKTSSAIEENIEALILAHGSLAPKRYRYSEVTKITSSLNIKLGEGGYGMVFKGRLDDGRLVAVKFLHDSKGDGEEFVNEVMSIGRTSHINIVSLFGFCLEGSKRALIYEYMSNGSLDKYIYTENPKAVLGWDKLYTIAIGIARGLEYLHHSCNTRIVHFDIKPQNILLDQNFHPKIADFGLAKLCHMKESKLSMTGARGTPGFIAPEVHSRTFGVVSTKADVYSYGMMLLEMVGGRKNVNSAAQESSEKYFPHWIYDHFGQEDGLQACEVTRENEGIAKKLSVIGLSCIQILPMHRPTIGKVMEMFERGSDELDMPPRQNFSQIFEDPVHSLNAETMSMISGTKAKAYSEVLKMKEISVTAVVVVAALLLHLSALPRLGLATATADTNQTSGNDTSCTSARCGNLSVTYPFSLAGVQPIYCGFPSVLPDDMRRRQPHLPQQDVQGSPLQRPPHILRQQPTGLWWSPSRPLLPATANAASRTSTCLPASTSCPSTSVPQTRSSLSSTAAMSLRGYDFNRHATTRQHYSGSVHLRRRRAVPRFDELQQRERAVHVHLPRREALPTFSR

SEQ ID NO: 29109 - protein, 148 aa, Glycine max
GCIVSPDLSVLNLVIVKKGENDLPGLTDVEKPRMRGPKRASKIRKLFNLFKEDDVRKYVNTYRRTFTTKAGKKVSKAPKIQRLVTPLTLQRKRARIADKKKRIAKAKSEAAEYQKLLASRLKEQRDRRSESLAKRRSKLSSAAKAAAV

SEQ ID NO: 29110 - protein, 227 aa, Methanocaldococcus jannaschii DSM 2661 [sequence omitted]

SEQ ID NO: 29111 - protein, 208 aa, Cryptococcus neoformans var. neoformans B-3501A
MSNQQVSTHTPRSADMQPEDELAPTRTEGYKLGHSKTVAELAALDQDDESLQRWKQSLGIAAGASAGGEKRVVLKSLFLSSPTLPSQITIDLTQSKDALAKLKKDPVTIKEGVEYSVGITFMIENEIVSGLKYLQVVKRSGITVDKTEAMLGSYGPQPEPFTKVFASEESPSGMLARSGTYVVRSRVIDDDNTIWLDFEWGFKLGKEW

SEQ ID NO: 29112 - protein, 318 aa, Neisseria gonorrhoeae
MKHLHDLPAWSKLWNHFDDSKTLHMREMFEQDPQRAERYWLQVGGLTLDYSKNRINDETMSLLFELAREAGVPERMRQMFHGEKINTTENRAVLHVALRNRTNSPIMVDGEDVMPKVNRVLQRMGEFAHEVRSGSWLGYTNQVITDVVNIGIGGSDLGPLTMCTALKPFGHPRLNMHFVSNVDGSQLRDVLSKVHPETTLFIIASKTFTTQETLTNALTAREWFLNHAGDEEAVAKHFAAVSTNRKAVAEFGIDIANMFEFWDWVGGRYSLWSAIGLPIMLYLGEENFIEMLNGAHLMDQHFINTPLERNLPVILALI

SEQ ID NO: 29113 - protein, 352 aa, Ralstonia eutropha JMP134
MQNTSGLAPRDAGADTDHPELTPDRLLQLGMGFWASKTMLSAVELGVFTRLAAGPLGAAELISALGLHRRSALDFLDALVALKLLEREQGKYRNTPDTALFLDAAKPSYVGDLLEMANTRLYPFWGSLTEALRTGQPQNEAKRGGNLFEAVYHDEHALRRFLRAMTGVSLGAAKAMAQKFPWQNYSTFIDIGTAQGALPVQIALAHPHLRGGGFDLPAVGPVFEEYVVSHGLQERLRFQPGDFFKDPCPTADVLVMGHILHDWDLGQKLELLKKCHAALPDEGCLIVYDAVIDDERRQNAFGLLMSLNMLIETPGGFDYTGAQCCAWMKEAGFTQVRVEPLAGPDSMVIGIR

SEQ ID NO: 29114 - protein, 426 aa, Methanocaldococcus jannaschii DSM 2661
MELMMAIGYLGLALVLGSLVAKIAEKLKIPDIPLLLLLGLIIGPFLQIIPSDSAMEIFEYAGPIGLIFILLGGAFTMRISLLKRVIKTVVRLDTITFLITLLISGFIFNMVLNLPYTSPVGYLFGAITAATDPATLIPVFSRVRTNPEVAITLEAESIFNDPLGIVSTSVILGLFGLFSSSNPLIDLITLAGGAIVVGLLLAKIYEKIIIHCDFHEYVAPLVLGGAMLLLYVGDDLLPSICGYGFSGYMAVAIMGLYLGDALFRADDIDYKYIVSFCDDLSLLARVFIFVFLGACIKLSMLENYFIPGLLVALGSIFLARPLGVFLGLIGSKHSFKEKLYFALEGPRGVVPAALAVTVGIEILKNADKIPASITKYITPTDIAGTIIIGTFMTILLSVILEASWAGMLALKLLGEYKPKYKEESHH

SEQ ID NO: 29115 - protein, 428 aa, Cryptococcus neoformans var. neoformans B-3501A
MASLVAILDVKGKSLIQRSYRDDVPTSYIERFLPLILEMEEDNVPVTPCFSDEGVNYMHIRHNNLYSTLLKSSSSSIDFALKVLTEYFKELEEESIRDNFVIIYELLDEMMDFGYPQTTESKILQEYITQESHKLEVQVRPPMAVTNAVSWRSEGIRYRKNEVFLDVVESVNLLVNASGNVIRSEILGAVKMKCYLSGMPELRLGLNDKVMFETTGRAARGKSIEMEDVKFHQCVRLSRFENDRTISFIPPDGEFELMSYRLSTPVKPLVFVEASVESHRGSRVEYMVKIKGQFKRRSTANNVEIYVPVPDDADSPKFRASVGSVVYAPEKSAFVWKIKQLAGGRDYLMRAHFGLPSVRNEELDKRAPISVKFEIPYFTVSGIQVRYLKIVEKSGYKALPWVRYITQNGDDYVLRTITDAKTAPLMGV

SEQ ID NO: 29116 - protein, 481 aa, Bacillus halmapalus
TNGTMMQYFEWHLPNDGQHWNRLRDDASNLRNRGITAIWIPPAWKGTSQNDVGYGAYDLYDLGEFNQKGTVRTKYGTRSQLESAIHALKNNGVQVYGDVVMNHKGGADATENVLAVEVNPNNRNQEISGDYTIEAWTKFDFPGRGNTYSDFKWRWYHFDGVDWDQSRQFQNRIYKFRGDGKAWDWEVDSENGNYDYLMYADVDMDHPEVVNELRRWGEWYTNTLNLDGFRIDAVKHIKYSFTRDWLTHVRNATGKEMFAVAEFWKNDLGALENYLNKTNWNHSVFDVPLHYNLYNASNSGGNYDMAKLLNGTVVQKHPMHAVTFVDNHDSQPGESLESFVQEWFKPLAYALILTREQGYPSVFYGDYYGIPTHSVPAMKAKIDPILEARQNFAYGTQHDYFDHHNIIGWTREGNTTHPNSGLATIMSDGPGGEKWMYVGQNKAGQVWHDITGNKPGTVTINADGWANFSVNGGSVSIWVKR

SEQ ID NO: 29117 - protein, 263 aa, Triticum aestivum
  misc_feature (217)..(217): Xaa can be any naturally occurring amino acid
  misc_feature (239)..(239): Xaa can be any naturally occurring amino acid
AYLGDSIEQVCTKKQAGTGPEFPGYRRPTRPVAQKITDDTRIRASIPTIKYLLEKGAKVILASHLGRPKGVTPKFSLKPLVPRLSELLGLEVVMAPDCIGEEVEKLAAALPDGGVLLLENVRFYKEEEKNDPEFAKKLASVADLYVNDAFGTAHRAHASTEGVTKFLMPSVAGFLMQKELDYLVGAVAHPKKPFAAIVGGSQVSSKIGVTKSLLAKXDILNPGGGMIFNFYKAQGLPVXKSLGEKNKLELANFLDQTAKAQGG

SEQ ID NO: 29118 - protein, 283 aa, Bacillus anthracis str. Ames
MIRVGYLGPEATFTNMAVSRFFPEAEHVPYRTIPDCMDAAANGNVDYAVVPLENAIEGSVNITVDYLVHEQPLSIVGEITVPIQQHLLVHPQYADVWEEVYAVHSHPHAIAQCHKFLNEELKGVTARDMTSTSAAAQYVKEHPEEKIAAIANEAAAEKYGLTIVRRGIHTHKNNHTRFLVLHKKKKAILPNNGENRGEKTTLMITLPADYAGALYQVLSAFAWRKLNLSKIESRPMKTGLGNYFFLIDVDKAYDEVLLPGVTMELEALGFSVTVLGSYSSYWL

SEQ ID NO: 29119 - protein, 211 aa, Neurospora crassa
MSTIPPPQGNGLPSQPPAEQQHPLPPRRQQQPMPRHGGSRPRPTAQQQQQQRELPTRKDVSLKELLSKMDEYAPIIPDAVTSYYMTRAGLPPPPQTDQRLARLLALATQKFIADIAADAYQYSRIRASNTNANNPMGSLGAAAGFPIPGQPTNQAAGAKDQGRGGPLGIQRPGYGGGGQGGSQNRTVLTMEDLGMAAGEFGVNVKRSEFYR

SEQ ID NO: 29120 - protein, 160 aa, Coprinopsis cinerea okayama7#130
MAPGWVNLEAATNVIPDSAFSEGEPAFKFLNLSKKTRIYGFLGCLLFGFVLSLVGAILLFGGNVVVFAVFFGLGTLVSLLGTGFIIGFFNQLKLMFKPVRVVATIIFLASIGLVFVGAFVIGSDILCLVLVFVQYLAYIWYTLSYIPYARAAVSKAVGLG

SEQ ID NO: 29121 - protein, 616 aa, Arabidopsis thaliana
MPVSVHSVIATNLATTLSSNYRNVSRRRTISTSVNCSVEITEADRSVKLKNGNDSLEICRVLNGMWQTSGGWGKIDRNDAVDSMLRYADAGLSTFDMADHYGPAEDLYGIFINRVRRERPPEYLEKIKGLTKWVPPPIKMTSSYVRQNIDISRKRMDVAALDMLQFHWWDYANDGYLDALKHLTDLKEEGKIKTVALTNFDTERLQKILENGIPVVSNQVQHSIVDMRPQQRMAQLCELTGVKLITYGTVMGGLLSEKFLDTNLTIPFAGPRLNTPSLQKYKRMVDAWGGWNLFQGLLRTMKTISTKHGVSIPTVAVRYVLDQQGVGGSMIGVRLGLAEHIQDANAIFSLVLDEEDVNSIQEVTKKEMGGFTGFGGLINQNIQQPRKAAAKSKIHENVKSGSVSEKDTNIQEPWYWDPDVDPKLKAEYKKNHSHVRSMPLYAIDPRYYDLLRLFDRDFRQRLDNKSTKVLKKDGPRQITRVKKTLRYKLLGRSIAIPIHLIIDENHKNLTAKYKKEKMMYMKVFEGRWKVEPLYADQERLCKSRSRINEEEYKKCSDGKGRIGSKVTMEQIFQPCSLLNVPPISWFIREITIKTIKNLLEDLRQFVIDMHKNSDPE

SEQ ID NO: 29122 - protein, 232 aa, Brassica napus
  misc_feature (207)..(207): Xaa can be any naturally occurring amino acid
RVVVKKIHQSSVRHKKTFNRVKITGTGEEDMEMVAFPLIPKPIEVNYRACTIPYRFPSDNPKIATPTEISWVNVFANSIPSFKKRAESDTTVPDAPARAQKFAERYGGILEDWKKDPESHGGPPDGVSLGRAREHLLRELGFMDIFKKVKDEENAKAISLFPEVVSLSDAIEDEGERLQNLVRGMFAGNIFDLGSAQLAEVFSRDGXSFLATSQNWVPRPWVIDDLDSFNPT

SEQ ID NO: 29123 - protein, 753 aa, Oceanicola granulosus HTCC2516
MAKARFTPEDALAFHMEPSPGKWEVQPTVPMTTQRDLSLAYSPGVAVPCEAIAANPELAYDYTNKGNLVAVISNGTAVLGLGNLGALGGKPVMEGKSVLFKRFADVNSIDIELDTEDPDAFCDAVRLMGPTFGGINLEDIKAPECFIIEQRLKEEMDIPVFHDDQHGTAVICAAGLINALHISNKKIEDVKIVLNGAGAAGIACIELLKSMGARPENCIVCDTKGVIYQGRTEGMNQWKSAHAVKTDLRSLEEAMDGADVFLGVSAKGAVTEKMVASMADNPVIFAMANPDPEITPEEAHAVRVDAIVATGRSDYPNQVNNVLGFPYLFRGALDIHARAINDEMKIACAEALAALAREDVPDEVGVAYGRKLAFGRDYIIPTPFDPRLIYRIPPAVARAGMETGVARRPIIDMDGYETALKGRMDPTASILRGIYARARAAQGTVLFAEGDDPRVLKAAVLYQRSGYGRSLVVGRESDVKTKLEAEGLADAARELTIVNAANTDHLETYKRFLYERLQRKGHDQQDVHRLAARDRHVFASLMLAHGHADAMVTGATRKSAHVLELINHVFDAGPHDGAVGVSAVLARGRIVLIADTLVHEWPDETDLAVIAERGAAVARTLGLVPRVAFVSFSTFGYPVSERATKMHQAPRVLDARGVDFEYEGEMTVDVALNTRAAEHYPFSRLTGPANVLVVPARHSASISVKLLQEMGGATVIGPILAGVHKPIQICSTVSTVTDILNMAVIAASKVDDR

SEQ ID NO: 29124 - protein, 201 aa, Rhizobium leguminosarum bv. viciae 3841
MALVPMVVEQTNRGERSYDIYSRLLKERIIFLTGAVEDHMATLVCAQLLFLEAENPKKEIALYINSPGGVVTAGMAIYDTMQFIKPAVSTLCIGQAASMGSLLLAAGHKDMRFATPNSRIMVHQPSGGFQGQASDIERHARDILKMKRRLNEVYVKHTGRTYEEVEKTLDRDHFMDADEAQSWGVIDKVLTSRLEMEGEQA

SEQ ID NO: 29125 - protein, 288 aa, Oceanicola granulosus HTCC2516
MTVLNLGSINIDIVFAVPHIPAPGETLSSTGREVFLGGKGTNMSVAIARAGGTVRHIGAVGPDGGWTVERLRAAGVDIGFIAELEEVTGQALIAVDADGENTIILYPGANRALRHDAVMAALAEAGPGDRLLLQNETNLQAEAAREAKALGLAVTYAAAPFDADAVKAVLPTLDMLFLNRVEAEQLTQATGQAPADLGVRDVVITLGADGCDWIGPGGVQHFDAVPVEPVDTTGAGDTFTGYTLAALERGLSMPAALELAGRAGALMVTRHGTSDVIPTLDEVRAFAG

SEQ ID NO: 29126 - protein, 336 aa, Candida glabrata CBS 138
MGSHEGIDTDVISLPRFIIEYQKRVHNATGEFTLVLNALQFAFKFIAHAIRRAELIHLGGLFGTSNATGDEQKKLDVIGDEIFINTMESSNCVKILVSEEQEDMIVFEHNTGNYAVCCDPIDGSSNLDAGVSVGTIVSLFKLQPGSTGKVEDVLRPGTEMVAACYAMYGASTHLVLTMGDGVNGFTLDTNLGEFILTEPDMRVPMYRQIYSINEGNTYYWNDNIKSFINFLKEPQDDGKPFSARYVGSMVSDMHRTFLYGGIYAYPEDKKNPKGKLRLLYEAFPMAFLMEQAGGKAVTDRGERILDLTPTHIHDKSSIWVGSPGEIDKFLKHIGKA

SEQ ID NO: 29127 - protein, 433 aa, Trichodesmium erythraeum IMS101
MASTPQLRREIGVFGATLMGNGSILGTGVFVSIGIAASIAGPSVIIAVAVAGVVATCNAFNSAQLAANHPVSGGTYEYGYKYLNNWLGFIAGWMFLFAKSASAATAALGFAGYFLNAFGVNNNTWLVLTALTAVVVLTIVVLSGIRRSNVTNIIIVSITLFSLVLFILAGVPQVVFSEGKNLMPFFPGDKPIASLLQATALMFVAYTGYGRIATLGEEVKEPRRTIPRAIALTMIFTCVLYISTAIVSVFAGQEVIQKLSQADVSLVAPLEVIAKVGGLGIPVIPKLIAIGAITAMLGVLLNLILGLSRVLLAMGRRRDVPKVVARLDSGQTTPYIAVVIVGVAIACLVLIGDVKTTWSFSAFNVLIYYAITNFAALHLSPEERLYPKWLGWLGLASCLFLAFWVEKQIWLVGLGLILIGLIWHSLIHRFITD

SEQ ID NO: 29128 - protein, 222 aa, Listeria monocytogenes str. 4b H7858
MKMIAASIMCSDSLHLADELRALEQANVKMLHCDVMDGVFVENAAMGAYVLQDIKNNTDMLLDIHLATVNPDKFVDLYAAIKPAYMSFHVEASPDVDATIKHIRALGIKPSIAISPDTEIEQIYPFLDKVDMVLMMTVNPGFAGQKFQHHVLEKIKKLQRELESHTNKPLIEVDGNIFEETVRLLEPIGADVYVVGTAALFNDKAGSYTEKLAPLREIIQER

SEQ ID NO: 29129 - protein, 309 aa, Vitis vinifera
  misc_feature (111)..(111): Xaa can be any naturally occurring amino acid
MSSTLEIEARDVIKIVLQFCKENSLHQTFQTLQSECQVSLNTVDSLETFIADINSGRWDAILPQVAQLKLPRKKLEDLYEQHSLDDFLEDLWRTVVARSHEEVELLVLNLXEIVVQSLFIDGISFGLSHTGDIETERFLIKIVLEMIELRELDTARAILRQTQAMGVMKQEQPERYLRLEHLLVRTYFDPHEGGASLGGTTSPSIKIPFKRRTKTKESLQKFRKIVSNKDDGISSLFVSLSTFLLAAPRKDQWVSLGRSTMQLSSIPGHLLCLVMPEYNVAKCSFSTSLKTLAVVVLFKSSNKAESLSH

SEQ ID NO: 29130 - protein, 204 aa, Triticum aestivum
MLLLRLWPPVACVATATARAMIQSRMSSASTPTAVAVARPAGRYAVYVAAVPLRAPQGPAQALMSSAYSLGLWDLQHFMVLLRPDPARTPTRAQEQEQEPSLVFDFQPRHPEDALAAFSVLSRSKIPGVVRRRRLRRIPDRRSWFVGLSDGDGDAADAAERFSERWPTDLVVGNHDCRDYTNGLVEVLTGQKRVLDALRSAGRQ

SEQ ID NO: 29131 - protein, 201 aa, Azoarcus evansii
MPCYEIDGLRPVVHPSAYVHPDAVLVGDVHIGARCYVAPLASLRGDFGPIILREGANVQDCCVMHGFPGIDTLVEENGHVGHGAILHSCHVGRNALVGMNAVVMDRAVIGESSIVAACSFVKAGMEIPPQVLVAGVPAKVVRTLTRQEMDWKVEGTRCYHDLAARSLTTLKPCEPLTEAEADRPAMVLPEVVPLFELKRRT

SEQ ID NO: 29132 - protein, 372 aa, Ashbya gossypii ATCC 10895
MLNLPTNSSISVTLSQEDLRTLTSAATGPELAEDRLWLNGKPESLGNARTQQCLADLRALRRALETEEPDLPRMSEWKLHIVSENNFPTAAGLASSAAGFAALVVAVAKLYGLPQDYSEISKIARKGSGSACRSLYGGYVAWEMGAEADGSDSRAVQIADVEHWPEMRAAILVVSADRKDTPSTSGMQQTVHTSDLFKERVATVVPRRYGEMAAAIRARDFATFARLTMQDSNSFHATCLDSFPPIFYMNDTSRRIVKLCHLINEFYNETIVAYTFDAGPNAVLYYLAENEARLCGFLSAVFGANDGWETTFSTEQRATFAAQFDECVRGKLATDLDDELHRGVARLIFTKVGPGPQDTKSSLIDPETGLPR

SEQ ID NO: 29133 - protein, 539 aa, Neisseria gonorrhoeae
MDAFTRAWYALERHYQDTCHILLRDRFAAEPDRFERMHERLDGMLFDYSKNRFGEDTLQLLCRLAETADLEGKMRALRTGAKVNGSEGRAALHTALRLPDGADAVYADGRDVLPEIRRELNRALKFAHSLDDGLYQGITGKRIADFVHIGIGGSDLGPAMCVQALEPFRRQISVHFVSNADPACLDEVLCRLNPETTMFCVASKSFKTPETLLNAEAVKAWYRGAGFSESETARHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGAEDGRSRFTVANAFAQAEALMKGKTLDEARAELADLPEAERERLAPHKEFPGNRPSNSILLDRLTPYNLGMLMAAYEHKTFVQGAIWNVNPFDQWGVEYGKQLAKTIIGELEGGTSVHDASTEGLMAFYREC

SEQ ID NO: 29134 - protein, 115 aa, Ashbya gossypii ATCC 10895
MLRLLGGAKRMQSSVSVLRTAAELQAATARPRAVVNLSAAWCGPCRGMAPVYKRLSEEHRDISFYKVDIDELPDAARHFGVTGVPTYVVLRDGREHARVVGADPRALEQALTLDG

SEQ ID NO: 29135 - protein, 364 aa, unidentified eubacterium SCB49
MKAGIVGLPNVGKSTLFNCLSNAKAQSANFPFCTIEPNVGVVNVPDNRLVKLEELVNPERVLPATVEIVDIAGLVKGASKGEGLGNQFLGNIRETDAILHVLRCFDDGNIVHVDGSVDPVRDKETIDIELQLKDLDTTEKKLEKVKRASRTGNKEAQTEEAILIRIKEGLEQGKSVRALDFTEKEREEYVKPLQFITDKPVMYVCNVDEAGAKAGNAYVEQVKEAVKEENAEVIFLAVGMEADITELEDFEERQIFLEDMGLQEPGSAKLIRGAYKLLDLQTYFTAGVKEVRAWTIPVGATAPQAAGVIHTDFEKGFIRAEVIGYDNYVAYGSEIKVKEAGKMGVEGKEYIVKDGDIMHFRFNV

SEQ ID NO: 29136 - protein, 302 aa, Arabidopsis thaliana
  misc_feature (260)..(260): Xaa can be any naturally occurring amino acid
MTSNLFQPPSMAASRGAISRRTGNVKVLVSFTSSNGKTLSFSDNSFRLRPMFIGKVTEQSSCSSPNEQQQDEEQEQEQEEITVSHIKEELYEALKGINRGIFGVKSDKKTEIEGLVKLLECRNPTPEPTGELDKIGGCWKLIYSTITVLGSKRTKLGLRDFVSLGDLLQQIDIAQGKTVHVLKFDVRGLNLLDGEFRIVASFKISSKSSVEITYESSTIKPDQLMNIFRKNMDLLLGIFNPEGLFEISYPFLIKIQNRNXNCVCYGLDSLILRNYCRYLDEDLQVGRDGKGNVFVLERIEKP

SEQ ID NO: 29137 - protein, 267 aa, Bradyrhizobium sp. BTAi1
MIADPHAIPQLAARALQIADRINTAGFEGQVLSATPLAVRIGETGVAVVFRYGVVVFIGLSVADELNFLDRLSGRLFGPIAPPEEETAKVQVAGESEEPIPVGGPILVKELSLERLLIVADALAKSVVLGRSEREIANVFDTIEPFARELAALGRTSKSRVAMLKLLGAALLVQHRVSGRVAVGEKPDVLWDRPDLERLYARLEDEYELKEREETLNRKLAVIAETATALADIIDTKRSLRLEIIVVILIACEIVLGFYEIFARSGH

SEQ ID NO: 29138 - protein, 539 aa, Neisseria gonorrhoeae
MDAFTRAWYALERHYQDTCHILLRDRFAAEPDRFERMHERLDGMLFDYSKNRFGEDTLQLLCRLAETADLEGKMRALRTGAKVNGSEGRAALHTALRLPDGADAVYADGRDVLPEIRRELNRALKFAHSLDDGLYQGITGKRIADFVHIGIGGSDLGPAMCVQALEPFRRQISVHFVSNADPACLDEVLCRLNPETTMFCVASKSFKTPETLLNAEAVKAWYRGAGFSESETARHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGAEDGRSRFTVANAFAQAEALMKGKTLDEARAELADLPEAERERLAPHKEFPGNRPSNSILLDRLTPCNLGMLMAAYEHKTFVQGAIWNVNPFDQWGVEYGKQLAKTIIGELEGGTSVHDASTEGLMAFYREC

SEQ ID NO: 29139 - protein, 626 aa, Herminiimonas arsenicoxydans
MSARSTMSVSRRRFVQGLAAGGVLLGVSAPLRHVLAQDVIASGTAAPVLRGNQFDLVVAESPVNFTGKAAIATTINGTLPAPTLRWKEGETVTIRVTNRLAVPTSIHWHGIILPFQMDGVPGISFNGIAPGETFTYRFKVQQSGTYWYHSHSGFQEQTGMFGAIIIDPAQGKDIAADREHVLLLSDWMDDDPMTVLGRLKKQGDYYNYGQLTAGGFFNDVSKDGWKAALSKRKMWNEMRMNPTDMGDLSAAVLTFLTNGITPAGNWTGLFQKGEKVRLRCINGSGNTFYDVRIPGLKLKVVQVDGVNIEPISVDEFRFGPGETCDVVVEPKDDAYTIFSQTMDRTGYALGTLAVKPGLRAPVPAIDKLEWLSMEDMMGDMSNMAGMDHGAMNMGGMSMDKMDMSGMSSMEGDSMAQMPNMAGMDHSAMGMQHGGMAMDHSKHAANADPLKTPSKKPRHASTEYGASTDNRIDSPRTTLNDPGVGLRNNGRRVLTLADMHTIGGPLDPRGPGREIELHLTGNMERYTWSFDGLEFGKSSPVHFKYGERVRVILQNDTMMTHPMHLHGVWSELETPEGEFLARRHTIPVQPAQRISFLVTADALGRWAWHCHLMMHMDAGMFREVIIA

SEQ ID NO: 29140 - protein, 623 aa, Candida glabrata CBS 138
MKTCYYDLLEVRSDASDLDLKKAYRRKALQYHPDKNPDNVEEATTIFAEIRAAYEVLSDPQERAWYDSHKEQILSDTPLNPNDEDDDYVVDSTVTGVTTEELMMFFNSSLYTSIDNSPAGFYQIAGKVFAKIAKDEVSWGLRLGLDGYKNYKDMEFEEHINSRGYILACDSSKANLSNLLFPIFGYSSTSYEELKLFYTKWSSFNTLKSFTWKDEYMYSRNYDRRTKREINKRNEKARAKAKEEYIKTVKRYVNFIKKLDQRMKEGAKKAAEKRLADERLRKENEMKLRKERLNNEQGAQFHLQSWQTIDQENWKELEKQYEKEFEKRNVDKDDELIGHEFTKNQFQTNNNSQHEDVDEIIIYDCFICKKSFKSEKQLENHIKTKLHKRNLDRVQKEMKKDSMALGLDELSDYNDFDSAESETEKLYSGMDLNDIDAELKKIEEQLAQSSVTDSEDFTDDNNDTEDQNSLVDKLSNTNYDIEIDDEINDDTNEEVQISGADNSETQNAEQDHDSNGDSEEEKEDELTRILRELEESKTSRSNFSDSDEEWSNKKKTKAKKKKNKANTPDKQPVTANKNDAKEVCGECRAEFESRNQLFSHIQTEGHVSPLSKVKKGKRSKKNK

SEQ ID NO: 29141 - protein, 381 aa, Aspergillus nidulans FGSC A4
MLSSRGEKKAKSFDIPWRFAVAPTYDKEANPDGIICFGMAEHGPVRADIAEYINNNVKFTTNSVCYPSMSTSNPLPAAVSSHLNKYFKPLIPITPEMVVKVNGCSAAGNMLSFALAEPGDAVLVSRPVYGRFELDYGVQGGVEIVYADTDVNEAFGTACVQRYEEALEKARERGVRVRALVVVNPHNPVGMNTLNSTSFVGRCYPPETLVEIMKFCNRHKLHLISDEIYAFKDFASGGLHLGFIISRNFELRRACSAMLRFHSPSSAAETIGTAILQDEDFVSRFIERSRRDLAHSYSIATSILDQEGINYVKGGNAGFFLYIELSPYLSLPNQEHEFALAQRLLDNGLFLHPGEEHCKEPGWFRLVFSHDEHILREGLRR

SEQ ID NO: 29142 - protein, 432 aa, Coprinopsis cinerea okayama7#130
MAKRRKNRTHLKGGQRDEGKSSAPKSFIIKHGHVGSSITQLVRDMRKVMEPNTASRLKERNRNKLKDYMTMGPALQVTHLLAFRLTPIAPSLRIVRLSDGPTLSFRVERYSLMKDVLNTARRAKSIGMEYLTPPLLVLASFPQPGPGTPPHLPLVMKAFQSLFPPLSPHTISLSSARRVVLISYNEERGTIDFRHYLIRVKAHGVSKRVRRVVESATSSSKPVINLGKEKDVADFLLRRRGDPGPDGGYESASSAESAVEDGDMVSLASDYVGRNNKKGTKRAVKLEEVGPRMELRLVKITEGVPGKEGNVIYHEFVKKTKKEIAEQKAAIAEKERLRKQRREEQERNVARKKKSANKKGDDDASSDDEGSVEDESGGEGDVEHEVDDIGEWDEEEEISEGEESEDEQDLSEEDSSDEDKPPAKKPRFHRKR

SEQ ID NO: 29143 - protein, 191 aa, Oryza sativa
SSSPRLSPHIIPSVLLPPHPPQPLHPGRRPPPPPPPPRRMQRAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERGNKPPCVFILSLATGSVIQKHNHMLEDRLLLNSVVKKRY

SEQ ID NO: 29144 - protein, 526 aa, Magnaporthe grisea 70-15
MGLLQDTTGPLVDAFYQLGTGAQVGVAFVSFIFLSVFFHVAQQIFFKNPHEPPVVFSWFPVVGSTVTYGKDPPQFFRDMAKKYGNIFTFILLGKKTTVYIGTEGNEFILNGKLRDVNAEEIYGPMTTPVFGKDVVYDCPNAKLMEQKKFMKIALTTEAFRSYVPIIADEVSSYLKRTPAFKGPSGVVNIPPKMAEITIFTASHALQGKEIRDQFDETLADLYHDLDMGFHPVNFKLHWLPLPRNIRRDKAQKTIAKIYMDTIQRRRAKGKDSEAKDMMYHLMNSTYKNGTPVPDHEIAHMMIALLMAGQHSSSSTSSWIMLRLASRPDIMEELYQEQVRALGADLPPLRYEDLANLPLHLAVIKETLRLHAPINSILRAVKQDLPVPGTNYVIAKDTTVLAAPGYSAGDPNHFPEPELWEPHRWEADSRLAPRISMSNDNDEEEKIDYGYGLVSKGTTSPYLPFGAGRHRCIGEHFANVQLQTIVAMIVREFKFRNVDGSGKVVGTNYASLFSRPEEPAKIYWERR

SEQ ID NO: 29145 - protein, 88 aa, Zea mays
  misc_feature (65)..(65): Xaa can be any naturally occurring amino acid
MAPTVMASAGTSVAPFQGLKSTAGLPVSRRSNGASLCSVSNGGRIRCMQGWPFEGIKKCETLSYXPPVNTEALLEQEDYLVRCQGAPG

SEQ ID NO: 29146 - protein, 142 aa, Vitis vinifera
MVSSVLLAAFSLRFSTAEAVNPKAYPLADAQLTITILDLIQQAANYKQLKKGANEATKTLNRGISEFIVMAADTEPLEILLHLPLLAEDKNVPYVFVPSKQALGRACGVTRPVIACSVTSNEGSQLKSQIQQLKDAIEKLLI

SEQ ID NO: 29147 - protein, 268 aa, Glycine max
MKDDKQAPVPASTTEGQPIRCKAAVSRRAGEPLVIEDIIVAPPKPREARIRIICSSLCHSDITLRNLQDPPAIFPRILGHEATGVVESVGKDVTEVTKGDVVIPVILPECGECIDCKSTKSNRCTNFPFKVSPWMPRDGTTRFTGQNGEIIYHFLFISSFSEYTVVDIANLIKIDPEIPPDRACLLGCGVSTGVGAAWRTAGVEPGSTVAIFGLGSIGLAVAEGARLCGATRIIGVDINPEKFEIGKKFGVTDFVNAGECGGKPVGQV

SEQ ID NO: 29148 - protein, 323 aa, Trichodesmium erythraeum IMS101
MKENHKSTVVITGASSGVGLHAAKALAKTGEWYVVMACRDISKAEKVAQEVGMTQDSYTVMHLDLASLEVVKRFVKTFRESGRSLEALVCNAAVYLPLLKEPMRSIDGYEISVATNHLGHFLLCNLMLEDLKKSPAKDKRLVILGTVTANPKELGGKIPIPAPPDLGNLQGFEQGFKTPISMINAKKFKSGKAYKDSKLCNVLTMRELHRRYYKSTGIVFSSLYPGCVADTPLFRNHYPLFQKLFPLFQKNITGGYVSQDLAGERVAAVVKDPEYKESGIYWSWGNRQKKDRKSFVQEVSDEASDDDKAIKLWELSSKLVGLS

SEQ ID NO: 29149 - protein, 514 aa, Glycine max
MKGALDRTKVVLRHLPPSISEAALLAQIDAAFAGRYNWLSFRPGKISQKHISYSRAYVDFKRPEDVILFAEFFNGHVFVNEKGSQFKVIVEYAPSQRVPRQWSKKDLRDGTIYKDSEYLEFLELLAKPVENLPSAEIQLEKREAERSGAAKDIPIITPLMDFVRQKRAAKGPRRPLSNGKVSRRAGTSSNGGPSSATSRRGSGKKRVSATMYVARDPGKSSTIKDKSSYTLVPKQDDQHLPNKASNMASSDGNQTLDENGVSGNHDAGKKKVLLLKGKEREIITVSDLDSMSQHHNVTSSAKTVVGSTVLKQSQRHEGSGRIIRSILSKKELRQSQYSRALSEQQIQTSNLEKEKQPPRPLHVQLILKGSNGTPENKIGVHDSHVSSERQERHVRHKDRPDRGVWTSRSNGADDSFSSSASSQVDPLEGSHADLKHDTPNARSGEVKSLGSVRTSHSSENGFNKHFGRRGPSHGVKDVDGYSVSSEGKHLRRSSTSAYGSNEKQVWVQKASSGT

SEQ ID NO: 29150 - protein, 423 aa, Vitis vinifera
MAFRTGISRRMMIRSGFGLRSMSSWWGSVEPAAKDPILGVTEAFLADPSPDKVNVGVGAYRDDNGKPVVLECVREAERRIAGKLNMEYLPMGGSVNMVEETLKLAYGENSEFIKDKRIAAVQALSGTGACRLFADFQKRFRPDSQIYIPVPTWANHHNIWRDAQVPQRTFHYYHPETKGLDFASLMDDVKNAPNGSFFLLHACAHNPTGVDPSEEQWKEISYQFKVKGHFAFFDMAYQGFASGDPERDAKSIKIFLEDGHLIGIAQSYAKNMGLYGQRVGCLSLLCEDEKQAVAVKSQLQQIARPMYSNPPVQGALIVSTILGDPELKKLWLKEVKVMADRIIGMRTALRENLEKLGSPLSWEHITNQIGMFCYSGLTPEQVDRMTNEFHIYMTRNGRIRWQVLQLEMSHIWLMPSMKCQNLL

SEQ ID NO: 29151 - protein, 360 aa, Azoarcus evansii
MTTHRTPKFHPLKVAEVRRETPEAVSLRFEIPAELAEDYRFEQGQHLNLKVMVNGEGVRRSYSICSGVDDNELRVAIKKIGGGVFSTWANDGGIRVGDVLEVMTPEGRFHTPLDPAHAKHYVAFAAGSGITPILSLVKTTLAAEPHSRFTLVYSNRRQASVMFAETLEDLKNRHMARFTLYNLFSREEQEVPLFNGRLDGERVRQFLDTLIPVDTIDEAFICGPGAMIDEVEAALQPRASHTSTSTLERFGVPASAPEHHVEPGDATQAKVTVIADGLRREMEFRAEDPSILDVALRAGMDLPYSCKVGVCCTCRAKLLDGKVRMDKNFTLEQPDVDAGYILTCQAHPLTERVVISFDER

SEQ ID NO: 29152 - protein, 300 aa, Methanocaldococcus jannaschii DSM 2661
MGMDMIEMIEKAEILMEALPFIQKFYGKIFVIKYGGHAMIDEKAKNWTAQDVVLLKYVGINPVVVHGGGPEINKAMEKMGKKPEFVHGLRVTDEETLDIVEMVLAGKINGDIVSKLSKFGGKAVGLSGKSGRIILAKKKLKKIKTEKGEEIEVDLGRVGETVEVNTELLEILINNGYIPVVSPIGLDEKGEAYNLNADTVAGDIAGALKAEKLILITDVDGIMDDINNPETLHRKLTASELKEMIEDGRIKGGMIPKAESALYALEHGVKSVHIINGKIPHALLLEIFTEEGIGTMITRD

SEQ ID NO: 29153 - protein, 539 aa, Neisseria gonorrhoeae
MDAFTRAWYALERHYQDTCHILLRDRFAAEPDRFERMHERLDGMLFDYSKNRFGEDTLQLLCRLAETADLEGKMRALRTGAKVNGSEGRAALHTALRLPDGADAVYADGRDVLPEIRRELNRALKFAHSLDDGLYQGITGKRIADFVHIGIGGSDLGPAMCVQALEPFRRQISVHFVSNADPACLDEVLCRLNPETTMFCVASKSFKTPETLLNAEAVKAWYRGAGFSESETARHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGAEDGRSRFTVANAFAQAEALMKGKTLDEARAELADLPEAERERLAPHKEFPGNRPSNSILLDRLTPYNLGMLMAAYEHKTFVQGAIWNVNPFDQWGVEYGKQLATTIIGELEGGTSVHDASTEGLMAFYREC

SEQ ID NO: 29154 - protein, 458 aa, Mannheimia succiniciproducens MBEL55E
MSAGKIVQIIGAVIDVEFPENAVPKVYDALKVAEGGLTLEVQQQLGGGIVRCIAMGSSDGLKRGLSVSNTGKPISVPVGTKTLGRIMNVLGEPVDEQGPIGAEEEWAIHREAPSYEEQSNSTELLETGIKVIDLICPFAKGGKVGLFGGAGVGKTVNMMELIRNIAIEHSGFSVFAGVGERTREGNDFYHEMTDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPQVVGQEHYDVARGVQGILQRYKELKDIIAILGMDELSEDDKLVVARARKIERFLSQPFFVAEVFTGSPGKYVSLKDTIRGFKGILEGEYDHIPEQAFYMVGSIEEVVEKAKNM

SEQ ID NO: 29155 - protein, 539 aa, Neisseria gonorrhoeae
MDAFTRAWYALERHYQDTCHILLRDRFAAEPDRFERMHERLDGMLFDYSKNRFGEDTLQLLCRLAETADLEGKMRALRTGAKVNGSEGRAALHTALRLPDGADADYADGRDVLPEIRRELNRALKFAHSLDDGLYQGITGKRIADFVHIGIGGSDLGPAMCVQALEPFRRQISVHFVSNADPACLDEVLCRLNPETTMFCVASKSFKTPETLLNAEAVKAWYRGAGFSESETARHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGAEDGRSRFTVANAFAQAEALMKGKTLDEARAELADLPEAERERLAPHKEFPGNRPSNSILLDRLTPCNLGMLMAAYEHKTFVQGAIWNVNPFDQWGVEYGKQLAKTIIGELEGGTSVHDASTEGLMAFYREC

SEQ ID NO: 29156 - protein, 196 aa, Zea mays
MGRAKKPQKFAVMKKTISHKALKHYKEEVLNPNKKDLTELPRNVPNVPSGMFFSHNTNMVPPYRVLVDTNFINFSIQNKIDIEQGMMFCLNAKCTPCITDCVMAELEKLGQKYRVALRIAKDPRFERLPCVHKGTYADDCLVDRVTQHKCFMVATCDRDLKRRLRKVPGVPIMYLAGRKYSVERLPEATLGRAPRY

SEQ ID NO: 29157 - protein, 256 aa, Desulfotalea psychrophila LSv54
MKFRPCIDLHNGQVKQIVGSTLSDVEPSQLQTNYTADKPASWFANLYRQDDLRGGHIIKLGPGNDDAAKSALAAWPGGMQIGGGINYDNACDWLDLGASHVIVTSWVFSNGQIDEGRLADLVRRVGKKRLVLDLSCRRRGDDYFIVTDRWQKFTEVQVVPEVLERLASCCDEFLLHAADVEGKCEGIERDLVLKLADWSPIATTYAGGIRGVEDLQAIAELGRGRIDATIGSALDIFGGSLISYAEAVEFHKRNDL

SEQ ID NO: 29158 - protein, 177 aa, Musa acuminata
FGSVYKGEIPDSGAIAVKRLESIRQGEKQFRMEVSTIGTIHHVNLVRLRGFCCEGDKRLLVYDYMPMGSLDSVLFADDREALDWKKRYRIALGIARGLAYLHERCRECIMHCDIKPENILLDMDMCPKIADFGMAKLLGREFSRVLTTVRGTIGYLAPEWTTGSAITPKADIYSYGV

SEQ ID NO: 29159 - protein, 121 aa, Zea mays
VCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVREETYTAFENIYPVLSEFRKIQQ

SEQ ID NO: 29160 - protein, 359 aa, Brassica napus
MEKYELVKDIGAGNFGVARLMKVKDSKELVAMKYIERGPKIDENVAREIYNHRSLRHPNIIRFKEVVLTPTHLAIAMEYAAGGELFERICGAGRFSEDEARYFFQQLISGVSYCHAMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTIQKIMAVQYKIPDYVHISQDCKHLLSRIFVANSLKRITIAEIKKHPWFTKNLPRELTETAQAAYFKKENPTFSAQTAEEIMKIVDDAKTPPPVSRSIGGFGWGGEGDLEGKEEEEVDEEEVEEEEDEEDEYDKTVKEVHASGEVRIS

SEQ ID NO: 29161 - protein, 396 aa, Cryptococcus neoformans var. neoformans JEC21
MSQSQDIQRADSHLDVAPTPQNTPLETGVLQNRPANLGQPTVETLQEGEESEEDEEVGGANPASLLAQNPALLAFAQSKLDGLVGKPSGYIESLPPAVRRRIDGLKGVQAKHSEIEGEFQLAILELEKKFLVKYQPLYERRQAIVKGEAEPTESEIEAGQASDLEDSDAEDEEEKKTKEEATGGEDVKGIPEFWLTALKNHVPTAETISDRDEEALKHLVDVRLSYLDGEKPGFKLHFVFTANEFFEDAELTKTYYYQEQVGYGGDFVYDKAIGTEIKWKEEKDLTKKVEIKKQRNKTTGRTRTIRKVVPTDSFFNFFKPPQPPTPDTLEASDIDEEELEELDSRLELDYQIGEDFKEKIIPRAVDYFTGKALRYEDFEEEDDFEDEDDFEDDDDE

SEQ ID NO: 29162 - protein, 124 aa, Brassica napus
MAEGGNRVPSSVSVIDAHELLQAGHRYLDVRTPEEFSQGHATGAINVPYMNRGNFIAFWMSKNPNFLEQVSSHFGKADEVLVGCQSGGRSLRATAELLDAGFTGVKDISGGYSAWAQNNLPTQD

SEQ ID NO: 29163 - protein, 489 aa, Arabidopsis thaliana
MAPTIKRIRSFRTHQKHFVDFFGDDLIVTVTPTASVIRRWIRSVRSYNRNHSVHPLVVGIGVQWRPDSSDPDPPPKTLQLCVGSRCLIIQLGYNYGLPKVLRTFLADPKTTFVGVWNGQDQKKLEKCRHRVEIGKLLDIRMFVRDSRGARMCFCSFEQIVKERLGRVGVRLDPAICMSDWGVYNLNHYQVNDVTLHLNRPNLTAFIFKKINGDSEHQYYNLTSLRRLQKEKKAVSSLSLLEKLKAKSMAPTIRTIGSYATQQRYSVDFFGEELFVTVTPDPSVIGQWIHDVFFHNRLSSHPLVVGVGVQWTPSGYHPASPPVSYRSDSSPDSYRSDSPPVFYSSDPPADTLQLCVGNRCIIIQLRYCERVPQVLRNFLADRDNTFVGIWNSQDAGKLERSRHQLEIAELMDLREFVSDSSGRRSMYNYSLEKIVEENLGYPGVRLDREVSMSDWRVYNLSYDQILQASIDVYACCSLAILDHLWEEKNR

SEQ ID NO: 29164 - protein, 303 aa, Gloeobacter violaceus PCC 7421
MRKPVIHDQDGHADDLVATLLLALYPAVDLRAVVVNSGDCIPQVSAAVLAALLDRLGKGAVPVAWQHHALPHPFPTAWQRESLNYLRAFPEAERYYPAAAGTRLLTETILAAGEPVTLLVTGPCTNLAAALRAAPEIARHLERVVLMAGGLEAGGNVAGEQDHDGSAEWNLYCDPPAAAYCLQAGLALDFVSLDVTNFVPMTARFVETLRSRGGACRLAAELLAGVEQQNYFFWDTLAALLTCEPDFLPRGRRTLTVRTDPPAAGRLEKTASGVPARVFEPDADVESLGARVEVRVAEILSAL

SEQ ID NO: 29165 - protein, 416 aa, Cryptococcus neoformans var. neoformans JEC21
MSQSQDIQRADSHLDVAPTPQNTPLETGVLQNRPANLGQPTVETLQEGEESEEDEEVGGANPASLLAQNPALLAFAQSKLDGLVGKPSGYIESLPPAVRRRIDGLKGVQAKHSEIEGEFQLAILELEKKFLVKYQPLYERRQAIVKGEAEPTESEIEAGQASDLEDSDAEDEEEKKTKEEATGGEDVKGIPEFWLTALKNHVPTAETISDRDEEALKHLVDVRLSYLDGEKPGFKLHFVFTANEFFEDAELTKTYYYQEQVGYGGDFVYDKAIGTEIKWKEEKDLTKKVEIKKQRNKTTGRTRTIRKVVPTDSFFNFFKPPQPPTPDTLEASDIDEEELEELDSRLELDYQIGEDFKEKIIPRAVDYFTGKALRYEDFEEEDDFEDEDDFEDDDDEDAEGAADANAAAANPDCKQQ

SEQ ID NO: 29166 - protein, 355 aa, Chlamydomonas reinhardtii
MSDAATINGGTPPDAGPKKTKEPRNTRITQQTLPACKPVLEPIWVVFIFLAMGVVLVPIGGVCLYYGMKPYEVGTRYDQTCLPNMTNSQRESYILQVGDNSLSCTVALRIEEDMAAPVYVYYELRGYYQNHRRYVKSRSDMQLANEPKNQATSLCDPQEFLNGNSSELINPCGLVAWSFFNDTYAVSARFGRVLLPISDEGIAFESDIKYRFANYTPEYFNPTLNSNRGGFNLSSTSGGATPKENQRFMNWMRLSALPTFRKLWGIINQDLKSGDTVTITVYNRYNTYKFDGQKSIVLGTTTWLGGYNPFLGIAFLVTGGLSFVMAVVYMALRIAKPRKFGDPSALSFNKPAGSG

SEQ ID NO: 29167 - protein, 500 aa, Mycobacterium sp. JLS
MPDVNVTSESRMLIDGKLVDGEAGTFINVNPANEEVLGEVADASRADMQRAIDAARRAFDETDWSTNGELRKRCLLQLHEAIEGELAELREELILEAGAPRAVTYGPQLDAPLEDGLKYPARLIDEFTWETDLGDKVVSVTGVNTRRKVWHEPVGVVGAIVPWNFPFEVTVNKLGPALAAGNTVVLKPAPNTPFNATRLGRLIAEKTDFPAGVVNVVTASDHFVGEELTISPKVDMISFTGSTVVGKRIMEKGAATMKRLFLELGGKSATIVLEDADFNTACLIGIGPLMHAGQGCAAPTRMLLPRSRYDEGVALLKALYENMRAADPQDPGTICGPVISGRQQARILGYIQRGVDEGATLLVGSTEAPKEFDKGFWVSPTLFTDVDNSMTIAQEEIFGPVLVVIPYEDEEDAIRIANDSVYGLAGNVMSSSLDRSLAVARRLRAGFIGLNGTAGYGADTPFGGYKDSGVGRQNGIVGFSQYTEVKSVAYPADERLREEQ

SEQ ID NO: 29168 - protein, 563 aa, Haemophilus influenzae 86-028NP
MRLKFQLFLMKGNTMKNINPTHTQAWKSLEAHKAELSNTTIQDLFKQEKNRFDDYSLTFNNQILVDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFRTTPIEKNIPTTLALVGLWNTNFLGAQTEAILPYDQYLHRFAAYFQQGNMESNGKYVDRDGNVINNYQTGPIIWGEPGTNGQHAFYQLIHQGTTLIPCDFIAPAQSHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 29169 - protein, 550 aa, Zea mays
  misc_feature (252)..(252): Xaa can be any naturally occurring amino acid
MYKNQLQELAQRSCFNLPSYSCIREGPDHAPRFKATVNFNGEMFESPVFCSTLRQAEHAAAEVALNELSKRGPSSTLAAKVLDETGIYKNLLQETAHRAGLKLPIYTTIRSGPGHTPVFACTVELAGKAFTGNPGKTKKQAQKNAAMAAWSELKKLPRVGEPSSSSCPPDQDDEVQEQVVVTRTLASLNQANSGKVPHQKEKQQSNNRPSSRRCYPKPNTPFYRPFMQNQAYPSVPPDQAMYHLWHRMQVTXTPRFPVVPAMGNTSFCPPAAMLPMYPPSPQGQFSNPANQDALGLLPCFPDASPAMLRHFSPYPVSYVPRSPLPVTVHNVHERRHDHTETVELPDAVVFSQCTTLDSFRTSECGGPPLKVQEPTKNRKEGCIGSPEKELDTLAVSSSTAQASSQKLEANEGKQTVQAGLKQTHEQQLMSSSSCVSSSVVAQSSHYASSIQHDESIHRRNPPHTSSPALPDVWSSRSQALPRFGSPSWVFQQRPWLAAPVTVRTAVPVCSARPNVVNSTTGIRPAAQSHDGERDLNSAAAASSGFNKLQI

SEQ ID NO: 29170 - protein, 183 aa, Magnaporthe grisea 70-15
MGLSISKLFDRLWGKKEMRILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDAILLVFANKQDLPNAMNAAEITDKLGLHSLRQRAWYIQSTCATSGDGLYEGLEWLATTLRKAGHQ

SEQ ID NO: 29171 - protein, 756 aa, Arabidopsis thaliana
MTSIIGAALPYKSPEKAIASSSYSAENDSSPVDAVIFAGTSLVLGTACRYLFNGTRVPYTVVLLVIGIFLGSLEYGTKHNLGKLGHGIRIWNGINPDLLLAVFLPVLLFESSFSMDVHQIKRCMGQMVLLAGPGVLISTFCLGALIKLTFPYNWDWKTSLLLGGLLGATDPVAVVALLKELGASKKMTTLIDGESLMNDGVSVVVFQLFFKMVMGHNSDWGSIIKFLVQNSFGAVGIGLAFGIASVFWLKFIFNDTVAQITVTLSASYFAYYTAQEWAGVSGILTVMILGMFFAAFARTAFKGDSHQSLHHFWEMAAYIANTLVFMLSGVIIAESVLSGQTISYKGNSWSFLFLLYLYVQLSRCVVVGVLYPLLCRSGYGLDWKESIILTWSGLRGAVSLSLALSVKQSSGNSYLSSDTGTRFLFLTGGIVFLTLVVNGSTTQLLLHLLRMDTLTATKKRILEYTKFEMMKTALKAFENLGDDEELGSADWPTVIRHISSLKDLEGRQVNPHDGYEAGSLDPTNIMDIRIRFLNGVQAAYWEMLDDGRITQCTANVLMQSVDEALDLVSTSSLSDWRGLEPRVHFPNYYKFLQSKIIPHKLVTHLIVERLESACYISSAFLRAHRIARQQLHIFLGNSNIASTVINESEVEGEEAKQFLEDVRDSFPQVLSVLKTRQVTHYVLNHLNGYIKNLEKVGLLEGKEVSHLHDVVQSDLKKLLRHPPSLKLPNVDDLITSNPLLKDRSSFRSLAIGETDA

SEQ ID NO: 29172 - protein, 378 aa, Physcomitrella patens subsp. patens
MALLGSRCRLSGLSRRLLSTRAASSVGSNSYGASRRSFSSDSEEEKIITATLFPGDGIGPEIAVSVKEIFAAAKAPIEWDEHWVGTKVDPRTGSFLTWESMESVRRNGVGLKGPMTTPIGKGFKSLNLTLRKELGLYSNVRPCLSIPGYRTRYDNVDLVTIRENTEGEYSGLEHQVVRGVVESIKIITRNASLRVAKYAFHYARLHGRKRVSAIHKANIMKKTDGLFLECCREVAAEYPDIVYEEVIIDNCCMMLVKNPSLFDVLVMPNLYGDIISDLCAGLIGGLGLTPSGNIGDNGLALMEAVHGTAPDIAGKNMANPTALLLSSVMMLHHLKLHNHADQIHNAVLKTISEGKYLTSDLGGKSTTTDYTKALIDNL

SEQ ID NO: 29173 - protein, 735 aa, Synechococcus sp. WH 5701
MTGNPRRGGPTSAASRRWLLLLAVVVLVALFFLLDLPQRLSLEALRDAHAGLLAWRQRAPLSAAALYGLAYVLVTGLSLPGAAVMTLAGGAVFGLGLGTLLVSFASSAGATIAFLLARTLLREPMLRRFGTRLAPIEEGLRRDGVLYLLSLRLVPVFPFFLVNVVMGLTPIRTLSFYLTSQIGMLPGTLVYVNAGTQLAQLRSLEGILTPPLLLSLALLGAFPWIARLALERWKLWRLYRPWTKPARFDRNLIVIGAGAAGLVTAYIAAAVKAKVTLIEAERMGGDCLNTGCVPSKALIATARAAARMRQADRYGLEPHEPSVSLPLVLERVFAKVAEVAPHDSVERYEGLGVEVLRGHGRLIDPWTVAITTRDGQEQRLTAPAIVLATGASPVLPDLPGADAVGLLTSETVWQALRDCPLASPRIVVMGGGPIGCELSQALARLGARVTLLQRGPQLLSREDPDAAAVVHQALEADGVRVLTSCTVRGFEPRPAATAVLITTGGPEAPEASELLGDQVLCAIGRRARLEGYGLEELGIPTGRTIDTNASLQTLFPNIYAAGDVAGPWQFTHTAAHQAWYAAVNALFGPFRRFRVDGRVIPRTTFTDPEVAGVGLSESEAARQGVAVEVTRFPLHELDRAIVESAETGFVKVLTPPGSDRILGVTIVAEQAGELLAEFVLAMRWRLGLGKILSTIHAYPTLSEANKYAAGAWKRAHAPQRTLALLQRFHSWRRGA

SEQ ID NO: 29174 - protein, 211 aa, Arabidopsis thaliana
LLRENKRMLDKSIREIERERQGLQTQEKKLINEIKKTAKQGQMGAVKVMAKDLIRTRHQIEKFYKLKSQLQGVSLRIQTLKSTQAMGEAMKGVTKAMGQMNRQMNLPSLQKIMQEFERQNEKMEMVSEVMGDAIDDALEGDEEEEETEDLVSQVLDEIGIDINQELVNAPSSAVAVPAAKNKVVQAEATGAEDSGGIDSDLQARLDNLRKM

SEQ ID NO: 29175 - protein, 167 aa, Limonium latifolium
GYDGFEGVKTLVDVGGSSGDCLRMIINKYKDIPKAINFDLPEVVAKAPKIPGITHVGGNTFESVPSGDAIFVKWVLTCFTDEEVITLMRNCNKALPVGGKLICSEPTLPENSDESHRTRALLVADIFIMTTYRAKGKHRTEEEYRQLGLLAGFPKFRVIHVDYFFPV

SEQ ID NO: 29176 - protein, 214 aa, Zea mays
MAPAVEAVKETGSFQKVPALNERILSSMSRRSVAAHPWHDLEIGPGAPTIFNCVIEIPRGSKVKYELDKKTGLIKVDRVLYSSVVYPHNYGFIPRTLCEDSDPLDVLVIMQEPVIPGCFLRAKAIGLMPMIDQGEADDKIIAVCADDPEYRHYNDIKELPPHRLAEIRRFFEDYKKNENKEVAVNDFLPASAAYEAIQHSMDLYATYIVEGLRR

SEQ ID NO: 29177 - protein, 211 aa, Arabidopsis thaliana
LLRENKRMLDKSIREIERERQGLQTQEKKLINEIKKTAKQGQMGAVKVMAKDLIRTRHQIEKFYKLKSQLQGVSLRIQTLKSTQAMGEAMKGVTKAMGQMNRQMNLPSLQKIMQEFERQNEKMEMVSEVMGDAIDDALEGDEEEEETEDLVSQVLDEIGIDINQELVNAPSGAVAVPAAKNKVIQAEATGAEDSGGIDSDLQARLDNLRKM

SEQ ID NO: 29178 - protein, 553 aa, Mycobacterium tuberculosis H37Rv
MTSAPIPDITATPAWDALRRHHDQIGNTHLRQFFADDPGRGRELTVSVGDLYIDYSKHRVTRETLALLIDLARTAHLEERRDQMFAGVHINTSEDRAVLHTALRLPRDAELVVDGQDVVTDVHAVLDAMGAFTDRLRSGEWTGATGKRISTVVNIGIGGSDLGPVMVYQALRHYADAGISARFVSNVDPADLIATLADLDPATTLFIVASKTFSTLETLTNATAARRWLTDALGDAAVSRHFVAVSTNKRLVDDFGINTDNMFGFWDWVGGRYSVDSAIGLSLMTVIGRDAFADFLAGFHIIDRHFATAPLESNAPVLLGLIGLWYSNFFGAQSRTVLPYSNDLSRFPAYLQQLTMESNGKSTRADGSPVSADTGEIFWGEPGTNGQHAFYQLLHQGTRLVPADFIGFAQPLDDLPTAEGTGSMHDLLMSNFFAQTQVLAFGKTAEEIAADGTPAHVVAHKVMPGNRPSTSILASRLTPSVLGQLIALYEHQVFTEGVVWGIDSFDQWGVELGKTQAKALLPVITGAGSPPPQSDSSTDGLVRRYRTERGRAG

SEQ ID NO: 29179 - protein, 358 aa, Cryptococcus neoformans var. neoformans JEC21
MGGCMSSPTTGDPVAEARSKEIDRALKEDEKRMAKEVKLLLLGAGASGKSTILKQMRLIHDKPFESNEVEDYRKLTFSNIVGGMRAIIDVMDELGLAVQPENRRYISLVDAEPPINTNEPYPIKYLTALKSLWADQNVQECYKRGNEFALAENMPYFYADLDRLFAQDFKPSSDDILRVRSKTTGITETRFPIHDVVFRLFDVGGQRSERRKWASCFEDVTAILFLVALSDYNSCLIEDRESNGMQEALMLFDSICNSQWFTKSSIILFLNKADLLQAKIQDPSQQIQEYFPEFEGQPYSFQDAVDFFKIKFRSLNRTSKKEIYCHVTTAVDRQNVKVVMTACQDTILKNALRDMAIL

SEQ ID NO: 29180 - protein, 447 aa, Desulfotalea psychrophila LSv54
MKVTVFGVGYVGLVQAVALADCGHDVCCVDVDAAKIAGLQQGIIPIFEPGLQELVLKNCEVARLRFSTDAALGVDHATIQFIAVGTPPGEDGSADLQYVLGVAGTIASLMSDEKIIVNKSTVPVGTADKVRAHVQDLLTRRGQELPFQVLSNPEFLKEGSALEDCMRPERIIIGTESPQAETLMRELYEPFNRNRDKIMVMDVRSAEFTKYAANCLLATKISFMNEMSHLAERMEVDIEEVRRGIGSDSRIGYQFIYPGCGYGGSCFPKDVRALERSGREVGYHAQILQAVEQVNFQQKQKLYQHITCHYGDDIAGKTFALWGLSFKPNTDDMREASSRVLMERLWQAGARVRAYDPEAMDEALRLYGMRADLEIVASKDEAVVGADALVIVTEWKDFRVPDFSMLQEKLRDRVIFDGRNLYEPSRVEDAGLAYYGIGRGRSCRKKL

SEQ ID NO: 29181 - protein, 347 aa, Oryza sativa Japonica Group
MGIGRARWVALLVGLAAAAVVATLGASEGDADPLYRACVDECEKTGSLRETSVRHCQVPTDDHPADKSWYAHEPLYLQWKEWNCKSECRYHCMMERESEREQLGLGSVKYHGKWPMKRASVFQEPISAALSALSLLVQFNGWLSFFLLLSYKLPLRPETQMTYYEYTGLWHIYGLLAMNAWFWRAIYHSCDTVWTEKLYYSSFAAFIGYSLILAILRTLNLKDEASRVMVAAPILAFTTTHILYLNFYELDKGLNTKVCTAASLAQFLLWAVWAVMTKHPSCFKILFVIIGNVFSIVLETYDIPPRWGYVDGRVFCVAISIPLTYLWWKFAKEDAEMRTSTIIKKTR

SEQ ID NO: 29182 - protein, 426 aa, Physcomitrella patens subsp. patens
MVRRALLVGCNYPGEPCELKGSANDVDRMHVLLTKKFGFKPTEILVLVDIDPRSRQPTGANIRKSLRKLVDGAEPGDVLFFHFSGHGTQVPPDRGRRDETGYEECIVPSDMNLLTDDDFRELVDRIPPGCNFTFIADACHSGGLIDNEKEQIGDRYSMGEGGPLGGRPRPPLRPEAGGGGLTDLVAEGIEAFSGAGGGKQNSFMDAGVRYGGYLDSGDYGYSGKPHHTPLKNKSLPLNILTSILSQRTGRSVKPGNIYQNLYDLFGEDASPTVKVFVRILLNKLEGEDGGRSHGLLGKIGGLASSLLKTKIDNDPSGGYPEDRQGEELRRHRRRQRRNYDAGILISACEPHESSADANPTNDPRDAYGALSNAIQTVIGESRGYLTNRQVVMAARRLLNEQGYKQHPCLYCSDRNADAYFLQPMPM

SEQ ID NO: 29183 - protein, 318 aa, Gloeobacter violaceus PCC 7421
MAEQTVIITGASSGVGLHAADSLAQSGRWHVVMACRDKAKAQNAAASLGMRPQSYTIVHLDLASLASVRRFVQDFRALGQPLDALVCNAAVYTPTAREPRYTADGFELSVGTNHLGHFLLCNLLLEDLQNSPAAEPRLVILGTVTHNPKELGGSIPPRPDLGDLRGLEQGFKAPHTMIDGKAYNPVKAYKDSKVCNLLTMRELHRRFHTSHKITFSALYPGCVATSGLFRESPRLFQILFPVFQKYVTGGFVSEAEAGGRVAALVDDPAYSRSGVYWSWGNRQKKDGKSFIQDVSTEASDEDKARRLWDLSAGLVGLA

SEQ ID NO: 29184 - protein, 444 aa, Bacillus anthracis str. Ames
MHILVVSVNYRTAPVEFREKLTFQAAELERAMTTLQNQKSVLENVIVSTCNRTEIYAVVDQLHTGRYYIKKFLADWFQLEIEEVAPYLTIFEQDGAIDHLFRVTCGLDSMVVGETQILGQIKDSFLEAQQVKATGTIFNELFKQVITLAKRAHSETTIGESAMSVSYAAVELGKKIFGELTDCHVLILGAGKMGELALQNLYGSGARKVTVMNRTLSKAEIMAEKYMGHAKPLSELQCALLEADILISSTGASDYVITKEMMTKVEKMRSGRPLFMVDIAVPRDIDPAIDELEGSFLYDIDDLQGVVEANRAERLKEAEKIQFMIEEEIVLFKTWLSTLGVVPLISALRDKALAIQSETMESLERKIPNLSDRERKVISKHTKSIINQLLKDPILVAKEIAAEEGADEKLALFAKIFDLEMEDVESRAEEVEHKRVWTPSVPSL

SEQ ID NO: 29185 - protein, 198 aa, Bacillus anthracis str. Ames
MKVTKADIVISAVKPEQYPDGDLPEIALAGRSNVGKSSFINKILNRKKLVRISSKPGKTQTLNFFLINEMMHFVDVPGYGYAKVSKTERAAWGKMIETYFTTREQLDAAVLVVDLRHKPTNDDVMMYDFLKHYDIPTIIIATKADKIPKGKWQKHLKVVKETLDIESGDEVVLFSSETGLGKEEAWKAIHKFTKTKNA

SEQ ID NO: 29186 - protein, 490 aa, Comamonas testosteroni
MKQYRNYINGEWVESARRFDDVNPVDGTVVAQVHEADREAVDSAIRAGHAAVRGAWGRTTVAERAAILCRIADEIDRRYDDFLAAEIADTGKPVAMASTIDIPRGAANFRVFADILKTAPLDTFQTDLPDGARALNYAVRKPLGVVGVISPWNLPLLLLTWKIAPALACGNAVVAKPSEETPGTATLLAEVMHTVGVPPGVFNLVHGFGPDSAGEFITTNDDIDAITFTGESRTGSAIMRAAATHVKPVSFELGGKNAAIIFADCDFEKMIDGMMRAVFLHSGQVCLCAERVYVERPIYNRFLDAFVERVKALKLGWPQDGTTGMGPLISAEHRDKVLSYFKLAREEGAQVLVGGGVPKFGDARDAGFWVEPTIITGLPQTARCIKEEVFGPICHVSPFDTEAEAIALANDTKYGLSATTWTGNLNRGHRVSEAMRVGLSWVNSWFLRDLRTPFGGVGLSGIGREGGMHSLNFYSELTNVCVRIDQEAVS

SEQ ID NO: 29187 - protein, 278 aa, Bordetella petrii
MRPIRKAVFPVAGMGTRFLPATKAMPKEMLPVVDKPLIQYAVEEAVAAGITDLIFVTGRNKRAIEDHFDSAPELEADLESKGKHELLAMVRGILPAHVNCLYIRQAAPLGLGHAVLTAAPAVGNEPFAVLLADDLIDADTPVLKQLIDASYAHDASVLGVQDVPREDTRKYGIVAARPIDDRTARITHIVEKPAPEEAPSTLAVVGRYVLEPEIFDHLRATQIGAGNEIQLTDGIAALMGARPVLAHRYTGQRYDCGSKAGMFQATVALGRKYHGLVA

SEQ ID NO: 29188 - protein, 572 aa, Debaryomyces hansenii CBS767
MVLGSEKKLKPVISETRRGSSASGSECDNIPSVGVTKWDRFVDSFRRQHVQHGDEGKSLQKGISSRHLILMALVTGMGTGLFVGTGNILSTAGPLFLIVGYIIVGSFLYPTLQAAGELAVNYSELSGGYNNYPLKFIDESVAFAVTWIYCIEWLSTFALELVTASITIRYWDGDQKINPDVWVTIIFVIVVLLHFVGSKAYGEGEFVIGCLKVLMVTGFLIMSIVVNVGGGPEGKFIGGQYWHDPGYYTNFKGLCTVFVTGAFAFSQSEFVALSAAEQPNPRRAIPTACKLVFWRILILFLGSLIMVGLLVPMNSPELMGASGGGSNASPFVLAATLHGVTVVPHIINAVILLSVCSVASSSLYASSRTLQSLADQGYAPKYFNYIDRSGRPLRSLIACSIVGLFSYIAAYEKQETVFNWLLSISGLAQLFTWDVICISHIRFRQALKYNGISTDSLGYTSSTGIWGSVYAIVIHWLILIALFYTALFPVGSSTPDAQSFFQNYLGAIVLVFFYVCHKLWSRNWKFYVNICDIDINTDRTIFDEEILNLEKQEFQEKYNNDPWYKKLTTILL

SEQ ID NO: 29189 - protein, 278 aa, Silicibacter pomeroyi DSS-3
MTGEGHIVDMSDIARRGLVLLGCGKMGSAMLAGWLDGGLPAGSVWVIDPYPSDWVKAQGVHVNAELPGDPAIALIAVKPQMMGDALPQMQALGNGTTLFVSVAAGTSIATYEQILGADTPIVRAMPNTPAAIGRGITALIGNARASAADLDLAEALLKAVGQTVRLEREEQMDAVTGVSGSGPAYVFHLIETLAAAGTAQGLPADLAMQLAKATVAGAGALAEAAEEDPAQLRVNVTSPNGTTQAALEVLMEPETGFPGLLNRAVAAATNRSRELSRG

SEQ ID NO: 29190 - protein, 498 aa, Physcomitrella patens subsp. patens
MGNCCKKSSVAEESTADRKKKPRVRAAINGKDNKEMAPLGKRTNFGYGRDFKSKYTLGKLLGHGQFGYTYVAIEKSTGSRVAVKTIEKKQMTLPISVEDVKREVKILRTLSGHENVVQFYASFEDDDLVYIVMELCEGGELLDRILAKKDSRYSEKDAAKIVRQMLNVAARCHLNGVVHRDMKPENFLFKSTSEDSPLKATDFGLSDYIRPGNRFHDVVGSAYYVAPEVLKKKSGPESDVWSIGVITYILLCGRRPFWDKTEKGIFDEVLKKNPDYGEKPWPTISSSAKDFVKKLLVKDPAARLTAAQALSHPWAKEGGDALDIPLDISVLSNMREFVKYSRLKQLALRALASTLDSSDIADLQDQFNAIDIDRNGKITLEEMREMDSNSDGLVDFDEFVAATLHVHQLEETDSEKWQSRSQAAFSQFDFDGDGYITADELKIATGLNGSMDSILVEADIDGDGKISLSEFQKLLRQASLGSRTNEHHTLVTHNHRKC

SEQ ID NO: 29191 - protein, 247 aa, Synechococcus sp. WH 7803
MFNHIRADLAIIRERDPAARGPLEILLCYPGFQALSLHRLSHRLWHSRLPLKLAARLLSQLGRNLTGVEIHPGARIGHGVFIDHGMGVVIGETAEVGDRCLLYQGVTLGGTGKDHGKRHPTLANNVVIGAGAKVLGAIEVGTNTRIGAGSVVVRDVEADCTVVGIPGRVIHQSGVRINPLAHSALPDAEANVIRNLMERIDQLEGQVRSLQDNLRTMAAASGRPLREVRNGQAQNLKDREILEFLGD

SEQ ID NO: 29192 - protein, 476 aa, Bordetella petrii
MTDSTTPEAPSTDAPTSTFADFGLHPQLLQSVADTGYTTPTPIQAQALPAVMAGRDVMGAAQTGTGKTAAFTLPILHRLMPLANTSASPARHPVRTLILTPTRELADQVYESVKRYSKHTPLRSAVVFGGVDIGPQKEALRRGCEILVATPGRLLDHVEQKTVNLSQVGILVLDEADRMLDMGFLPDLDRIVRLLPAQRQGLLFSATFSNEIRKLGRTYLNQPVEIEVAARNATADTVSQIAYQMPSDAKRAAVVHLVKSRGLKQVIVFSNTKIGTARLARELERDGVRAESIHGDKSQADRMKALDAFKAGELEVLVATDVAARGLDVAGVPCVINYDLPHNAEDYVHRIGRTGRAGASGEAIALFTADETRYLQDIEKLTKRPVPRGTLDVPRDLVARSHTRDTRDGRDARGRGRERRGSSQAYGAPQQPVDDFFYKPYEPAAPAADQAEPKTESRSSTPKRQVAVLLGGSRKP

SEQ ID NO: 29193 - protein, 371 aa, Trichodesmium erythraeum IMS101
MTLELSYQSKLLSPYQSKLQGWPGLIEAYRSYLPVTEETPVVSLKEGNTPLIPVPAIADKIGRQVEVFVKYDGLNPTGSFKDRGMTLAISKAKEAGAKAVICASTGNTSAAAAAYALRGGMRAFVLIPDGYVALGKLAQALLYGAEVLAIKGNFDQALQIVKDVAKKYPVTLVNSVNPYRLEGQKTGAFELVDTLGDAPDWLCIPVGNAGNITAYWMGFCQYHKSKKCDRLPKMMGFQAAGAAPIVKGYPIAHPETVASAIRIGNPASWKKAIEAQKASQGSFTAVTDEEILEAYRLLASNEGIFCEPASAASVAGLLKIKDQVPRGAKIVCVLTGHGLKDPDVAIKHSHNDHFSQGIEPTTEAVAKIMGL

SEQ ID NO: 29194 - protein, 234 aa, Limonium latifolium
ETLLKAWPFLHTAILDASTEPFARVNGEPAYQYYGKNDELNKNMQYAMSGVSVPYMKALLGSGYDGFEGVKTLVDVGGSSGDCLRMIINKYKDIPKAINFDLPEVVAKAPKIPGITHVGGNMFESVPSGDAIFVKWVLTCFTDEEVITLMRNCNKALPVGGKLICSEPTLPENSDESHRTRALLVADIFIMTTYRAKGKHRTEEEYRQLGLLAGFPKFRVIHVDYFFPVVEFQK

SEQ ID NO: 29195 - protein, 248 aa, Ashbya gossypii ATCC 10895
MARTFFVGGNFKLNGSKQSIKEIVERLNTADLADNVEVVICPPATYLDHAVSLVSHPQVTVGAQNAYTKASGAYTGENSVDQIKDVGAKWVILGHSERRTYFNEDDEQVAEKTAFALERGVSVILCIGETLDEKKAGVTLDVVKRQLTPVLEKVKDWTNVVIAYEPVWAIGTGLAATAEDAQDIHAAIRDFLAERTSRDVADAVRILFGGSANGANAASFRDKADVDGFLVGGASLKPEFVDIINSRR

SEQ ID NO: 29196 - protein, 436 aa, Ashbya gossypii ATCC 10895
MLRSTLRVTSRAARPLAASMGRSSAVHAGAAAQAKLYSQIQMGAMHGPALQHLCGLRYASTSVQVPPMAESLTEGSLKEFTKQVGEYIEQDELLATIETDKIDIEVNAPVSGTVTKLNFKPEDTVTVGEELAQIEEGAAPAGGQKPAAKEETSAPQEAAPASPAAKEEKPQAAKPAQAAPAKEQPKQAAAQSSTVSAGASVSGFARTERRVKMNRMRMRIAERLKEAQNTAASLTTFNEVDMSALLEMRKLYKDEILKTKGVKFGFMGLFAKAVALAQKEVPAVTGGIEGDQLVYRDYTDISIAVATPKGLVTPVVRNVESLSVLEIEQEISRLGQKAREGKITLEDMAGGNFTISNGGVFGSLYGTPIINTPQTAVLGLHGVKERPVTVNGQIVSRPMMYLALTYDHRMLDGREGVTFLKTIKELIEDPRKMLLV

SEQ ID NO: 29197 - protein, 206 aa, Limonium latifolium
RAYQYYGKNDELNKNMQYAMSGVSVPYMKALLGSGYDGFEGVKTLVDVGGSSGDCLRMIINKYKDIPKAINFDLPEVVAKAPKIPGITHVGGNMFESVPSGDAIFVKWVLTCFTDEEVITLMRNCNKALPVGGKLICSEPTLPENSDESHRTRALLVADIFIMTTYRAKGKHRTEEEYRQLGLLAGFPKFRVIHVDYFFPVVEFQK

SEQ ID NO: 29198 - protein, 387 aa, Mycobacterium tuberculosis H37Rv
MDLFEYQAKELFAKHNVPSTPGRVTDTAEGAKAIATEIGRPVMVKAQVKIGGRGKAGGVKYAATPQDAYEHAKNILGLDIKGHIVKKLLVAEASDIAEEYYLSFLLDRANRTYLAMCSVEGGMEIEEVAATKPERLAKVPVNAVKGVDLDFARSIAEQGHLPAEVLDTAAVTIAKLWELFVAEDATLVEVNPLVRTPDHKILALDAKITLDGNADFRQPGHAEFEDRAATDPLELKAKEHDLNYVKLDGQVGIIGNGAGLVMSTLDVVAYAGEKHGGVKPANFLDIGGGASAEVMAAGLDVVLGDQQVKSVFVNVFGGITSCDAVATGIVKALGMLGDEANKPLVVRLDGNNVEEGRRILTEANHPLVTLVATMDEAADKAAELASA

SEQ ID NO: 29199 - protein, 188 aa, Limonium latifolium
HGTTRSRHGSSSSSSPTANGFEGVKTLVDVGGSSGDCLRMIINKYKDIPKAINFDLPEVVAKAPKIPGITHVGGNMFESVPSGDAIFVKWVLTCFTDEEVITLMRNCNKALPVGGKLICSEPTLPENSDESHRTRALLVADIFIMTTYRAKGKHRTEEEYRQLGLLAGFPKFRVIHVDYFFPVVEFQK

SEQ ID NO: 29200 - protein, 338 aa, Streptococcus agalactiae A909
MTKQKIAVLGPGSWGTALAQVLNDNGHEVRLWGNVVEQIEEINTNHTNQRYFKDITLDSKIKAYTNLEEAINNVDSILFVVPTKVTRLVAKQVANLLKHKVVIMHASKGLEPGTHERLSTILEEEISEQYRSDIVVVSGPSHAEEAIVRDITLITAASKDIEAAKYVQKLFSNHYFRLYTNTDVVGVETAGALKNIIAVGAGALHGLGYGDNAKAAIITRGLAEITRLGVQLGADPLTFSGLSGVGDLIVTGTSVHSRNWRAGDALGRGEKLEDIEKNMGMVIEGISTTKVAYEIAQNLNVYMPITEAIYKSIYEGANIKDSILDMMSNEFRSENEWH

SEQ ID NO: 29201 - protein, 386 aa, Clostridium perfringens SM101
MNKIYFDNAATTFPKPDSVIKAMFDYMSFEGGSANRGSSSTALQSSRAVYECRYEIAKFFNFPKSENVIFTNNITTSLNMLLLGIIKSDWHIITTSMEHNSVLRPLVKISEELPNVELDIVQCNNEGLVSVEKIKEKIKNNTKLIILSHASNLVGTIQPIKEIGKLCKENDIFFILDSAQTAGVIPIDMTELNLNALAFTGHKSLLGPQGIGGFIIDDKLNSICKNIFSGGTGSNSSLIEHPQELPDKFEYGTLNTPGIIGLLEGIKFIEKEGIENIKAKEEVLCQKAMDLLCEIPEVKIYGPMDAKKKTSTISFNIEGMDPEFTGFLLDSEFNITCRTGIHCTPLAHKTVGSYPAGSIRISLGYFNTIEEVYRFVEVIKELISRR

SEQ ID NO: 29202 - protein, 375 aa, Limonium latifolium
MANHSSAAAMVVDETSEARNNARLKIIELANLISVPMSLTAIVRLKVPEAIWSNGSNTPVSAAEILSRLPDAPATADAENLQRLLRVLTSFGVFSEHLDTTSSSSSSTSERRYCLTEVGQTLVSFDESCPSHGAYVLQHHQETLLKAWPFLHTAILDASTEPFARVNGEPAYQYYGKNDELNKNMQYAMSGVSVPYMKALLGSGYDGFEGVKTLVDVGGSSGDCLRMIINKYKDIPKAINFDLPEVVAKAPKIPGITHVGGNMFESVPSGDAIFVKWVLTCFTDEEVITLMRNCNKALPVGGKLICSEPTLPENSDESHRTRALLVADIFIMTTYRAKGKHRTEEEYRQLGLLAGFPKFRVIHVDYFFPVVEFQK

SEQ ID NO: 29203 - protein, 415 aa, Mannheimia succiniciproducens MBEL55E
MQSKVKIPQGDKIQLADNGALIVPHNPIIPFIEGDGIGVDVTPAMKAVIDAAVEKAYGGTRKISWMEIYAGGKANQVYGENTWLPAETLELIRQYHVAIKGPLMTPVGGGIRSLNVAMRQGLDLYNCLRPIRYYEGTPSPVKHPEFVNMVIFRENSEDIYAGVEWVAGSPGADKLINFLQREMGVTKIRFTEDCGIGIKPVSKQGSQRLVRAALQYVIDNDRSSLTLVHKGNIMKFTEGAFKEWGYQVAKEFGAELIDQGPWMKLKNPNTGTEIIIKDCIADAFLQEVLLHPKDYDVIATLNLNGDYISDALAAQVGGIGISPGANIGDDAAIFEATHGTAPKIAGQNKGNPGSLILSGEMMLRHLGWLEAADLVVNAVAKTIADKTVTFDFAEMLEGATLRSTSEFAEDIIANM

SEQ ID NO: 29204 - protein, 288 aa, Desulfotalea psychrophila LSv54
MRVKKAIFPVAGLGTRFLPATKAMPKEMLPVVDKPLIQYAVEEALASGIEQLIFVTGSGKSALENHFDSSYQLEDTLRKRGKDELLRTVESLVPASGSIIYTRQSQPLGLGHAIWCARDVVGDEPFAVLLADDLIKSEKPVLQQMIHQFDRLRASMVATIEVPREETNRYGILEGETVYDGILQISSMVEKPKPEDAPSNLAAIGRYIFTPRIFDFLGKQQTGAGGEIQVTDAMVALLAEQPIFGVGFEGTRFDCGDKVGFQKANIAFALEHPEIGGPLREYLQGLEL

SEQ ID NO: 29205 - protein, 238 aa, Zea mays
MRAVVVDWLVVLAEEFELHAETLHLAVSYVDRFLTMNVVARDKLQLLAVTALLVAAKYEEIESAEMKVNIYINSMDNTYTKQQVVKMEADLLKSLNFQIGGPTVTTFLRQFIASCRGGNSTSREKLEFVCSYLADLSLLDYDCISYLPSVVAAACLFVARFTIHPKTRPWNLTLEQNTGYKVFDLQKSIYVIHELQLTIRCPDQEATRKKYKDPKFGCVSTMVSPREIPTSFPEDCHK

SEQ ID NO: 29206 - protein, 403 aa, Cryptococcus neoformans var. neoformans JEC21
MSQGHKHLHRRRASSVTVALDQIPLNHNRQSSPESAVKPLPGRRRPTEGDRYRSKGLWSDIKTGRWLLAPASSFKLSLIAPSLYLLHHLLSTYGIINHSQVPNVFEHFILPSNKLEDGRYGKSWWDFAFLAHYVIFCTFVRQFMTTRVLRPMARALGVKGQKIVRFTEQGYAIFYFGILGVYGLYVMRDLPIWWFKTEHFWLEYPHREMTSHLKTYYLLQASYWLQQTIIMIAKIEKPRKDYKELVAHHIVTLWLIGWSYTVYLTYIGVAIFITMDVSDLFLGLAKCVNYVSEFYSVPLFAWFTIVWTYMRHYLNIVILHSVWTQFDLIPFPDRTTFDPWNDRWIDWWMKWQIFIPIFLLQLLNLVWYFLILRILARAVFLNDRKDERSDDEDDVEGDEAKEE

SEQ ID NO: 29207 - protein, 383 aa, Cryptococcus neoformans var. neoformans JEC21
MVFGLLCRWACNICSYLYPAYASYKALSIHPESSPEAMAQVERWLMYWAVVGTWTAVEAIIGWTITWMPFYSLIKTFVFLSLSLPQFEASTYIYRSHLSPFFQEHEQDIDAFLASSRSRAGFALVESVGWIWQKAKVQLNITLPDEQLQAAAMLAQNQGQGRPNEGGYPAQDVHQPPTLSDPASGALQTALHFVSNYAGRYMPVALTALSAAAASAKGQAGESQGGASSSITPQSRATQMPQQMTMPVPVPTPPVHQQQSDPSLRSRAFMHASSNNSAGQYPSLNNLKQQQQYQALSSARSPPQGFSGRSASGPAGPARMSQSSSRSSDESLGSRYEGYEQIGKDELQEMNNSRSRMQGKKNWFGWGGPAGMNDDRDDRDKID

SEQ ID NO: 29208 - protein, 342 aa, Desulfotalea psychrophila LSv54
MGALNILVTGGAGYIGSHTCLELLEAGYEVTVVDDLSNSCYEALARVETLTEKKITFHQVNVLDQQALDAVFVSSKKPFAAVIHFAGLKAVGESVAEPLRYYHNNVTGTLVLCDLMAKHGLKNIIFSSSATVYGDPATVPITEDFPLSCTNPYGRTKLMVEEILADLHGADHEWNACLLRYFNPVGAHKSGRIGEDPNGIPNNLMPYIAQVAIGRLDYLSVFGNDYPTVDGTGVRDYIHVVDLAKGHVCAVKKILEGRGITTYNLGTGHGCSVLEMASAFSRACGHDVAYKIVARRAGDVAVYCADATKALDELGWSTSLGLEDMCEDTWRWQKNNPTGYRQ

SEQ ID NO: 29209 - protein, 436 aa, Gloeobacter violaceus PCC 7421
MTVPLSELAREKGIRYFLISFTDLFGTQRAKLVPTQAIDAIAASGAGFAGFAAWMDMSPADPDMFAHPDAGSVFQLPWQPEVAWMPADLFTPEGTAIAQTPRLVLKRVLKLALELGYRVRTGVECEYFLLAADEVQIADSRDFQSKPCYDQQALMRRYAVISEICDAMNALGWGAYQNDHEDANGQFEMNWTYADALVTADRHAFFKYMVKTVAEKHSLRATFMPKPFMHLTGNGCHTHLSVWDSEGKVNRFDDPRGELGLSPLAYHFIGGVQHSAEALCAFANPTVNSYKRINAPITASGATWSPNTISYSGNNRTHAIRIPEPGRFELRLADGAANPYLLPAALTAVGLDGIAHQRDAGPRRDNNSYTNPLPPESAKPLPANLLDALRALESDTVLSEAMGADFVASYLKLKHREWQDYCARVTPWELEHTLDC

SEQ ID NO: 29210 - protein, 343 aa, Neurospora crassa
MATTAMDYENANGDRFDEDAPRYDRDRSASPRRDDGHDSSRRRSMSPNGNDRAPAKDEGQSKGGEEDGARNPGSNLFVTGIHPRLEEAEVTRLFEKYGEVEKCQIMKDPHTGESRGFGFVKMMTPEQANAAKEGLQGEVIEGRTLSIEMARRARPRTPTPGKYFGPPKRGEGRFDDRNGRRGGGFGGGYGGGRDDSYRGYRGGGYRDDRGYDRGYDRGYDRSGGYGGGDRGYERNSYREDRGYDRSYRGEDRGYDRRERGGADEAYGRGGDRYRDDRGGERYGGSGRGGPDERRAPGYDRDRGYDRPSDRDARPPRDAAPGTSSYGEPAPREAREPYGTYSNV

SEQ ID NO: 29211 - protein, 289 aa, Arabidopsis thaliana
MTKDELTEEESLSGKDYLDPPPVKTFEVRELKKWSFYRAVIAEFIATLLFLYVTVLTVIGFKSQTDINAGGGACASVGLLGISWAFGGMIFILVYCTAGISGGHINPAVTFGLFLASKVSLVRAVSYMVAQCLGATCGVGLVKVFQSTYYNRYGGGANMLSDGYNVGVGVGAEIIGTFVLVYTVFSATDPKRNARDSHIPVLAPLPIGFSVFMVHLATIPITGTGINPARSFGAAVIYNNQKAWDDQWIFWVGPFVGAAIAAFYHQFVLRAGAMKAYGSVRSQLHELHA

SEQ ID NO: 29212 - protein, 167 aa, Bacillus sp. AH 546
FKEYIDPAVGLQGFQARRIAFNIHIPKELVGQAVKFMMGLYRAFIEKDCSIAEINPLVTTGEGKVMALDAKLNFDSNALYRHKDILELRDLDEEDSKEIEASKYDLNYIPLDGNIGCMVNGAGLAMATMDIIKHYHGDPANFLDVGGGATAEKVTEAFKIILSDKNV

SEQ ID NO: 29213 - protein, 167 aa, Bacillus sp. AH 547
FKEYIDPAVGLRGFQARRIAFNINIPKELVGQAVKFMMGLYSAFIEKDCSIAEINPLVTTGDGKVMALDAKLNFDSNALYRNKDILELRDLEEEDSKEIEASKYDLNYIPLDGNIGCMVNGAGLAMATMDIIKHYHGDPANFLDVGGGATAEKVTEAFKIILSDKNV

SEQ ID NO: 29214 - protein, 523 aa, Magnaporthe grisea 70-15
MFLQRGSRHLLRQLPKGVIAIPTTPTVTTTVSARSRQQPTQQRQQQRHCRTTRGFHSTRRLLDVKPVLLADIGEGIVECEIIQWFVEPGARVEEFSPLCEVQSDKASVEITSRFSGVVKKLYYDAGEMAKVGKPFVDIDITGDLEAEPEKVLAGDVAPAKPVEEKTTQKAVETAPDMIGTPASVGGAERKRGKCAALATPAVRHLSKELKVDINEIDGTGRDGRVLKEDIYKFVQGKQSGSGVAPTIPAAPAAPAPQAASKVPPTPAPLPSQPGTPQTEEVMQLSHTQQMMFKTMTRSLTIPHFLYADEIDFTSLVELRTRLNRVLAAGGTGGPGTAEISKLSYLPFIIKAVSLALYQYPILNARVDIPSDGGKPSLAMRKQHNIGVAMDTPSGLLVPVVKNVNERNVLSIAAELVRLQSLATAGKLSPADMSGGTMTVSNIGSIGGTYLSPVVVEREVAILGVGRMRTVPAFDENDKVVKKHVCNFSWCADHRVVDGATLARAANMVRQVVEEPDVMVMHLR

SEQ ID NO: 29215 - protein, 527 aa, Burkholderia sp. 383
MSAGPAGLTHDVPAAPFERNATMSDSVAKPVDATFDQFGLAADILKAIAEQGYTTPTPIQAQAIPVVLAGRDVMGAAQTGTGKTASFSLPIIQRLLPQANTSASPARHPVRALILTPTRELADQVAANVHAYAKHTPLRSAVVFGGVDMNPQMAELRRGVEVLIATPGRLLDHVQQKTANLGQVQILVLDEADRMLDMGFLPDLQRILNLLPKERQTLLFSATFSGEIKKLASTYLRNPQTIEVARSNSTNANVTQIVYDVAEGDKQAAVVQLLRDRGLKQVIVFCNSKIGASRLARNLERDGVVASAIHGDKTQIERMQALDAFKRGEIEALVATDVAARGLDIAELPAVINFDLPFSAEDYVHRIGRTGRAGATGDALSLCSPNERKQLADIEKLIKRPLEMQTLALDKPARHRHDERGNDRGGDRNSERGGERGGERGGERGGRRDRDEHRGASAGRRPGGSERGHHRRHEAPVDDFFLKPYEPSAPAKQQDDAQPAQQPEKKGPKRQVAALLGGFGMPRKPSA

SEQ ID NO: 29216 - protein, 496 aa, Saccharomyces cerevisiae
MSMSNIVVFGGDSHPELVTKICENLDIHPSKVELGKFSNGETNIALRESVREKDVYIIQSGCGQVNDTFMQLLILISACKSASASRVTAVMPYLCYSRQPDIPYTAKGAPIISKPKENYTFESHPGTPVSSSLMTQRPGAESSLKSLDSAIRSTINLENPQPIRTPNSSATANNNFDIKKTLSFSRIPMIPGGKLQNTSNSTDAGELFNAQNAGYKLWVVQAGTLIAHLLSAAGADHVITMDLHDPQFPGFFDIPVDNLYCKPIAQNYIQHRIPDYQDAVIVSPDAGGAKRATAIADALELSFALIHKERRSQLLKGPPDATLTSGGSLPVSPRPLVTTLVSSQNTTSSGATGVAALEMKKTTSTSSTSSQSSNSSKFVQTTMLVGDVRNKVCIIVDDLVDTSYTITRAAKLLKDQGSTKVYALITHGVFSGDALERIGQSSIDKLIISNTVPQDRTLQYLGKDRVDVIDVSCIIGEAIRRIHNGESISMLFEHGW

SEQ ID NO: 29217 - protein, 435 aa, Vitis vinifera
  misc_feature (210)..(210): Xaa can be any naturally occurring amino acid
  misc_feature (235)..(235): Xaa can be any naturally occurring amino acid
  misc_feature (237)..(237): Xaa can be any naturally occurring amino acid
MPKLMLVVSAELKNIVILQPQDGSDDETINYFFKLKCEYCGWISHNNACVSISIKEKPTGNRRNDNLNLSRKCQGCERHGEISLIPGHGTPLSQNHCTEVDLMLFHCDGLLPVEYSFNGGWLATTISGREIHVDLTMGEYTDVIDGVEGMCTEVRLRGTGVVRRNANQKECRSPDCNDKCTCILKCGDVEKAWRIFDGVSCKKLPSWNAXISEYAQCGLLEEAIDLYCLMKAQSXKXNEIMLGHWNLGEKFICTLNGLELNVILATTLVDVYAKCGKIDDACLVFVKTSEKDVALWNAMILGLAYHGDMERTGVQPNDVTFIGVLSACNHSGLVEEGRVQFSSMADKHGLSPKLEHCACMLDLLGRAGHLKEAYELVQNMDPNLCILLSNFYVSAGRWKDVARVRRQEIYSTYEILIDHLKAEGYVLNSGFSWRY

SEQ ID NO: 29218 - protein, 399 aa, Acidobacteria bacterium Ellin345
MSSATSQLTLSPAARMNRIEISATLAVVNEAEKLRSAGVDLVDFGAGEPHFGTPQHIREAAIAAIHNNFSKYTAVAGTAELRDAIAKRHATDFATDYKREEVIASVGGKHALFNAIQVLVDHGDEVIIPVPYWVSFKDMVQYSGGKPVFVEADESQNFRLTAAMVEKAVTPKTKLIILNSPSNPSGAVMAPEDMKSIARFAYERGIWVISDECYVYLNYTGEEFSLGSLTEVKERLLVVGSLSKTYAMTGWRLGYTLAPAAVVSQMQKLQSQSTSNPTSIVQKAAVAALNGPQECVAEMRADYIKLRDEIVSGLRSIPGVKCTMPQGAFYAYPDISCAFGKAGMNSAADVAKKLLHEAHVVSVPGEAFGTTKHIRLSYAASHENVARGLERMHKFFASL

SEQ ID NO: 29219 - protein, 303 aa, Saccharomyces cerevisiae
MTVTDTFKLFILRHGQSELNSENIFCGWIDAQLTEKGKSQARHSAKLIKQFCDSNNISLPQIGYTSRLIRTQQTMDVILEELGLKHTNYVITTNTNIKEELQDTRFEGSMPVLQTWRLNERHYGAWQGQRKPDILKEYGKEKYMYIRRDYNGKPPKVNLNLEMVQEENDQGSSTGYDFKEPNRHLKYGPEEKANERLPESESLCEVVVRLKPFLNNVVLSTANKISQESCVIVGHGSSVRSLLKVLEGISDEDIKDVDIPNGIPLVIELDRDNYSFVRKFYLDPESAKVNAQMVRDEGFEKNP

SEQ ID NO: 29220 - protein, 103 aa, Prymnesium parvum
STRRRANALLLKVNQIGSVSESIEAVNMAKAAGWGVMTSHRSGETEDSFIADLAVGLKTGQIKTGAPCRSERLSKYNQLLRIEEELGKSAIYAGQSFRMPPAE

SEQ ID NO: 29221 - protein, 316 aa, Paracoccidioides brasiliensis
MAEQLVHRGTLEGHNGWVTSLATSLENPNMLLSASRDKTLIIWNLTRDDTAYGYPKRSLHGHSHIVSDCVISSDGAYALSSSWDKTLRLWELATGNTTRTFVGHTNDVLSVSFSADNRQIVSGSRDRTIKLWNTLGDCKFTITDKGHTEWVSCVRFSPNPQNPVIVSAGWDKLVKVWELSSCRIQTDHIGHTGYINTVTISPDGSLCASGGKDGTTMLWDLNESKHLYSLQAGDEIHALVFSPNRYWLCAATSSSITIFDLEKKSKVDELKPEYVEKGKKSREPECISLAWSADGQTLFAGYTDNKIRAWGVMART

SEQ ID NO: 29222 - protein, 174 aa, Paracoccidioides brasiliensis
MATLKGLGVSEIHDGSTLRIAIVHARWNDTIIAALVEGAKKALLAAGVRGSNIVVQSVPGSWELPIAQYRIYAGSQSEQPFDAMIAIGTLIKGETMHFEYIADAVSHGLMRIQLDKDVPVIFGVLTVLNEEQALVRAGLAKGEGSAGHNHGEDWGRAAVELGVKRKQWAMGKFS

SEQ ID NO: 29223 - protein, 419 aa, Physcomitrella patens subsp. patens
MTRISEGREFCFCLAAARPWKTSDCRLVLEDGSIWRGKSFGATGTQVGEVVFNTSLTGYQEILTDPSYSGQFVLMTQPHIGNTGINLDDEESGQCFTGGLIIRSLSNIVSNWRSSEELPEYLRKRNVMGISDIDTRAITRRLREEGSLIGVLTTDKSKTDDELMEMAKTWKIVGKDLISDASCTEPYEWKDKTDSEWEFSPNVPDADDTKFHVVAYDFGVKQNILRRLTSYGCKITVVPSTYPASKVLDLNPDGILFSNGPGDPSAVPYAVKSVQDLVGKVPVFGICMGHQLLGQALGGTTFKMKFGHHGGNHPVRHLPTGRVEISAQVIVMIQKLTRSLFNDFVCAQNHNYAVDPDTLPEGVEVTHINLNDGTCAGLVFPAMKAMSIQYHPEASPGPHDSDQAFFDFVEMMRKNKSQS

SEQ ID NO: 29224 - protein, 447 aa, Methanocaldococcus jannaschii DSM 2661
MVGMMRKTKILVTLGPSLENKLDKAINLIDGVRFNMSHATTDYCEKFLNILEKNNIAKVMDLKGIKIRIKEVKLKNKILKMGEKVVIGEDIKLNYNIDTIEEGHFILINDGKIKLRVVEKTDKIIAVVEVGGEIKEGMGVNLPDTRIELPIIDETDLKNIKFAVEKDFEYIALSFVRNKEDVKELKDIISEYKGDCEVISKIETKEGLKNIKEIARESDGVMVARGDLGVEVPIENIPIEQKNILRIANRYGILSITATQILDSMINNPFPTRAEVTDIANAIYDGTDCLMLSNETTIGKYPIEAIKVLNKVAKVADEHYEEFGDRVCLEVESIDEGLVYAVYELYKKLNTKLVITPTYSGRTAKLISKLRINSKIIAPTPNIRTLKRLRLVWGVESCLMEEFDDMEKIINTCREMAKKEIGKGIYLITLGHPIGQKKTNTIKVESI

SEQ ID NO: 29225 - protein, 172 aa, Streptococcus agalactiae A909
MDLNNYIASIENYPQEGITFRDISPLMADGKAYSYAVREIVQYAADKDIDMIVGPEARGFIVGCPVAYALGIGFAPVRKPGKLPREVISANYEKEYGLDTLTMHADAIKPGQRVLIVDDLLATGGTVKATIEMIEKLGGVVAGCAFLVELDGLNGRKAIEGYDTKVLMNFPG

SEQ ID NO: 29226 - protein, 251 aa, Prototheca wickerhamii
VVNLQIWNLVDMQREVLASPAGASRTVAAGPCLRAPFCHARKPGKFAHHGTRRAAPVSSMGIGFHPTYEPTSEPEGLSFCPEFGLTTAQMQVLGLAQPDASPTFDPTTLTAKAFYVGDAVTESSRQSTRMAQDTRAPGRAPPDLPSLLLDGRICYIGMPLVPAVTELVISELLWLNYSSPTKPVYVYINSTGSQREGGESVGFETEATAIMDTMAYIRPDIYTLVIGQACGNAAMLLASGKKGHRFALPHS

SEQ ID NO: 29227 - protein, 240 aa, Prototheca wickerhamii
VLALAECSGDRQRTGASRCCCWEREAWARVATVNSLLGERAAVVSSFQATGLGVHMHTRTLPGGFALNLIDTPSLLDQDSVSTSRLEQIGSAIKGVKIDAVLFLDRLDVYSTDTLDEQVVDGVTAYFGEDMWDHAVLGLTRATSSAPPLSTDFGEWVVERSLQLQSLIAKARAQYAPRRRRGEAPPLTPAGCRESQECPRKLRGSGSSPATAPGSPTCMPRWRSAATGAGQAWLHDAARR

SEQ ID NO: 29228 - protein, 437 aa, Gloeobacter violaceus PCC 7421
MATAFSALGLSESVVKALDELGFEQPTPIQLKSIPFLLDGRDLLAQAQTGTGKTAAFGLPLVDRSDPQDARVQALVLAPTRELAVQVCEAIHTYSKHSGVRVLPIYGGQPIDRQMRRLRAGAQIVVGTPGRVLDLMRRGSLDLSALRTLVLDEADQMLDMGFIEEVQTILDAAPPERQLVFFSATLPASIRKLAARHLRTPMTLTMPAEERDTPAIAQRVYFVNFKNRAQALTRVLAAEDPASALIFTRTKQAADELAEQLQDDGHRAEALHGDLNQSAREAVLGRFRRQQLNVVVATDVAARGLDIADLSHVINYDMPQDGESYIHRIGRTGRAGRTGVAISFALPTDRYRLRLIERATGSTLVPAKIPSAGEIQVRRTERLVEQLRRQLQADESDPSLVLYREVVGQLREEFDLGDIAATFLKLAQQRPGSTGSG

SEQ ID NO: 29229 - protein, 520 aa, Trametes versicolor
MSRFHSLLAFVVASLTAVAHAGIGPVADLTITNAAVSPDGFSRQAVVVNGGTPGPLITGNMGDRFQLNVIDNLTNHTMLKSTSIHWHGFFQKGTNWADGPAFINQCPISSGHSFLYDFQVPDQAGTFWYHSHLSTQYCDGLRGPFVVYDPNDPAADLYDVDNDDTVITLVDWYHVAANVGPAFPLGADATLINGKGRSPSTTTADLSVISVTPGKRYRFRLVSLSCDPNYTFSIDGHNMTIIETDSINTAPLVVDSIQIFAAQRYSFVLEANQAVDNYWIRANPNFGNVGFTGGINSAILRYDGAAAVEPTTTQTTSTEPLNEVNLHPLVATAVPGSPVAGGVDLAINMAFNFNGTNFFINGASFTPPTVPVLLQIISGAQNAQDLLPSGSVYSLPSNADIEISFPATAAAPGAPHPFHLHGHAFAVVRSAGSTVYNYDNPIFRDVVSTGTPAAGDNVTIRFRTDNPGPWFLHCHIDFHLEAGFAVVFAEDIPDVASANPVPQAWSDLCPTYDALDPSDQ

SEQ ID NO: 29230 - protein, 360 aa, Mycobacterium sp. JLS
MATEDPLRLGVVAGDGIGPEIVSAAVQISERALAAVSVPVDWRRLRMGAEAITAEGTPLPEATLAELDRLDAWLLGPHDNAGYPAPFRDALSPGGTIRKRYGLYANIRPARRLSGAIPAVCPTLDVVVVRENTEGFYSDRNMYDGPGEFMPTADVAMAVAVFTREACERIAHQAFRLARTRRRSVTVAHKANVLSKTTGLFRDSCVRVAEQYPDVTVRLEHIDALAALLVARPAEFDVIVAENMFGDILSDLTGQLAGSLGMAPSVNLSDTKAMAQAAHGSAPDIAGRNIANPVAMILSTAMLLEWLAERHHRGALADAATRIRDAVCRSLDDGVHTPDLGGAATTTGFTEHVLSVLASA

SEQ ID NO: 29231 - protein, 350 aa, Mycobacterium sp. JLS
MSAHRIAVIPGDGIGTEVTASARTVLDAVAARHGIDLSYEEFDWSCRRFERDGAMMPADGLETLSGFDAILLGAVGWPGVPDHVSLWGLLIPIRRAFRQYVNLRPIRVFDGVASPLRDATDVDFVVVRENVEGEYSEIGGRINRGFPDEMAVQESVFTRVGVTRIADYAFDLAETRRRYVTSATKSNGIVHTLPFWDEVVAERAANHPGVRFDSEHIDALAAKFVLQPGRFDVVVGSNLFGDILSDLAAAVAGSIGIAPSANLDPTKQNPSMFEPVHGSAPDIAGRGVANPIGAVWSAALMLEHLGHASAAADVMTAVERTLAQPQTRTADLGGHASTAEVTDALAAQLR

SEQ ID NO: 29232 - protein, 320 aa, Rhodococcus sp. RHA1
MSKRRSDLHPEVEAMLSSLEVFPDVTQHRAADLRDMIVSRRLPLTRQPEMRKVDDLVIEGPGGALALRVYAPYRDESVLPVVVFAHGGGFVFCDLDSHDEFCRSMADAVGVVVVAVDYRLAPEHPGPAAMEDVYCALNWAAENISAYGGDPEQIAVAGDSAGGNLAATVSLAARDRGGPKIVAQILLYPVIDDDFSTESYELYGEGYYNTTRAMRWYWKQYAPHGTDDPYLVPSKADSLAGLPAAVVATAELDPPCAAGEMYAKQLAAADVPVTEYRFDGLFHGFLTFPALSLTGPARARLWRMMREVLTLPAASNYRSH

SEQ ID NO: 29233 - protein, 460 aa, Bacteroides thetaiotaomicron VPI-5482
MKSYNKKFVYSICLVSAMGGLLFGYDWVVIGGAKPFYELYFGIADSPTMQGLAMSVALLGCLIGAMVAGMMADRYGRKPLLLISAFIFLSSAYATGAFSVFSWFLAARFLGGIGIGIASGLSPMYIAEVAPTSIRGKLVSLNQLTIVLGILGAQIANWLIAEPIPADFTPADICASWNGQMGWRWMFWGAAFPAAVFLLLACFIPESPRWLAMKGKREKAWSVLSRIGGNRYAEQELQMVEQTSASKSEGGLKLLFSRPFRKVLVLGVIVAVFQQWCGTNVIFNYAQEIFQSAGYSLGDVLFNIVVTGVANVIFTFVAIYTVERLGRRALMLLGAGGLAGIYLVLGTCYFFQVSGFFMVVLVVLAIACYAMSLGPITWVLLAEIFPNRVRGVAMATCTFALWVGSFTLTYTFPLLNTALGSYGTFWIYSAICVFGFLFFLRALPETKGKSLETLEKDLIK

SEQ ID NO: 29234 - protein, 798 aa, Bacillus sp. D6
MGKRLPKIFINLMVLSLIISMFAFGASANGGKQVEVKELPLAELFGEIELSSSKPTTVIVELQAESIVEAKHKGKSQSKGKLKAERDKVISSLQGKVSNAKVNREYDHVFSGFSVELPANEIIQLLATPGVKAVYPNVHYTADVISAEEISAETFSPAMMESAPFIGSNDAWDAGFTGEGVTVAIIDTGVDYTHPDLAHAFGDYKGFDFVDDDNDPQEGPGQYHGTHVAGTVAANGGNKGVAPEASLIAYRVLGPNGGTTEDVVASVELAVQDGVDVMNLSLGNTLNNPDWATSIALDWAMAEGVVAGTSNGNAGPNNWTVGSPGTSRDAISVGATQLPYNVYTSVISTSEGVSYPSAKVMGFPSDEELLALNEGEYEFVYVGLGAVSDFEGKDLDGKIALISRGEFAFVDKATNAKNAGAVGAIIFNNVAGEQPDVPGMAVPTIKTTLADGQKLLAELEAGNNTVSFNIEFDKAVGETMADFSSRGPVTLTWMIKPDVSAPGVNIVSTFPGEGYAALQGTSMASPHVAGAAALLLQAHPNWGTEDVKAALMNTAEDMINPATGKVYPHNTQGAGSIRVLDAINTKTLVAPGSHSFGKFVKESGKQVERQSFEIKNLSKERKRYSFDVQFDGNPTGIKVMTSNNLQVQPGKTQQVNFNVQVDTSKLEPGYYEGTITVSDGTQSIEVPTILFVGEPDYPRVTGAFMGKEADGSYYVGSYLPGGAEVIEYDIYVLGPGNTIGGFVDTIGSFENVSAPIHEFNWDGTVQNGIDLANGDWVLGVYVEKAGVTEYKAYLVTKN

SEQ ID NO: 29235 - protein, 798 aa, Bacillus sp. SD521
MGKRLPKIFINLMVLSLIISMFAFGASANGGKQVEVKELPLAELFGEIELSSSKPTTVIVELQAESIVEAKHKGKSQSKGKLKAERDKVISSLQGKVSNAQVNREYDHVFSGFSVELPANEIIQLLATPGVKAVYPNVHYTADVISAEEISAEAFSPEMMESAPFIGSDLAWDAGFTGEGVTVAIIDTGVDYTHPDLAHAFGDYKGFDFVDDDNDPQEGPGQYHGTHVAGTVAANGGIKGVAPEASLIAYRVLGPNGGTTEDVVASVELAVQDGVDVMNLSLGNTLNNPDWATSIALDWAMAEGVVAVTSNGNAGPNNWTVGSPGTSRDAISVGATQLPYNVYTSVISTSEGVSYPSAKVMGFPSDEELLSLNDGEYEFVFVGLGAEEDFEEKDLEGKIALISRGEFAFVDKATNAKNAGAVGAIIFNNVAGEQPDVPGMAVPTIKTTLADGQKLLAELEAGNNTVSFDIEFDKAVGETMADFSSRGPVTLTWMIKPDVSAPGVNIVSTFPGEGYAALQGTSMASPHVAGAAALLLQAHPNWGTEDVKAALMNTAEDMINPATGKVYPHNTQGAGSIRVLDAINTKTLVAPGSHSFGKFVKESGKQVERQSFEIKNLSKERKRYSFDVQFDGNPTGIKVMTSNNLQVQPGKTQQVNFNVQVDTSKLEPGYYEGPITVSDGTQSIEVPTILFVGEPDYPRVTGAFMGKEADGSYYVGSYLPGGAEVIEYDIYVLGPGNTIGGFVDTIGSFENVSAPIHEFNWDGTVQNGIDLPNGDWVLGVYVEKAGVTEYKAYLVTKN

SEQ ID NO: 29236 - protein, 210 aa, Silicibacter sp. TM1040
MIDPTETYMNTLVPMVVEQTSRGERAYDIFSRLLKERIIFLNGPVHDGMSSLIVAQLLHLEAENPSKEISMYINSPGGVVTSGLSIYDTMQYIKPKVSTLVIGQAASMGSLLLTAGEAGMRFSLPNSRVMVHQPSGGYQGQATDIMIHAEETLKLKRRLNEIYVKHTGQDYDTIEKALERDNFMSPEQAKEFGLIDEIVENRSKADDAES

SEQ ID NO: 29237 - protein, 347 aa, Sulfolobus solfataricus
  misc_feature (1)..(1): Xaa can be any naturally occurring amino acid
  misc_feature (44)..(44): Xaa can be any naturally occurring amino acid
  misc_feature (138)..(138): Xaa can be any naturally occurring amino acid
  misc_feature (186)..(186): Xaa can be any naturally occurring amino acid
  misc_feature (269)..(269): Xaa can be any naturally occurring amino acid
  misc_feature (306)..(306): Xaa can be any naturally occurring amino acid
  misc_feature (317)..(317): Xaa can be any naturally occurring amino acid
  misc_feature (322)..(322): Xaa can be any naturally occurring amino acid
XRAVRLVEIGKPLSLQEIGVPKPKGPQVLIKVEAAGVCHSDVHXRQGRFGNLRIVEDLGVKLPVTLGHEIAGKIEEVGDEVVGYSKGDLVAVNPWQGEGNCYYCRIGEEHLCDSPRWLGINFDGAYAEYVIVPHYKYXYKLRRLNAVEAAPLTCSGITTYRAVRKASLDPTKTLLVVGAGGGLGTXAVQIAKAVSGATIIGVDVREEAVEAAKRAGADYVINASMQDPLAEIRRITESKGVDAVIDLNNSEKTLSVYPKALAKQGKYVXVGLFGADLHYHAPLITLSEIQFVGSLVGNQSDFLGIXRLAEAGKVKPXITKTXKLEEANEAIDNLENFKAIGRQVLIP

SEQ ID NO: 29238 - protein, 115 aa, Listeria monocytogenes str. 4b H7858
MFYGYHGVLAEETKLGQTFRVSLILGLSTKKAGISDSVDDTVSYAEVYETVKEIVEGTPFKLIEALAEKIATEVLTGYPLLEEVTVKLIKPNPPIPGHYDSVAVEIERKRSDLNG

SEQ ID NO: 29239 - protein, 132 aa, Oryza sativa
KSDKLVQWCHGAPGFVYLFVRAYQVTGNDSYLELAVSAGDAVWQRGILTKGYGICHGTAGNGYVFLDLYHATNDLKWLHRAIQFANFCFDYGKHHISRTPDSPYSLFEGLAGTIYYMADVLTPSNARFPAFE

SEQ ID NO: 29240 - protein, 212 aa, Ostreococcus tauri
MAHVDASMPASPSSPTASAWADASAPITVRVHVYDLTGDDAMHAAARMCGLGIHHSGCEVLEREYAFGYHDVRGITGVFDVAPMKAPMPATYRETIEMGRIDMTREEVGEAIDELRAAWPGTSYDLLKRNCNSFTEAMVMRLTGKMIPGYVNRLATIGCLAREYAPCLLPTSLVGDLRTLPAATGDEGSDTEDEEDAEEVQLLAVNPVEEMK

SEQ ID NO: 29241 - protein, 219 aa, Arabidopsis thaliana
MPVKWVLHWQPNQGSTVSSQILNEATQCVESINGVKEGRWKATLNYYKPMLKDQANQLEFPRDFLGISLADQPNKYYFIIRTQRIVLEADSSIQLIMEKLQSYKSKVALYFDGFQYQLGDFRLRVGKVVPTHSENVRGIVMEVEYLPISSMEKAQKVMEEFLEIWNEALAKRSLPGKFVNIDLNFGEFGLGDIYTPQHTAVRYALVMAHMIATVQAVRG

SEQ ID NO: 29242 - protein, 189 aa, Trichodesmium erythraeum IMS101
MVIDKVPDVVFKTRVRDESVDGPNPFRWQDKTTQEIFGGKRVVLFALPGAFTPTCSSTHLPRYEELYNEFKGQGIDEIICLSVNDAFVMFQWGKQQGSKNVFLLPDGNGEFSRKMGMLVEKSNLGFGMRSWRYAMVVNDCTIEKMFVEEGFADNYGDDPFEVSDADTVLAFLKGQEAPKDKPARLDFVG

SEQ ID NO: 29243 - protein, 220 aa, Prymnesium parvum
SFEMRDGDKMLYMGKGASKAVHNVNTIIGPALVGMDPVQQKEIDDKMVKTLDGSKNDWGWSKSKLGANAILGVSMAVCKAGAASKGIPLYKHIAERAGNPTDKMYMPVPSFNVINGGSHAGNKLAMQEFMILPIGATDFTEAMRMGSEVYHNPKSVIKAKYGQDACNVGDEGGFAPNIPRKQGGSGPTCHIYREGGYTGMSRLVWMLRHPSSGLLTRKCT

SEQ ID NO: 29244 - protein, 252 aa, Methanocaldococcus jannaschii DSM 2661
MKWDEIGKNIAKEIEKEILPYFGRKDKSYVVGTSPSGDETEIFDKISEDIALKYLKSLNVNIVSEELGVIDNSSEWTVVIDPIDGSFNFINGIPFFAFCFGVFKNNEPYYGLTYEFLTKSFYEAYKGKGAYLNGRKIKVKDFNPNNIVISYYPSKKIDLEKLRNKVKRVRIFGAFGLEMCYVAKGTLDAVFDVRPKVRAVDIASSYIICKEAGALITDENGDELKFDLNATDRLNIIVANSKEMLDIILDLL

SEQ ID NO: 29245 - protein, 465 aa, Bertholletia excelsa
MAKLFLLSLGIFLLFHCCLAIEYEQEELYECRIQRLTAQEPQYRLEAEAGVSEVWDYTDQQFRCAGVAALRNTIRPQGLLLPVYTNAPKLYYVTQGRGILGVLMPGCPETFQSMSQFQGSREQEEERGRFQDQHQKVHHLKKGDIIAIPAGVALWCYNDGDEDLVTVLVQHTASDLNQLDQNPRHFFLAGNIQRSQKQRGERYGLRGGQQILADNVFKGFNMEALADVLGFGMDTETARKVRGEDDQRGHIVRVEQGLKVIRPPRIREELEQQEGGGYNGLEETICSATFIQNIDNPAEADFYNPRAGRLTTVNSLKVPILTFLQLSAMKGVLYENAMMAPLWRLNANSVVYAVRGEARVQIVDHRGETVFDDNLREGQMVVVPQNFVVVKQAGSRGFEWVVFNTNDNALFSTAAGRTSPLRGIPVGVLANAYRLSQEEARRIKLNRDEAVLFQPGSRSRGRASA

SEQ ID NO: 29246 - protein, 158 aa, Zea mays
  misc_feature (82)..(82): Xaa can be any naturally occurring amino acid
MLNAEFNGIARNPGLDLYPAHLWASIDEANELVYDAINNGVYKCGFAKKKDDRVLVTDLGSLTSIHDRARELFYYLKGAQVXYGEEHSKACGHNRFGRIYHIGHYPVRYEHNPVHFVGHSAGAQVVRVLHHMFTDKVDHCHGNQLCTMISQAGRSHGH

SEQ ID NO: 29247 - protein, 95 aa, Oryza sativa
SSRYNLESAESLRYLSLYDNRCLRYFKGHKDRVVSLCMSPVNDSFMSGSLDHSVRIWDLRVNACQGILRLRGRPSVAYDQQGLVFAVAMSCLHRQ

SEQ ID NO: 29248 - protein, 211 aa, Arabidopsis thaliana
LLRENKRMLDKSIREIERERQGLQTQEKKLINEIKKTAKQGQMGAVKVMAKDLIRTRHQIEKFYKLKSQLQGVSLRIQTLKSTQAMGEAMKGVTKAMGQMNRQMNLPSLQKIMQEFERQNEKMEMVSEVMGDAIDDALEGDEEEEETEDLVSQVLDEIGIDINQELVNAPSGAVAVPTAKNKVVQAEATGAEDSGGIDSDLQARLDNLRKM

SEQ ID NO: 29249 - protein, 168 aa, Sorghum bicolor
MAAADVEYRCFVGGLAWATNNETLEQAFANFGQVIDSKVITDRETGRSRGFGFVTFSSEQSMLDAIENMNGKELDGRNITVNQAQSRGGGGGGGGYGGGGGGYGGREGGGYGGGGGGYGGRREGGGGYGGGGYGGGGGGYGGREGGGGYGGGGGYGGNRGDSGGNWRN

SEQ ID NO: 29250 - protein, 214 aa, Prototheca wickerhamii
RACHLCSIPAVKMQLAPVCTATLPVASCRPRLTACRPIARAACLSTSKSAMAAQPLMAKPMGMASLPSQQRVKSASVRVEASNSAATPAPKEGSFLGIAAFTWQKIIPLGLMFFCILFNYTILRDTKDVLVVTAPGSGAEIIPFLKTWVNLPMAIGFTILYTKLANVLNNEQLFYVCIIPFLAFFSAFAFLLYPCATSCTPPSGPPRRSPSMAP

SEQ ID NO: 29251 - protein, 244 aa, Gloeobacter violaceus PCC 7421
MYKTLASVVATIREDFQAAFEKDPAARSWFEVLTCYPGLHAVAVHRFAHLLYARRWFWPARFLSHIARWLTGVEIHPGATIGAGIFIDHGMGVVIGETAIIGRDALIYQGVTIGGTGKQKGKRHPTLGDNVVVGAGAKVLGNIEIGNNTRIGAGSVVLRTVPSDCTVVGVPGRVVYQDGERIDPLAHGQVPDPLADVIRSLVRRIDELESEVQQLRTDKTGKPAAPSCAIEARLLEDFLHGPGI

SEQ ID NO: 29252 - protein, 345 aa, Desulfotalea psychrophila LSv54
MTRYQEVQQELKDSPKTWLITGVAGFIGSNLLETLLGLGQKVVGLDNFVTGYQHNLDEVEGAVTDAQWQNFRFIEGDICSLDACQEACQGVDYVLQQAALGSVPRSIVDPITTNNTNISGFLNMLVAARDAEVKSFTYAASSSTYGDHPALPKVEENIGNPLSPYAVTKYVNELYASVFARTYSFKTIGLRYFNILGKRQDPNGAYAAVIPLWTAAMINDETVFINGDGETSRDFCFIENAVQANILAATATEEARDNVYNVAVGDRTTLNELFNLIKHNLADHGIVYNLDPSYRDFRAGDVRHSQADTTKIKRLLGYSPQYKIGAGIEKAMGWYVQSLSVSGHK

SEQ ID NO: 29253 - protein, 157 aa, Daucus carota
MAEVEYRCFVGGLAWATNDESLEQAFSQFGDITDSKIINDRETGRSRGFGFVTFKDEKSMRDAIEGMNGQELDGRNITVNEAQSRGSGGGGGRREGGGGGYGGGGGYGGRREGGGGGGYGGRREGGGGGYGGGGGGYGGRREGGDGGYGGGGGGSRW

SEQ ID NO: 29254 - protein, 409 aa, Shewanella sp. MR-4
MTYSNAAENASLRNKMPNCIKPMNIVVVGMGYVGLSNAVLLAQQNHVVAIDLMPERIALVNARKPTVADSLIEEYLQHKTLNLSATSDKNVVKEADFVILATPTDYDPQTNYFNTQSVERVAKEVLALNPDTTIVIKSTVPVGFTEGLRSKLNSNNILFSPEFLREGKALYDNLHPSRIIVGERSERAQAFADLLARAAIKQDIPILLTDSTEAEAIKLFANTFLAMRVAYFNELDSYAESRGLNTRQIIEGVCLDPRIGDYYNNPSFGYGGYCLPKDTKQLLANYNDVPNNLISAIVDSNTTRKDFIANAIISKQPKRVGIYRLIMKSDSDNFRASAVQGVMKRIKAKGIEVVVYEPVLKEDEFFNSKVIRDLHEFKAMCDVIISNRMANELEDVAAKVYTRDLFHHD

SEQ ID NO: 29255 - protein, 426 aa, Desulfotalea psychrophila LSv54
MEYSLDTTKIGIVGLGYVGLPLAVEFGKKISTIGFDLNESRVRDLVAGSDFTLECSAEELSKASELQYSTNLEDLRDCNVYIVTVPTPIDEHKCPDLSPLVKASESLGQVLSKGDIVIYESTVYPGATEENCVPVLERVSGLSYNKDFFAGYSPERINPGDKEHSVTMIKKVTSGSTEQIADFVDELYSSIIIAGTHKASSIRVAEAAKVIENTQRDLNIALINELAIIFNKLGIDTEEVLEAAGTKWNFLPFRPGLVGGHCIGVDPYYLTHKAQSVGYHPEVILSGRRINDNMGSYVASQLVKALIKKRIQVEGANVLLLGLTFKENCPDLRNTKVVDIISELAQYNIQVDVYDPWVSKIEAEKEYGISPVEKPGQNKYDAVVVAVAHNEFVALGESGLQDLLREKSVVYDLKYILPRAVVDIRL

SEQ ID NO: 29256 - protein, 335 aa, Shewanella sp. MR-4
MKYLVTGAAGFIGAKVSERLCAQGHEVVGIDNLNDYYDVGLKLARLAPLEALSNFRFIKLDLADRDGIAALFAEQGFQRVIHLAAQAGVRYSLDNPLAYADSNLVGHLTILEGCRHHKIEHLVYASSSSVYGLNQKMPFSTEDSVDHPISLYAATKKANELMSHTYSHLYQLPTTGLRFFTVYGPWGRPDMALFKFTKAILAGDTIDVYNHGDLSRDFTYIDDIVEGIIRVQDKPPRPTPDWRVETGTPANSSAPYRVFNIGNGSPVQLLDFITALESALGIEAKKQFLPMQPGDVHSTWADTEDLFKAVGYKPQVDINTGVSRFVEWYRAFYAK

SEQ ID NO: 29257 - protein, 518 aa, Pycnoporus sanguineus
MGSGLFSLFVAIAAISGSLAAIGPKADLVISDAVVNPDGTPRAAVVVNGDFPGPLISGKKGDHFQLNVINKLTNHTMLKTTSIHWHGLFQEHTNWADGPAFVNQCPIASGHSFLYDFHVPDQAGTYWYHSHLSTQYCDGLRGPLVVYDPHDPQAHLYDVDNDDTVITLADWYHVAAKLGPQFPRGANSTLINGLGRAATDSTSDLTVITVEHGKRYRFRLVSISCDPNHTFSIDGHNMTIIEVDGVNSKPLTVDSIQIFAAQRYSFVLNANQPVDNYWIRANPSGGTLGFEGGINSVILRYKGAPDAEPTNTTAPTSVIPLVETNLHPLKPMQVPGRSGVGNVDYAKTLNFNFNGTNFFINNATFTPPTVPVLLQILSGAHNAQDLLPAGSVYTLPPHSAIEITMPATTMAPGSPHPFHLHGHVFAVVRSAGSSEYNYHDPIFRDVVSTGQPGDSVTIRFMTDNPGPWFLHCHIDFHLEAGFAIVFAEDVNDIKYANPVPPSWEELCPIYDKLPESDH

SEQ ID NO: 29258 - protein, 798 aa, Bacillus sp. Y
MGKRFSKVFINLMVLSLIISMFAFGASANGGKQVEVKELPLAELFGEIELSSSKPTTVIVELQAESIVEAKHKGKSQSKGKLKAERDKVISSLQGKVSNAKVNREYDHVFSGFSVELPANEIIQLLATPGVKAVYPNVHYTADVISAEEISAEAFSPAMMDSAPFIGSDLAWDAGFTGKGVTVAIIDTGVDYTHPDLAHAFGNYKGYDFVNDDNDPQEGPGQYHGTHVAGTVAANGGIKGVAPEANLLAYRVLGPNGGTTEDVVAGVELAVQDGADVMNLSLGNTLNNPDWATSIALDWAMAEGVVAGTSNGNAGPNNWTVGSPGTSRDAISVGATQLPYNVYTSEISTSEGVAYPSAKVMGFPSDDELLALNDGEYEFVYVGLGYPADFVGKDLEGKIALISPGDFAFVDKATNAKNAGAVGPIIFNNVAGEHADVPGMPVPTIKTTLADGQKLLAELEAGNNKVSFDIEFDKAVGETMADFSSRGPVTLTWMIKPDVSAPGVNIVSTFPGEGYAALQGTSMASPHVAGAAALLLQAHPNWGTEDVKAALMNTAEDMINPATGKVYPHNTQGAGSIRVLDAINTKTLVAPGSHSFGKFVKDSGKQVEKQSFEIKNLSNERKAYSFDVEFAGNPVGIKVMTSNNLRVQPGKSQQVNFNVQVDTSKLTPGYYEGTITVSDGTDTIDVPTILFVGEPDYPRVTGAFMGKEADGSYYVGSYLPGGAEVIEYDIYVFNPNGTIGGFVDTIGSFENANAPFHEFSWDGTVQNGINLPNGDWVLAVYVEKAGVTEYKAYLVTKN

SEQ ID NO: 29259 - protein, 566 aa, Helianthus annuus
MATLISDTASWKDLKAHVGEIDKTHLRDLMTDTDRCKSMMLEFDGIFFDYSRQRATVNTVSKLFKLAEEAHLKQKINSMFNGEHINSTENRSVLHVALRASKDATINSDGKNVVPDVWQVLDKIKEFSDKVRNGSWVGATGKALTNVVAIGIGGSFLGPLFVHTALQTDSEASKLAGGRQLRFLANVDPVDVARNISGLDPETTLVVVVSKTFTTAETMLNARTLREWISSALGPQAVSKHMVAVSTNLKLVEKFGIDPNNAFAFWDWVGGRYSVCSAVGVLPLSLQYGFSVIEKFLAGARSIDQHFHSAPFESNIPVLLGLLSVWNVSFLGYPARAILPYTQALEKLAPHIQQVSMESNGKGVSIDGVRLPFEAGEIDFGEPGTNGQHSFYQLIHQGRVIPCDFIGIVKSQQPVYLKDEVVNNHDELMSNFFAQPDALAYGKTPEQLQSENVAPHLVPHKTFTGNRPSLSLLLPSLDAYRIGQLLAIYEHRIAVEGFVWGINSFDQWGVELGKSLASQVRKQLHASRKKGESVEGFNFSTTKLLTRYLEASADVPSEPTTLLPKI

SEQ ID NO: 29260 - protein, 159 aa, Salmonella enterica subsp. enterica serovar Typhi str. CT18
MRIGHGFDVHAFGGEGPIIIGGVRIPYEKGLLAHSDGDVALHALTDALLGAAALGDIGKLFPDTDPAFKGADSRELLREAWRRIQAKGYTLGNVDVTIIAQAPKMLPHIPQMRVFIAEDLGCHMDDVNVKATTTEKLGFTGRGEGIACEAVALLMKAAK

SEQ ID NO: 29261 - protein, 356 aa, Bacillus cereus ATCC 14579
MVTKMTIDRICTIGPASNNKETLAQLIKNGMKIVRLNLSHGTHESHKDIIRLVKSLDDSIKFLGDVQGPKIRLGEVKGEQITLQAGDSFILHTQPVTGSNTEASVDYEGIANDVKVGSRILINDGEVELIVEKISTDKIETKVKTGGNISSHKGVNLPDAAVRLPAITEKDKKDIQFLLEENVDFIACSFVRKPSHIKEIRDFIQQYKETSPNVIAKIETMEAIENFQDICKEADGIMIARGDLGVELPYQCIPLLQKMMIQECNRTNTYVITATQMLQSMVDHSIPTRAEVTDVFQAVLDGTNAVMLSAESASGEHPIESVRTLRLVSEFAEHVKKDGPFAMKDVLQLLRESLDE

SEQ ID NO: 29262 - protein, 524 aa, Triticum aestivum
  misc_feature (256)..(256): Xaa can be any naturally occurring amino acid
MYKNQLQELAQRSCFNLPAYTCLREGPDHAPRFKAAVIFNGEQFESPGFFTTLRQAEHAAAEVALAALARRGPSYSLAARILDETGVYKNLLQEVAQRVGAPLPSYTTERSGLGHLPVFTCTVELAGITFTGDHAKNKKQAEKNAASAAWASLKQLAREEANTTNEPENNDEQEQIRIARALLNYRTKEKIAMANNPNASPFPKKFPMQPERKPCFGQSSQSSYSKILPLFRPKSSSRSRPESPAAADGASQSPFXPIESSNSRSRFPAAEAAPYVPVGHYRMPCHSMAPPVTVRSSIPVFSAPPLPPPSGRTQQLPPLLSNPPSVRMASPVHIRPASPHFAPSGPAQRPRPVMSVQMKDVQHKAIRESMSSAIPVQVKDAQQRPTKESPSSAMPVQVKDAQHQLFKGSMSSSVMPIQMKDVQPQPAKEPLSEGKDAPPAATGPPVKIEAPAQVKEASEVVTSEVVPCPAAGLLLVLLLLLPVNAALLRQQASLGLMMMQPRVKRRVRTSWKLKQHWRRASSSF

SEQ ID NO: 29263 - protein, 319 aa, Oceanicola granulosus HTCC2516
MIAVAGGGAFGTALAAALAANGPVTLWMRDAEEAARNEQTRENRHRLAGVPIPAPVRVSADLETVFAAEIVLLAIPAQQLRPFLAQHGARLAGKPLVACSKGIDVETGEGPSAIIEAAVPDATAAVLTGPSFAADIARSLPTALTLACRNSAAAVALQDRLSTPVLRLYRTADVTGAELGGALKNVMAIACGTCIGAGFGESARAALITRGFAEMQRLAVGMGAEAETLAGLSGFGDLTLTCTSDQSRNYRHGLAIGRGERGDTGSTVEGVATARAIGRIARVRGLDLPVCAVVEALVEETITAQDALARLLSRPLKEE

SEQ ID NO: 29264 - protein, 396 aa, Streptomyces coelicolor A3(2)
MKAVTWQGKRDVRVEEVPDPKIQEPTDAVIRVTSSGLCGSDLHLYEVLTPFMTPGDILGHEPMGIVEEVGPEVTNLKPGDRVVVPFQIACGHCYMCDTGLPTQCETTQVTGEGMGAPLFGYTRLYGAIPGGQAEYLRVPQAQFGPIKVPEGPADDRFVYLSDVLPTAWQAVEYAAVPQGGSLAVLGLGPIGDMACRIARLKGIDKVFGVDLVPERLERARERGVETFDLRSFDNEKELVSAIQDRTGGRGPDAVIDAVGTEAHGGAVAKLVQQTAAVLPRAIGGPLAERFSIDRLAALYTAIDLVRRGGTISLSGVYGGMADPMPMLTMFDKQIQLRMGQANVRRWSDEIVPYLTDDDPLGVDGFATHRMPLADAPHAYEMFQKKQDGAVKVLMQP

SEQ ID NO: 29265 - protein, 367 aa, Synechococcus sp. WH 5701
MPLLSALRRLGQQPTMQDWPGLIEAYRRWLPVSEATPVITLREGATPLIPAPAVASRLGRGIKVFLKYDGLNPTGSFKDRGMTMAVSKAREAGAEAVICASTGNTSAAAAAYARRGGMRAFVLIPDGYVAQGKLAQALVYGAEVLAVKGNFDRALAIVREVADTYPVTLVNSLNPYRLQGQKTAAFEVVDALGDAPDWLCIPMGNAGNISAYWMGFQEYRQAGHSRRLPRMMGFQASGSAPLVLGHTVEQPDTIATAIRIGNPANREKALAVREQSGGSFHAVTDQDILEAYQLLGREEGVFCEPASAASVAGLLQQAEQVPAGATVVCVLTGNGLKDPNTAIDNCDGAFHAGLAPEVDVVAKVMGF

SEQ ID NO: 29266 - protein, 560 aa, Borrelia burgdorferi B31
MASSRGTALKKRPRDFNSLEGQDFVVETLKHSIEKNKIANAYIFSGPRGVGKTSSARAFARCLNCRNGPTVMPCGECSNCKSIENDSSLDVVEIDGASNTSVQDIRQIKEEIMFPPAISKYRIYIIDEVHMLSNSAFNALLKTIEEPPNYIVFIFATTESHKLPETIKSRCQHFSFKLLSLDKIYNMLKKVCLEDDIKYEDEALKWIAYKSSGSVRDAYTLFDQIVSFTDSNIKLDQIRSKMGLTNDEFLEKLSVSILGEDVKELICVLDSIFLSGVSYEQFLLDSIEFFREALFLKIGIKNFEFIGIKSEDLRKKLIEFDLNYLERIIVVLLETYRDLQFSVNPRYELEINFIKILRLKSYVPNHVLIKQIQNLEDNLLENIATDSNNFDVLSNNKSEDDLAFIPSKSSLKCEFPEIKSLEKEEADRDENLSTKIDKNILETNSIDEIDEIFIEDDNASNSNDFIDIRDKFIYIVSRYVQTLVHSGEVAIDDNVLYYKVFSEFEYNELQNYKGEIRSEFYKEFPNLSIVFQKNFKNLEKDFEKLETVKNIFGASEVLEG

SEQ ID NO: 29267 - protein, 169 aa, Borrelia burgdorferi B31
MSMLLQKTLCIVKPDGVRRGLIGDVVSRFERVGLKMVAAKMLIVDESLAKKHYLYDDIVFRHSEAVWNSLIKFISNSPVFTFVVEGVESIEVVRKLCGATEPKLAIPGTIRGDFSYHSFKYSNEKGFSIYNVIHASANEADAMREIPIWFKDNEILNYKRDDECEHYYC

SEQ ID NO: 29268 - protein, 473 aa, Glycine max
MEEKLKYPCLSSLLTLFLCISATSTNPHNSQTQTLLLHTLPDPPTLSWPESATVEPDPEPTTSLSLHHIDALSFNKTPSQLFHLRLERDAARVKTLTHLAAATNKTRPANPGSGFSSSVVSGLSQGSGEYFTRLGVGTPPKYLYMVLDTGSDVVWLQCKPCTKCYSQTDQIFDPSKSKSFAGIPCYSPLCRRLDSPGCSLKNNLCQYQVSYGDGSFTFGDFSTETLTFRRAAVSRVAIGCGHDNEGLFVGAAGLLGLGRGGLSFPTQTGTRFNNKFSYCLTDRTASAKPSSIVFGDSAVSRTARFTPLVKNPKLDTFYYVELLGISVGGAPVRGISASFFRLDSTGNGGVIIDSGTSVTRLTRPAYVSLRDAFRVGASHLKRAPEFSLFDTCYDLSGLSEVKVPTVVLHFRGADVSLPAANYLVPVDNSGSFCFAFAGTMSGLSIIGNIQQQGFRVVFDLAGSRVGFAPRGCA

SEQ ID NO: 29269 - protein, 209 aa, Prototheca wickerhamii
HGTHAGLRVRPSPSAGRRVATAAGTGTFFVGGNWKANGSTAVVEKLVQELNAGILPKDVEVVVAPSFLYLDQVQGSLKSSYQVAAQNCWKGKSGAFTGEVTAEMLADKQIPWVILGHSERRALMGDTDEVVGEKVAYALSKGVKVIACIGETLEERESGRMFDVLDTQAKAIAEDVTDWSSVVLAYEPVWAIGTGKWPPPSKPRSARLA

SEQ ID NO: 29270 - protein, 292 aa, Salmonella enterica subsp. enterica serovar Anatum
MKTRKGIILAGGSGTRLYPVTMAVSKQLLPIYDKPMIYYPLSTLMLAGIRDILIISTPQDTPRFQQLLGDGSQWGLNLQYKVQPSPDGLAQAFIIGEEFIGNDDCALVLGDNIFYGHDLPKLMEAAVNKESGATVFAYHVNDPERYGVVEFDQSGTAVSLEEKPLQPKSNYAVTGLYFYDNSVVEMAKNLKPSARGELEITDINRIYMEQGRLSVAMMGRGYAWLDTGTHQSLIEASNFIATIEERQGLKVSCPEEIAYRKGFIDAEQIKNLAKPLSKNAYGQYLLNMIKGY

SEQ ID NO: 29271 - protein, 295 aa, Xanthomonas campestris pv. campestris
MTQRKGIILAGGSGTRLYPITKGVSKQLLPVYDKPMIYYPLSVLMLAGIRDILIINTPHEQALFQSLLGDGAQWGVNIQYAVQPSPDGLAQAYLIGRDFVGGKPSCLVLGDNIFHGHGLTDTLRRADAREQGATVFGYWVNDPERYGVAEFDQHGKVIDIAEKPEKPRSNYAVTGLYFYDGKASDYAAALKPSPRGELEITDLNRCYLDAGDLHLEPLGRGYAWLDTGTHQSLHEAANFIETIQMRQGLQVCCPEEIAFGQGWIDAEQLERLAAPLLKNDYGKYLTALAKRGAVH

SEQ ID NO: 29272 - protein, 992 aa, Oryza sativa Japonica Group
MTQRDNQREQGKQDSFTRKGKGKRPRTPAAIPIHPIEVPPTAVPGGPREPGPHVIEVLRIKGRSNMKYSINFIIWDFKRLCEYQTGKRSNPCPRSLPPNAVMGLALTRDCRGSGLLKRCYALENCGQDWLLGRRGGGIPSANVVMDRPQDPFNSRGIAVPPAVKMRNMAGNNSPWIDPLPPPMNARNGLANASLFSTSLPVLPHEKINFLDSARGTPLMDDASAKLKELDDDPEGKDYKFDFDLRQIDDLLPNEDDLFAGITNEIEPAGQTNSMEELEEFDVFGSGGGMELDTDPVESITAGLGNTSIADGLRGNGVNHFGPSNSASTVAGEHPYGEHPSRTLFVRNINSNVDDTELRSLFEQYGDIRTLYTATKHRGFVMISYFDIRAARGAMRGLQNKPLRRRKLDIHFSIPKENPSDKDLNQGTLVIFNLDPSVSNEEVRQIFGTYGEVKEIRETPNKKHHKFIEFYDVRAAEAALRSLNKSEIAGKRIKLEPSRPGGTRRNLMQQLGHDIDQDEPRSYRIPHVGSPIASSPPGAWAQYSSPTDNNLLQAFNASPTGNGMSPIGMPPSLISNAVKIAPIGKDSNWSKYDKVFSNNNQPHGAAFQHSHSYQDHKSEHMSSSPGTLTGPEFLWGSPKPYSEHAQSPIWRPPAIGHAIPSNTRSQGQGLLYGGRQASLFGSQDQLHHHHVGSAPSGAPFESHFGFLPESPETSYMNQVRFGNIGNIGSGRNGTGLMLNMAARASVNPVSALSGNMSDNNSSSFRPILSPRLGQSFYGNPTYQGPGSFGLDNSIERGRNRRVDSSVFQADSKKQYQLDLEKIRKGDDTRTTLMIKNIPNKYTSKMLLAAIDEFHKGTYDFFYLPIDFKNKCNVGYAFINMISPVHIVSFYQAFNGKKWEKFNSEKVASLAYARIQGRTALISHFQNSSLMNEDKRCRPILFHSNGPDAGNQEPFPINGICIHMPLEDGAIATGDPFGNEEDNNQNERTAGEEL

SEQ ID NO: 29273 - protein, 341 aa, Shewanella sp. MR-4
MKALSKLKAEKGIWLVDAPKPEMGHNDLLIKIKKTAICGTDMHIYNWDEWSQKTIPVPMVVGHEYVGEVVDIGQEVRGFKIGDRVSGEGHITCGHCRNCRAGRTHLCRNTSGVGVNREGSFAEYLVIPAFNAFKIPDDISDDLASIFDPFGNAVHTALSFDLVGEDVLITGAGPIGIMAAAVCRHVGARHVVITDVNEYRLELARKMGATRAVNVAQESLKDVMKELGMTEGFDVGLEMSGVPSAFHAMLDTMNHGGKIAMLGIPGGEMAIDWSKVIFKGLVIKGIYGREMFETWYKMASLIQSGLDISPIITHHYKIDDFQKGFDAMGSGQSGKVILSWD

SEQ ID NO: 29274 - protein, 617 aa, Chlamydomonas reinhardtii
MKAKTHFFKNLDLTSILVPEEDGAFTGTKVVCTVGPSCQEVDTMCEMLDAGVVGCRVDLTWGPLEFHRKSLANLQQAMRKSRRLCCTMVDTLGRELMIRRQVKIGEDGWPIHEESFAVTAGQQVIITTRTDVDASSNVLPITYSKFTEMAVKGDTIYIGRYLVCGADSASLYLEVMDVQGDDVYCIAKNDAVLDGLLTVFHAERSVEGLANVQNDLPLLSDYDKECLHILAQDFEIDFLSLSYTRAAEDVREARRFLDSIGMSNTKILAKLESRQSLLNFQGILNEADGIIISRGNLGLDCVPEKMALVQKTLVQACNLVGKPVLLTRVVDTMINTPRPTRAEATDVANAVLDGVDGILLGAETLRGRYPVSTVTTICNISRAAEKVFDHHYHYEHLMERAPYISKLESIASSAVRAADRVGASLIVVYTHTGKTAQLVAKYRPPMPILTLVVPHLVSDQLKWKLEGRSSARQCLISRALLPVLAAPSPSGDQLLQEAVAMAGRVKLVKPHDHVVCVQRIHDDFCVKIISVDDMGAGIKRDDTVMSHSVFGSSPMAVQGSSGYDSPRVHNNPIGNKFGPMPPAIITTGNSFTLGGMGVGVLSPAGLAAARGSNGGRQ

SEQ ID NO: 29275 - protein, 167 aa, Bacillus sp. AH 685
FKEYIDPAVGLQGFQARRIAFNINIPKELVGQAVKFMMGLYSAFIEKDCSIAEINPLVTTGDGKVMALDAKLNFDSNALYRNKDILELRDLEEEDSKEIEASKYDLNYIPLDGNIGCMVNGAGLAMATMDIIKHYHGDPANFLDVGGGATAEKVTEAYKIILSDKNV

SEQ ID NO: 29276 - protein, 570 aa, Salmonella enterica subsp. enterica serovar Typhi str. CT18
MSEKYPGPLVVEGKLSDAERMKLESNYLRGTIAEDLNDGLTGGFKGDNFLLIRFHGMYQQDDRDIRAERAAQKLEPRHAMLLRCRLPGGVITTTQWQAIDKFAADNTIYGSIRLTNRQTFQFHGILKKNVKPVHQMLHSVGLDALATANDMNRNVLCTSNPYESELHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGLETFKAEVERRAGITFEPIRPYEFTGRGDRIGWVKGIDDKWHLTLFIENGRILDYPGRPLKTGLLEIAKIHQGEFRITANQNLIIASVPESQKAKIEKLARDHGLMNAVSAQRENSMACVSFPTCPLAMAEAERFLPSFTDKVEAILEKHGIPDEHIVMRVTGCPNGCGRAMLAEIGLVGKAPGRYNLHLGGNRIGSRIPRMYQENITEPDIQASLDELIGRWAKEREAGEGFGDFTVRAGIIRPVLDPARDFWE

SEQ ID NO: 29277 - protein, 691 aa, Staphylococcus aureus subsp. aureus Mu50
MLRGQEERKYSIRKYSIGVVSVLAATMFVVSSHEAQASEKTPTSNAAAQKETLNQPGEQGNAITSHQMQSGKQLDDMHKENGKSGTVTEGKDTLQSSKHQSTQNSKTIRTQNDNQVKQDSERQGSKQSHQNNATNNTERQNDQVQNTHHAERNGSQSTTSQSNDVDKSQPSIPAQKVLPNHDKAAPTSTTPPSNDKTAPKSTKAQDATTDKHPNQQDTHQPAHQIIDAKQDDTVRQSEQKPQVGDLSKHIDGQNSPEKPTDKNTDNKQLIKDALQAPKTRSTTNAAADAKKVRPLKANQVQPLNKYPVVFVHGFLGLVGDNAPALYPNYWGGNKFKVIEELRKQGYNVHQASVSAFGSNYDRAVELYYYIKGGRVDYGAAHAAKYGHERYGKTYKGIMPNWEPGKKVHLVGHSMGGQTIRLMEEFLRNGNKEEIAYHKAHGGEISPLFTGGHNNMVASITTLATPHNGSQAADKFGNTEAVRKIMFALNRFMGNKYSNIDLGLTQWGFKQLPNESYIDYIKRVSKSKIWTSDDNAAYDLTLDGSAKLNNMTSMNPNITYTTYTGVSSHTGPLGYENPDLGTFFLMDTTSRIIGHDAREEWRKNDGVVPVISSLHPSNQPFINVTNDEPATRRGIWQVKPIIQGWDHVDFIGVDFLDFKRKGAELANFYTGIINDLLRVEATESKGTQLKAS

SEQ ID NO: 29278 - protein, 150 aa, Pinus pinaster
SKSAREGGAFETRYGLTPASKWLVKGRELSMAPMLLMQNDKTTLAPWHHFNECVLEGGVAFKKANGAEIWSYASDHPDFNNLFNNAMACNARIVMKAILSKYQGFHSLNSLVDVGGGTGTAVAEIVRAYPFITGINYDLPHVVATASSLS

SEQ ID NO: 29279 - protein, 227 aa, Phleum pratense
YYEAGARFAKWRAVLKIGPNEPSQLSIDQNAQGLARYAIICQENGLVPIVEPEILVDGPHDIDRCAYVTEVVLAACYKALNDQHVLLEGSLLKPNMVTPGSDAKKVAPRESLAEYTVRTLQRTVPPAVPAIVFLSGGQSEEEATVNLNAMNKLQTKKPWFLSFSFGRALQQSTLKAWSGKEENVGKAQKAFLVRCKANSEATLGTYKGDATLGEGASESLHVKDYKY

SEQ ID NO: 29280 - protein, 315 aa, Synechococcus sp. WH 5701
MMDCTDRHFRVLMRQISRRALLYTEMVVAQALHHGRRDTLLDFDPQEHPLALQLGGDDPALLAESAQLAAAWGYDEINLNVGCPSPKVQQGRFGACLMADPDRVARCVEAMANASSLPVTVKHRIGIDDQDSYELLLAFVDKVAGAGASRFSVHARKAWLHGLDPKQNRTIPPLRHDLVHQLKRDRPQFTIELNGGLLSLENCQEHLGQVDGVMVGRAAYDHPLRWASVDQELFGCLERAPASASTVVRGLIPHASRWCGAGRRLWPIARHLVHLVEGVPGARHWRRRLGERAGERSAGPEVLEAAAQDLEQQGL

SEQ ID NO: 29281 - protein, 327 aa, Triticum aestivum
MEQAASFLSSLLGGGGGGQEPSGEPAATVASILIYPVKSCRGVSVPQAPVTSTGFRWDRQWLVVNAKGRALTQRVEPKMALVEVELPPAAFDEDWQPTPDSCLVIRAPGMDTLKVPLVAERATLDDVSVWEWSGSAYDEGAEAAEWLSAYLGKPSRLVRFKEDSEIRPTDPEYAQGYKLKFTDVFPFLMASQGSLDALNEVLKEPVPINRFRPNILVDGCHPYSEDMWKTIKINKLTFDGVKLCDRCKVPAVNQENGILGTEPTETMLTFRSGEVICPSHKNKHKVYFGQYLVCKESVSAKGKGRIVKVGDPVYVLQTYPSSDEVPA

SEQ ID NO: 29282 - protein, 618 aa, Oryza sativa
MRAVLEEWIKQRESWKPFWVRGINMVGYSINGLHPVLFSSQADGDDDGIRAGVAGPDAGPHRRLSCLCHIAVAPFPAPALEMWQQLGRLINGEHNALLLAIPLDGIGSFPPHPPPDPQEQEAAAPPPPPAEPAVPPRHRGHLHLFKKPLHRALSGLAATHGPVLLLHFGSRAVLHVTDPAVAEECLTDHDVTFANRPRLPSSCHLSNGYTTLGSSSYGPNWRNLRRIATVEVFSAHRLLRSADVRGGEVPHMARWLYLAAPAAGPSEPARADVKARAFELVLNVVARMVAGKQYYGGEGDAEAETEEAARFREMVREYFAMHGASNLQDFVLLLGLVDIGGAKRRAVKLSRERNTWAQRLIDEHRATATAAAATEARTMVGDLLKMQASEPEAYSDKVITALCLTGTDTSSSTIEWGMALLLNHPAAMAKARAEIDRFVGTGRVVEEADLPNLPYLQCIIRENLRLYPVGPLLAPHESSADCSVSVAGGGRYAVPAGTMLLVNVHAMHRDARFWGPDPESFSPERFEGGRSEGKWMLPFGMGRRRCPGEGLAVKVVGLALATLVQCFEWRRVGDEEVDMTEGSGLTMPKAVPLEALYWPRPEMVPALSGIFFIYNFFY

SEQ ID NO: 29283 - protein, 461 aa, Bacillus subtilis subsp. subtilis str. 168
MKKIAVIGTGYVGLVSGTCFAEIGNKVVCCDIDESKIRSLKNGVIPIYEPGLADLVEKNVLDQRLTFTNDIPSAIRASDIIYIAVGTPMSKTGEADLTYVKAAAKTIGEHLNGYKVIVNKSTVPVGTGKLVQSIVQKASKGRYSFDVVSNPEFLREGSAIHDTMNMERAVIGSTSHKAAAIIEELHQPFHAPVIKTNLESAEMIKYAANAFLATKISFINDIANICERVGADVSKVADGVGLDSRIGRKFLKAGIGFGGSCFPKDTTALLQIAKSAGYPFKLIEAVIETNEKQRVHIVDKLLTVMGSVKGRTISVLGLAFKPNTNDVRSAPALDIIPMLQQLGAHVKAYDPIAIPEASAILGEQVEYYTDVYAAMEDTDACLILTDWPEVKEMELVKVKTLLKQPVIIDGRNLFSLEEMQAAGYIYHSIGRPAVRGTEPSDKYFPGLPLEELAKDLGSVNL

SEQ ID NO: 29284 - protein, 219 aa, Shewanella sp. MR-4
MTESHIDFRRAKFLISAPDIAHLDQYLPGDVGVEIAFAGRSNAGKSSALNALTEQKNLARTSKTPGRTQLINVFELDAQRRLVDLPGYGFAQVPLAMKLKWQQSLGEYLQKRACLSGVVVLMDIRHPLKDLDMQMIEWAVASEIPVLALLTKSDKLAQSAKMKTVNEVRKALVEFGDWVQVEPFSALKGTGKPKVLSILNEWCHPQWLADELENQDDAE

SEQ ID NO: 29285 - protein, 249 aa, Brassica napus
  misc_feature (199)..(199): Xaa can be any naturally occurring amino acid
MSCVQSNYGSEESPPEKKRRNEKASPWWSSLPDAVALSIVARLTRLDQAALSLVSKRHRSLVASPELCRTRSLIGCTEASLYVCLNIMPDPNPSWFVLTRNRQLRQIPSNPYQPLRPSSSFVVVDWGIYVIGGIVNGNPTRDVWFLDCYSRTWHPVPSMKMARASASANVIDGKIYVFGGCRDEEAEVFDPKTQTWRNXISPIGIQQSVVVQGKKIYAVDEEDQSFCSLPSQCPSWTSGKRDCKPRNRK

SEQ ID NO: 29286 - protein, 556 aa, Oryza sativa
MRTNPTTSHPGVSTIEEKSTGRIDQIIGPVLDVTFPPGKLPYIYNALVVKSRDTDGKQINVTCEVQQLLGNNRVRAVAMSATDGLMRGMEVIDTGAPLSVPVGGATLGRIFNVLGEPVDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNLEESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVGNEHYETAQRVKQTLQRYKELQDIIAILGLDELSEEDRLTVARARKIERFLSQPFFVAEVFTGSPGNGQIGVLPNHAPINTAVDMGPLRIRLLNDQWLTAVLWSGFARIVNNEIIILGNDAELGSDIDPEEAQQALEIAEANVSRAEGTKELVEAKVALRRARIRVEAVNWIPPSN

SEQ ID NO: 29287 - protein, 293 aa, Burkholderia sp. 383
MSGHRVRFKQVDVFTAVPFKGNALAVVFDADSLGDDDMLAIARWTNLSETTFLCTPTDPEADYRVRIFTTEGELPFAGHPTLGTAHAFLENGARPRTPGRLIQQCGVGRVALREQADGWAFAAPPARVTPLDRSDYAALAAALRSDAIDLDAEPCAVDNGAPWLVVRLQSADACIGLTPDPALLEALTRRYGTDGVAVYAPHAEGGPATFEIRCLMTGGNFGFGEDPVTGSANAALAGLLTRQERRPGQSYTARQGTAIGRDGRIFVSYDEDGTTWIGGHVVTVVDGTFLSPA

SEQ ID NO: 29288 - protein, 432 aa, Salmonella enterica subsp. enterica serovar Typhi str. CT18
MSKIVKVIGREIIDSRGNPTVEAEVHLEGGFVGMAAAPSGASTGSREALELRDGDKSRFLGKGVTKAVGAVNGPIAQAILGKDAKDQAGIDKIMIDLDGTENKSNFGANAILAVSLANAKAAAAAKGMPLYEHIAELNGTPGKYSMPVPMMNIINGGEHADNNVDIQEFMIQPVGAKTVKEAIRMGSEVFHHLAKVLKGKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 29289 - protein, 391 aa, Silicibacter pomeroyi DSS-3
MIPSVLPTYTRAPLHFVKGEGAWLTEADGRRFLDLGAGIAVNALGHAHPALVKALTDQAQNLWHVSNLYHIPQQQALADKLVEHTFADTVFFTNSGTEACELAVKMARKYFYDKGQPERVEIITFDGSFHGRSSAGIAAAGSEKMVKGFGPLLPGFVHLTFGDLDGVTNAITDKTAAILIEPVQGEGGIRPVPDADLKALRQICDDHGLLLILDEVQCGVGRTGRLFAHEWAGITPDIMMVAKGIGGGFPLGAVLATEEAASGMTVGTHGSTYGGNPLGCAVGCAVMDHVADPDFLAEVNRKAALLRQRLEGLIATHPNVFEEVRGSGLMLGLKCKASNLDVVKAGFDNLVITVPAADNVVRLLPPLTLTEEDIAEAFTRLDAAATQVDAA

SEQ ID NO: 29290 - protein, 308 aa, Silicibacter pomeroyi DSS-3
MNHFLDIHKTDAADLRAMIDQAGAMKQARLGRPKAAPDDEQPLKDRMVALIFEKPSTRTRVSFDVGVRQMGGQTMVLSGNDMQLGHGETIADTARVLSRYVDMIMIRTFDESVLAEMAEYADVPVINGLTDRSHPCQIMADVLTYEEHRGPIAGKKVVWTGDGNNVCSSFLHAAGQFGFDLTFSGPAQFDPEEEYMGFARQKGSKIVIERDAVKAVEGADLVVADTWVSMHDAQSAKERRHNLLRPYQVNAELMRHAKPDALFMHCLPAHREEEATSEVMDGPHSVIFDEAENRLHAQKAIMRWCLGA

SEQ ID NO: 29291 - protein, 314 aa, Pyrococcus furiosus
MVVSLAGRDLLCLQDYTAEEIWTILETAKMFKIWQKIGKPHRLLEGKTLAMIFQKPSTRTRVSFEVAMAHLGGHALYLNAQDLQLRRGETIADTARVLSRYVDAIMARVYDHKDVEDLAKYATVPVINGLSDFSHPCQALADYMTIWEKKGTIKGVKVVYVGDGNNVAHSLMIAGTKLGADVVVATPEGYEPDEKVIKWAEQNAAESGSFELLHDPVKAVKDADVIYTDVWASMGQEAEAEERRKIFRPFQVNKDLVKHAKPDYMFMHCLPAHRGEEVTDDVIDSPNSVVWDQAENRLHAQKAVLALVMGGIKF

SEQ ID NO: 29292 - protein, 723 aa, Thermotoga neapolitana
MWLLFLIPLVALGFAAANFAAVVKKPEGTDRMKEISSYIRSGADSFLAHETRAIFKVAIVIAILLMIFTTWQTGVAFLLGAVMSASAGIVGMKMATRANVRVAEAARTTRKIGPALKVAYQGGSVMGLSVGGFALLGLVLVYLIFGKWMGQLDNLNIYTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQRVGENLVHQIPKETIQSLITYPILFALVGLGCSMLGILYVIVKRPSDNPQRELNISLWTSAILTVVLTAFLTYFYLKDAQGLDVVGFRFGPISPWFSAIIGIFAGILVGFWAEYYTSYHYRPTQFLSRSSIEGTGMVISNGLSLGMKSVLPPTLTLVLGILFADYFAGLYGVAISALGMLSFVATSVSVDSYGPIADNAGGISEMCELDPEVRKITDHLDAVGNTTAAIGKGFAIGSAILAALSLFASYMFSQISPSDVGKPPSLILLLNMVDARVIAGALLGAAITYYFSGYLISAVTKAAMKMVDEIRRQAREIPGLLEGKAKPDYNKCIEITSDNALKQMGYPAFIAILTPLVTGFLLGPEFVGGVLIGTVISGAMLAILTANSGGAWDNAKKFLEAGNLEGYGKGSEPHKALVIGDTVGDPLKDTVGPSLDILIKIMSVVSVIAVSIFKHVHLF

SEQ ID NO: 29293 - protein, 591 aa, Vitis vinifera
MESTLKDIRDGASVLDLDPKATVGGGVEDLYGEDFATEDQLVTPWTVSVASGYSLLRDPRHNKGLAFNDKERDAHYLCGLLPPVVSTQELQERKLMNSIRQYQVPLQKYMAMMDLQERNERLFYKLLIDNVEELLPVVYTPTVGEACQKYGSIFRRPQGLYISLKEKGKILEVLKNWPERRIQVIVVTDGERILGLGDLGCQGMGIPVGKLSLYTALGGVRPSACLPITIDVGTNNEKLLANEFYIGLKQRRATGKEYSEFLQEFMSPVKQNYGEKVLIQFEDFANHNAFDLLAKYGTTHLAFNDDIQGTASVVLAGIVSALRLLGGTLADHKFLFLGAGEAGTGIAELIALEMSKQTKCPIEETRKKIWLVDSKGLIVGSRKDSLQQFKKPWAHEHEPVKDLLDAVKVIKPTVLIGSSGVGKAFTKEVIEAMASCNEKPLILALSNPTSQSECTAEEAYTWTQGRAIFASGSPFDPVEYNGKTFVPGQANNAYIFPGLGMGLVISGAIRVHDEMLLAASEALARQVTQENFDKGLIYPPFSNIRKISAHIAANVAAKAYELGLATRLPQPENLVKYAESCMYSPVYRSYR

SEQ ID NO: 29294 - protein, 447 aa, Saccharomyces cerevisiae
MPKESEVINSEFHVDVQDPERLNGHPVAKFINKLSGQPESYVNRTNYIFGRTLGAGSFGVVRQARKLSTNEDVAIKILLKKALQGNNVQLQMLYEELSILQKLSHPNIVSFKDWFESKDKFYIVTQLATGGELFDRILSRGKFTEVDAVEIIVQILGAVEYMHSKNVVHRDLKPENVLYVDKSENSPLVIADFGIAKQLKGEEDLIYKAAGSLGYVAPEVLTQDGHGKPCDIWSIGVITYTLLCGYSPFIAESVEGFMEECTASRYPVTFHMPYWDNISIDVKRFILKALRLNPADRPTATELLDDPWITSKRVETSNILPDVKKGFSLRKKLRDAIEIVKLNNRIKRLRNMYSLGDDGDNDIEENSLNESLLDGVTHSLDDLRLQSQKKGGELTEEQMKLKSALTKDAFVQIVKAATKNKHKVLAGEEEDDSKKTLHDDRESKSED

SEQ ID NO: 29295 - protein, 726 aa, Streptomyces coelicolor A3(2)
MSTEPTTIRWEQDDTGVVTLVLDDPDQSANTMNQAFRDSLAAVTDRLEAEKDSIRGVIVTSAKKTFFAGGDLRDLIRVTPETAQDLFDGGMAIKRNLRRIETLGKPVVAALNGAALGGGYEIALACHHRVALDAPGSKIGCPEVTLGLLPGGGGVVRTVRMLGITDALLKVLLQGTQYNPRRAQENGLVDEVADSREDMLAKARAFIDAHPESAQPWDRPGYRIPGGTPSHPKFAANLPAFPANLRKQTNGAPYPAPRNIMAAAVEGSQVDFETAQVIEARYFVELAAGQTSKNMIQAFFFDLQAVNSGANRPKGVEPGKVAKVAVLGAGMMGAGIAYSCARAGIDVVLKDVSLESALKGKAYSEKLCAKAVAKGRTSQEKAAALLARITPTAEAADLAGCDAVIEAVFEDTSLKHKVFQEIEHVVAPDALLCSNTSTLPITALAEGVERQGDFIGLHFFSPVDRMPLVEIIKGERTGDEALARAFDLVRQIGKTPIVVNDSRGFFTSRVIGHFINEGVAMVGEGIEPASVEQAAAQAGYPAKVLSLMDELTLTLPRKIREETKRAVEEAGGTWAAHPAEALIDRMVDEFGRPGRSGGAGFYEYGEDGRRAGLWPGLREHFTKPGYEIPFADMQERMLFSEALDTVRLLEEGVLTSVADANIGSIFGIGFPGWTGGVLQYINGYDGGVPGFVARARELADRYGERFTPPALLVEKADNGEVFTDGR

SEQ ID NO: 29296 - protein, 340 aa, Synechococcus sp. WH 5701
MTLRVAINGFGRIGRNFMRCWLSRGENTGIEVVGLNDTSDPHTNAHLLEYDSMLGKIRDTEVGYTKDTITVNGKPIKCFSDRNPLNLPWKDWGVDLVIEATGVFIDTEGAGKHIKAGASKVLITAPGKGEGIGTFVVGVNDDQYRHDDYNVISNASCTTNCMAPLVKVLDQAFGIVKGTMTTTHSYTGDQRILDASHRDLRRARAAAINIVPTSTGAAKAVALVYPPMKGKLNGIAMRVPTPNVSVVDLVIEVSRGTTREEVNAVLKQASENGMKGIIKYSDLPLVSSDHAGTDESTIVDADLTLVMGDNMVKVIAWYDNEWGYSQRVVDLAELVAKNWK

SEQ ID NO: 29297 - protein, 588 aa, Triticum aestivum
LSSCEQQIRPFISPPSVLPIRPQRENEGKGTCTYVDMAPSEKCGWLLYVSLAAKCCGNGDGKPYRVVGFVVVLLAAFVVTSLLHWASQGGAAWGRYWWRRKGLGIGEARIPGPRGFPVIGSMGLMTGLAHRKLAAAAAGNVRRRRLMSFSMGETRVVVTADPDVARELLASPAFADRPVKESAYGLMFHRAIGFAPYGAYWRTLRRVSSSHLFSPRQVAASAAQRAVIAHQMVDAMRPVGGAGVKHVEARRFLKRASLHNVMWSVFGRRYELDEAGSGEAAELKSLVDEGYDLLGQLNWSDHLPWLARFDLQKIRSRCSALVPRVNRFVGRIIDEHRAALNDDDDAVVDFTDVLLSLQGSDKLSDADMIAVLWEMIFRGTDTVAVVIEWVLARLMLHQDVQARVHEELDRVVGPNRAVTESDAASLVFLQAVVKEVLRLHPPGPLLSWARLATSDVHVDGLHVPAGTTAMVNMWAITHDPTVWVKPAEFKPERFLGGSSSDHAAAGAEFSVTGSDLRLAPFGSGRRSCPGKSLAIATVGFWVATLLHEFEWTPPSSDGSGGVDLSEVLRLSCEMAAPLEARLRPRRAV

SEQ ID NO: 29298 - protein, 489 aa, Streptomyces coelicolor A3(2)
MSKDAVDTAQVAAHPQATGTIPADAGDAGYSKDLKARHVNMIAIGGAIGTGLFLGAGGRLRDAGPALAIAYLVAGVFAFFVVKALGELVLYRPSSGSFVSYAREFLGEKGAYVAGWMYFLNWSTTGIADITAIALYTHYWSMFTSIPQWVLALVALAVVLAVNLISVKIFGEMEFWFAIVKVATLVGFMLIGIFLLATQHEVSGQTPGMGMITDHGGILPHGVMPVVLVMQGVIFSYAALELVGVAAGETAEPHKIVPRAVNSIMWRVALFYVGSVVLLALLLPSSLYSGDESPFVTVLSGIGVPAAGDVMNLVVLTAAMSSLNSGLYSTGRILRSMAMAGSAPRFTGVMSRSQVPYGGILLTCAVCVLGVGLNYLVPSKAFEIVLNVASLGIISTWVIIMICHLVFVRRARAGLVERPGFRLPGSPVTEIVTIAFLLAVVGLMWNDEEVGRKTVLLVPVIAVMLVAGWFGVRRRVAHQAGQERPAPRE

SEQ ID NO: 29299 - protein, 292 aa, Bacillus subtilis subsp. subtilis str. 168
MKKVRKAIIPAAGLGTRFLPATKAMPKEMLPIVDKPTIQYIIEEAVEAGIEDIIIVTGKSKRAIEDHFDYSPELERNLEEKGKTELLEKVKKASNLADIHYIRQKEPKGLGHAVWCARNFIGDEPFAVLLGDDIVQAETPGLRQLMDEYEKTLSSIIGVQQVPEEETHRYGIIDPLTSEGRRYQVKNFVEKPPKGTAPSNLAILGRYVFTPEIFMYLEEQQVGAGGEIQLTDAIQKLNEIQRVFAYDFEGKRYDVGEKLGFITTTLEFAMQDKELRDQLVPFMEGLLNKEEI

SEQ ID NO: 29300 - protein, 163 aa, Triticum aestivum
MGSGSFLKVLAKNFDVLAGPLVSLAYPLYASVRAIETKSQVDDQQWLTYWVLYSFITLFELTFAPILEWLPFWPYGKLFFNCWLVFPCFNGAAYVYEHFARPMFVNRQIVNIWYVPRKEKLSKSDDVLSAAEKYIELNGPEAFEKLISKVFLLSAKILANALL

SEQ ID NO: 29301 - protein, 492 aa, Glycine max
MDTVLSTTLLLMLACSIVHVLRSLQARMRRKSNYNLPPGPSLLTIIRNSKQLYKKPQQTMAKLAKTYGPIMRFTIGQSTTIVISSIEATQEVLQTHDSLFSDRTNPDITTSYNHNRYSLVFLPVSPLWQELRKICHGNLFSAKTLDASTDLRRMKMKELLTDIRQRSLNGEVVDIGRAAFMACINFLSYTFLSLDFVPSVGDGEYKHIVGTLLKATGTPNLVDYFPVLRVFDPQGIRRHTTNYIDKLFDVFDPMIDERMRRRGEKGYATSHDMLDILLDISDQSSEKIHRKQIKHLFLDLFVAGTDTTAYGLERTMTELMHNPEAMRKAKKEIAETIGVGKPVEESDVARLPYLQSVIKESLRMHPPAPLLLPRRAKTDVQVCGYTVPQGTQILINEWAIGRNPAIWEDAHRFSPERFLDSDIDVKGRHFKLTPFGSGRRICPGSPLAVRMLHNMLGSLINNFDWKLENNIDPIDMDLDQSLRAIPVLVNAN

SEQ ID NO: 29302 - protein, 258 aa, Bacillus anthracis str. Ames
MLKFLSVRVEDHIAVATLNHAPANAMSSQVMHDVTELIDQVEKDDNIRVVVIHGEGRFFSAGADIKEFTSVTEAKQATELAQLGQVTFERVEKCSKPVIAAIHGAALGGGLEFAMSCHMRFATESAKLGLPELTLGLIPGFAGTQRLPRYVGKAKACEMMLTSTPITGAEALKWGLVNGVFAEETFLDDTLKVAKQIAGKSPATARAVLELLQTTKSSHYYEGVQREAQIFGEVFTSEDGREGVAAFLEKRKPSFSGR

SEQ ID NO: 29303 - protein, 267 aa, Glycine max
  misc_feature (106)..(106): Xaa can be any naturally occurring amino acid
  misc_feature (131)..(131): Xaa can be any naturally occurring amino acid
  misc_feature (190)..(190): Xaa can be any naturally occurring amino acid
  misc_feature (199)..(200): Xaa can be any naturally occurring amino acid
  misc_feature (206)..(206): Xaa can be any naturally occurring amino acid
MSTNDSNKARQIFDNRGNPTDEEDLTCSDRTLARAAVPSGAYTDIYEALELRDRGSDYLGKGVSKAVDNVNTIIAPALVGKDPTQQTAIDNLMLQHLDGTVNEWGXCKQKLAADAILALSLAVCRAGAAVXLYVPLYTHIANIAGTKKVVLPVPAFHVINGAPHAGNKLAMQEFMVLPVGTSLFFFSLKXMGVEVYHNXXPLIKKXYGQDAANGGDEGGFCPKLPQNQRNACELVQHRPSPKPGTTGQRLSFGTWLAAGFLNFNHGR

SEQ ID NO: 29304 - protein, 480 aa, Oryza sativa Indica Group
MAHGGGEEEEERVLSHGDVVLLRCDLTILRGPHFLNDRIIAFYLAHLAADHHDDDLLLLPPSVPYLLSNLPDPASVAAVADPLRLASRRLVLLPVNDNPDVSHAEGGSHWTLLVLDNSNAVSGPRFVHHDSLPPTNLPSARRLAAVLRPLLPASAIPLIEGPTPRQTNGYDCGVFVLAVASAICNWWPTRARHSNSDSDWLEAVKREIKLVHYLVMLDEPSHCPSTQLPSHPSIASTSLPVTAQDFGTWCDMQSHKKVAAVKPVASRPSSRLRSFSMLQEDSTAIDSPRVTSLEEIILRRPKLEDSGTHTAYDQKKADTGKGACWDNLTVSQSVRKPNVSAKNSLSYDGYSWRKYGQKQVKGSEFPRSYYKCTHPTCPVKRKVEMTPDGRIAEIVYNGEHNHPKPHPPRKPTLSTSVETLVATNDAGLENKLEGCDQAIGSDAVVEALRGGCHCLDGFRNGNEISDCKKRPTASLEDTLR

SEQ ID NO: 29305 - protein, 476 aa, Arabidopsis thaliana
MSIFLCFLLLLPLSLILFKKLLPSKGKLPPGPIGLPIIGNLHQLGKLLYKSFHKISQEYGPVVLLRLGVVPVIVVSSKEGAEEVLKTHDLETCTRPKTAATGLFTYNFKDIGFAPFGDDWREMRKITTLELFSVKKLKSFRYIREEESELLVKKISNLLMSFGQNFHQCDFVDMEKVEELVLESEANLGTFAFADFFPGGWLIDRISGQHSRVNKAFYKLTNFYKHVIDDHLKTGQPQDHSDIVSVMLDMINKPTKADSFKVTYDHLKGVMSDIFLAGVNGGANTMIWTLTELSRHPRVMKKLQEEIRAMLGPNKERITEEDLEKVEYLKLVMVETFRLHPPAPLLLPRLTMSDIKIQGYNIPKNTMIQINTYAIGRDPKYWKQPGEFIPERFLDSPIDYKGQHFELLPFGAGRRICPGMATGITMVELGLLNLLYFFDWSLPNGMTIEDIDMEEDEGFAIAKKVPLVLIQTSHRW

SEQ ID NO: 29306 - protein, 512 aa, Methanococcoides burtonii DSM 6242
MAFIEKLNSDEINFKNEVLSGLTVSLALVPEAVAFSIIANVSPLVGLYSAFIIGLITAILGGRPGMISGATGAIAVVVVALVIQHGVEYLFAAVVLMGIIQMIIGALKLGKFIRLVPHAVMFGFVNGLAIVIFMAQLAQFKVTDINGIEHWLGGQALLVMLGFVGLTMAIIYLLPRFTKAVPASLAAIIVVSTIVIYFQIQTRTVGDIASIAGGFPKFHLPKVPLNLETIKIIFPYSLIMALVGLIESLLTLTVIDEMTETRSRGNKESVAQGVANLVCGFFGGMGGCAMIGQSLININSGARNRISGIVAALGLLFFVLVGSSLIEKIPMAALVGVMFVVAIGTFEWASLKIFRKVPITDVLVMVVVASITVIYHNLAAAVIAGVIISALAFAWEHAKLVRSREIVDDNGIKHYEFFGPLFFGSVTEFQSKFDVLNDPDEIIIDLKESRVADHSAIEALNKITERYAKVGKTVHLRHLSEDCRVLLDNASAIIDVNHWEDPHYKVPSDILG

SEQ ID NO: 29307 - protein, 322 aa, Glycine max
MANAWKRDKATRLLSPKLLFLLFSSTLIVFFFFAFLTSRPSNPATTLTAFNTRLSFNAISPFDCTASPQAHPVVANTVEGVRYPFLFSLSDFGTLPDKPHKNIVRMLKGKPFRKPDISVTVQEVLEKARTEGKDGFFVDVGANVGMASFAASAMRFRVLAFEPVFENLQKICEGVYFNRVADLVTVFEAAASDRVGNITVHKLVGRLDNSAISATGAKLAFKSNEEIAFQVRTVPLDEVIPKSERVLLLKIDVQGWEYHVLKGASKLLSRKGSQAPYLIYEEDERLLRASNSSAKEIRDFLRSVGYHDCTQHGTDAHCVKKD

SEQ ID NO: 29308 - protein, 309 aa, Burkholderia pseudomallei K96243
MTAKTIRHYLQFKDFSLEDYEYVLERTGILKRKFKNYETYHPLHDRTLAMIFEKSSTRTRLSFEAGIFQLGGHAVFMSTRDTQLGRGEPVEDSAQVISRMVDIIMIRTFEQDIIQRFAENSRVPVINGLTNEYHPCQVLADIFTYYEHRGPIRGKTVAWVGDANNMLYTWIQAARILGFKLRLSTPPGYALDTKLVDAESAPFYQVFDDPNEACKGADLVTTDVWTSMGFEAENEARKQAFADWCVDEEMMSHAHPDALFMHCLPAHRGEEVTAGVIDGPQSVVWDEAENRLHVQKALMEFLLLGRLNH

SEQ ID NO: 29309 - protein, 221 aa, Griffithsia japonica
ARGSLGSIFSVYYRKSAPGKEGDTSDLLQRPGFEQVAAGYCVYGSTTYLTFSMGYGVHVFILDTLSGHFVLAKQHVQTPKAGPIYSVDTSVLPNVVDGVRKYVDLLEAEGSGKKFRHLNNLVANFHNVLTKGGILMLPGPQKQDLAKFLTEAAPLAFVARQAGARASVGKRNLLELSAWSLEMSVPLFVGSTADVDRLEEMVLGHAVEEKNSVDPSTMHKI

SEQ ID NO: 29310 - protein, 358 aa, Triticum aestivum
  misc_feature (90)..(90): Xaa can be any naturally occurring amino acid
  misc_feature (222)..(222): Xaa can be any naturally occurring amino acid
IKGAGSFVNEHEVKVDLNEGGETSVRGKNILIATGSEATPFPGLEIDEKRVITSTGAIALEKVPETMTVIGGGIIGLEMASVWSRLGSKXTIVEFLGQIGGPGMDSEIAKNTQKTLKKQGLEFKLNTKVVSGDKSGGKVKLEVDSAKGGKVESIESDVVLVAIGRRPYTAGLGLENIGLEADDRGRVVIDSEYRTKIPHIRCVGDCTFGPMLAHKAEEEAVXVVEYIKSGYVGVNYGAIPSVMYTHPEVAWVGQSEQDLKSQNIPYRVGSFPFAANSRAKTNIDTEGMVKMLADPETDRILGVHIIGPNAGEMIAEGTLALEYGASSEDIARTCHAHPTLAEAFKEAAMATHAKAIHY

SEQ ID NO: 29311 - protein, 109 aa, Griffithsia japonica
MSDVRTYTIEIDMHGTKYDIPVKEDCTLLEGIEEFGLEVLHSCRAGVCVTCAAKILAGEIDPGFASITDDLKEEGYVLTCSAYPRSDGIKLEMNHFDDAYDKQYGQFEN

SEQ ID NO: 29312 - protein, 418 aa, Ostreococcus tauri
MPASPGSTLAVAPGLDVTTPHHRALARAMTTRARLWTEMAHHDCVTRMCSSTMTRSETHVTAQVGGSRPSGLARAAEILESEYGYDEVNLNCGCPSERVCRKDDETSSFGAAMMIDVENTAECVRRMVEAVDATKITVKHRLGVRFDKTMTVKEETDSYEHVVKFIEAIKDAAGVDHFIVHARSAVMGGLSPDANRKIPPLRYDEVFALCDEFSKCDFTLNGGVETLEQAKGLLEREDGKLAGVMMGRAFYKHPCMLADIDRVIFGEPTADPPPTRRSLVKMYGDYGDSVFAGLGSDVHYKVRKSMARRLFKAVSAISYGTSTGSRAFHREADNHLLKRHYDDYPANPEDDRPWSVNFREFVEGIIDEEYLDDPLVNVNPEGDNTRPLARKFVRALKLKDANEKLKDSNAETAIRDGE

SEQ ID NO: 29313 - protein, 320 aa, Synechococcus sp. WH 5701
MVSAVVNRSPWKGASGRMLVLGGGYSGQRFASAVAATGMPVLISHRPDGHPVLGEGISSVAFASELRPGIEPAALENVTHVLVTVPPGRDGKDPVLESLGPILAGLPLQWLGYLSTSGVYGDRGGAWVQESDSPTPGLARSRARLACEQAWEASGLPLQVFRLPAIYGPGRCPFNGLRAGSSRLIHKPAQVFSRIHVDDITGALLHNLALPSAQRPALLNVADDRPCPSSETLGYAAHLLNCKLPEVESYGRIQESLSPMARSFWSENRRTSNRRLSVELGYRLRYPSYREGFRASLLEEQAVQRGAGSTSSGHTGAASG

SEQ ID NO: 29314 - protein, 84 aa, Glycine max
MASSADPWVREYGEAARLADDVAAMVADRAALPQSGPEVMRHTSAIRRKITILGTRLDSLEGMLARLPPKSITDKELNKHRDTL

SEQ ID NO: 29315 - protein, 156 aa, Triticum aestivum
NKFVQKSSLVPVRNSRDIVDPRVRTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 29316 - protein, 86 aa, Zea mays
  misc_feature (9)..(9): Xaa can be any naturally occurring amino acid
DHRGVGHLXVKLATDRGCKARPNFKVGICAEHAGEPWSLAFFAKSGLDYVSCSPFRVTTARLSTGQVLVSGSLLVGNRIASCWWMW

SEQ ID NO: 29317 - protein, 688 aa, Gibberella zeae PH-1
MSTLHTSPNVSNGEPHDAKIEEKGTQNVEIGVSHSEKQTFYSKVSVYLMMIFSGLALGSDGYNAGVIGNLELLFTSLYPDALTSMMSSRLSNAFLIGMIVGMIGFGVLVDQLGRKTGAVMTTIILVVGIALSTGASGTSDSGLLWMLVIARGIAGVGAGGEYPVSGAGALEASDEASHFRKSRGFMFAMVADLSAGLGYTFAALVPLILLLCVNQRTDRYELVWRLSFGLGAIPPLTIFWFRLRMRMSTAYRKSAMRKQKTPYTLIFKKYWRRIFGAAFSWFLYNWISIPFGIFSSVIISRVNASNSLVQNLGWGALINSFYLPGPFIGGFLSDRIGRRKTMALGYTLQAILGFVLGGANEKIQKVFPLFVVLYGIFLTLGEVGPGSTVVIMATEPFPTSVRGHTMGFISAWSKAGAAIGTQVFTAILSSYADPVKGNQVAFLDGEKQLDKEDLVWKNYLAEQGWDVTWGDYETPDPVKTKHQELLCQPGQMNHESHYSNWASTVFATSTKEEGRGEEAEEYRDDRAKGGRAYETHQVIATCVHTIGEASFRIFASFAEPNKPLLHEWMPSEHPAATASFICIINPATNKAFFVTRPLSTHPSVTYHKNKYLTTNNMCTEQYTHFYCIYCRCCIRKGYAWEICEQALQTESKSMGSCGYTEDGEVARVSEYCQQCPPDERKWNKVNLS

SEQ ID NO: 29318 - protein, 406 aa, Cryptococcus neoformans var. neoformans JEC21
MPHKIILDTDPGVDDVLAILLALSSPEVDLALISIVFGNTHAPVAHSNLLKIYHLLAQEVAQTAGAEGRYGRLKGQVKTVLAMGEDGPIGGEKAVAAYFHGPDGLSNISETHPHFTPPEIQPGDMHAHLDTSPKPSYEVILDILRAEPDDSVTIVALGPLTNIAHSLRADPETFTKVSRVVWMGGAIDHPGNTSPVAEFNCFADPYAASSVISAAKEGKIELVMAPLDITTPHAIPFSDLIHPSVVPIPEPSTGAVRKAPETPTPLEAFISAMLVRVRGLQASFGLPDAMEMHDPVAVWYAIAHAGVPRGAGPVEGWALQGREFTVERTGEYTRGMCVVDRRGTGETGVDRSKDERILSHGLAQDTGNTLPEKALKPRMLPLVITRTPGAEVLRSTLLGRVFGERE

SEQ ID NO: 29319 - protein, 463 aa, Shewanella sp. MR-4
MSTGTVVQVIGAVVDVEFPQDAVPQVYDALKIVGEGSCNGLVLEVQQQLGGGVVRTIAMGTSDGLRRGLEVVNSGSPISVPVGTATLGRIMNVLGEPIDEAGAIGEEERYVIHRSAPSYEDQSNTTELLETGIKVIDLVCPFAKGGKVGLFGGAGVGKTVNMMELINNIAKAHSGLSVFAGVGERTREGNDFYYEMKDSGVLDKVAMVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVANGVQTVLQRYKELKDIIAILGMDELSDDDKMTVSRARKIERFLSQPFHVAEVFTGSPGKYVSLKDTIRGFKGILSGEFDHIPEQAFYMVGSIDEAVEKANKKK

SEQ ID NO: 29320 - protein, 418 aa, Kineococcus radiotolerans SRS30216
MMSAMTTDERADAPARPAGRRSLLRMLGPAFVAAIAYVDPGNVAANLTAGAGYGYLLLWVLVLANAMAVLVQYLSAKLSVVTDRTLPEVLRDRLSRPARLAYWAQAELVAVATDLAEVIGGAVALHLLFGTPLLLGGIVVGAVSLGLLALHGRNGVRRFEAVIVGLLLVIVVGFVSGVVFSPPDAGEAVKGLVPRFEGSETVLLAASMLGATVMPHAVYLHSAMARDHHGTVTPALTRRVLGATRVDVVAALVVAGLVNISMLLLAASALRGVEGTDTLEGAHAAVEANLGTGAALLLAIGLLASGLASTSVGAYAGAVIMQGLLRIDVPLLVRRVVTLIPALVCLGIGVDPTRALVVSQVVLSFGIPFALVPLVRLTSSRALMGEHVNRRGTQVAATIAVGLVVALNLALLWLTFTG

SEQ ID NO: 29321 - protein, 253 aa, Brassica napus
MPLLCFISFTERLYNSYFVTEDMEDKVVVITGASSAIGEQIAYEYAKRGANLVLVARREQRLRVVSNNARQIGANHVIIIAADVVKEDDCRRFITQAVNYYGRVDHLVNSASLGHTFYFDEVSDTTVFPHLLDINFWGNVYPTYVALPHLRKTNGRIVVNASVENWLPLPRMSLYSAAKAALVNFYETLRFELNGDVGITIATHGWIGSEMSRGKFMLEEGAEMQWKEEREVPANGGPLEDFAKMIVAGACRG

SEQ ID NO: 29322 - protein, 334 aa, Rhodococcus sp. RHA1
MTITDDNPLAQRIALAPTLAEIRAEERVMAAISQLSRGEAIILTDGIGSPTSGEVVFPAARISTADAAFAIRYSSGFLQVALPPDRCDALWLPAQQGAAPGTAQCVTVDAATGITTGISAADRARTIRLLASPDASPASFSRPGHVVPLRADAALPISDFGHPEAAVHLVAAAGFPPAAVLTTVVGTTHPTDVASGNDLQEFARTHQLPIVGLRDLDSEKTPLPILHVSVDLPSGRTSLESFTDLGHNYLVVAVGEVSGREDVPVHLLPADRVLIDAGSPGAEPRILIGLPQTPEDEYGRAIDGLHRQHSMIRAVLRRLGCLSVLAHRRPDSLR

SEQ ID NO: 29323 - protein, 309 aa, Methanococcoides burtonii DSM 6242
MENIYEDITKTVGKTPLVRLNRITVGCYATVLVKVEAFNPLGSIKDRIALNMIETAEKDGMLKKGAIVIEPTSGNTGIGLAFVCATKGYRLILTMPETMSVERRNILKVLGAEIVLTPGPNGMKGAIEEAERIGKETPDSFIPHQFMNPANPDIHRCTTAGEIWDDTGGKVDILVAGVGTGGTITGVSEELKSRKPGFKAIAVEPKDSAVLSGGSPGPHMIQGIGAGFVPDVLNVDIIDEIITVSNEDAFETTRELAKKEGILAGISSGAALFAALDVARRKENEGKMIVVVLPDTGERYLSTTIVEKE

SEQ ID NO: 29324 - protein, 561 aa, Polaromonas sp. JS666
MTDLKITGMTCDSCAAHVKEALEKVPGVFSAVVSYAKGTAQLATELGTSPDALTAAVAGLGYKATLADAPTAEKRGGLLDKARGWLSGGDKSVGDGGKLHIAVIGSGGAAMAAALKAAEQGAKVTLIERGTIGGTCVNVGCVPSKIMIRAAHIAHLRRESPFDDGIEATVPAIDRRELLAQQQARVDELRHAKYEGILDSNPAINVLQGEARFKDGQSLAVGLNDGGERAVVFDRCLVATGASAAVPPIPGLKDTPYWTSIEALVSDTIPQRLAVIGSSVVAVELAQAFARLGSQVTILARSTLFFREDPAIGEAVTAAFRAEGIKVLEHTQASHVAYADGEFLLTTGHGEVRADKLLVATGRAPNTHSLALEAAGVTVNAQGAIVIDKFMRTSTPHVYAAGDCTDQPQFVYVAAAAGTRAAINMTGGEAAIDLSVMPAVVFTDPQVATVGYSEAQGHHDGIETDSRLLTLDNVPRALANFDTRGFIKLVIEEGSGRLIGVQAVAPEAGELIQTAVLAIRNRMTVQELADQLFPYLTMVEGLKLAAQTFSKDVTQLSCCAG

SEQ ID NO: 29325 - protein, 878 aa, Ostreococcus tauri
MASVRGGTTSMDRVPSTSSLNDGPVTTSDVHVLVVDDERICRTVTSSLLRRCGYRVTMAESGEEALELLRRGTEFHMLLTDVMMPGIDGPALLQIVRNDERLRDMPVVMMSANEHSDTVFRCIQHGAEDYLLKPVSRRAVKHMWTHVWRKSQVNVSRTVPQLGEDGEELLEDDEDRGEMVHGVPSVPQHGEEVTNSGEYNVIDRVHSPAGMRRNVSMLSLASAGLSTKASLFSAPVQTEGEDVSQKEEATMDIDEDVGKSNIQIVPEPVVHSLPPPLAGLETGARCLREWLDDETSGAQATRKEERWHVAWRITAFVDGLKYGTSAASYDMFDANCLNISPQGDITFAAKAHNEERSFVELAQELDDRDALFVVGLIILNMFWPEVFITVYEAEYPEKALTQVLAMSGFAKQAMTGEFEAAKVVVNHDLDVTGFEAARKRARKESTSGATEVGVSCYDDGTLMHKNLNSVVKSAFRSAKSLERQVFEDLEISLFDKCIVAMRQTSPSDCDSDGAWLKRVRENVGGSGYSVCNALDDFESEIRLVTRSVSLKRCASIGGDVTDFVANNSMVCCASWDRDGELFATAGTSRSICVYEADAVMKLGARVHCPAVEFEANDKVSSLCFNHYVKQSIASGDYQGVVQLWDVHKEVSTWENNTHRRRVWSLDFSSIDPTKLASGSDDGTVRVFSTTTKEATCTIQNHANVCSVRFHPTAPHLLAIGSANHKIHCYDLRQLNNPLLTLQGHRKAVSYVYWVGDELLSASTDNTLKLWDVKRNNPQTACVRTYTGHTNEKNFVGLSANADGYIACGSEDNVVHLYAKHSSVPVSSYSFSDKPAPVTQHRRDKAGFISSVVWSPDSKHLLAANSKGHLKILALSKSV

SEQ ID NO: 29326 - protein, 378 aa, Ostreococcus tauri
FTGLTSTALPTKAEQTFAGRVQRQTATKATGSKTVAAMKGKTIKVAINGFGRIGRNFLRCWHGRANTMLDIVAINDSGGVKQASHLVKYDSVLGTFEADVKIVDDTHISIDGKKIEIVSSRDPLQLPWKALGVDLVIEGTGVFIDTPGASKHITAGASKVLITAPAKGDDIPTYVLGVNADGYKHSDKIISNASCTTNGLAPFVKVIDEKFGLVKGLMTTTHSYTGDQRILDASHRDLRRARAACLNIVPTSTGAAKAVALVLPQLKGKLNGIALRVPTPNVSVVDLVVQTSKKCTADEVNAAFREAANGPLKGILAVADEPLVSCDFRCTDVSCTIDAALTMVMGDDMLKVVSWYDNEWGYSQRVVDLAELCAANWE

SEQ ID NO: 29327 - protein, 242 aa, Glycine max
MLNHFICGSFHHQEEDVPCSSPKKYSRRKESRNINKNPYSNRGLDKFSALLADLDERRQKVYSQMSPQDISFVRFAYSSNDDFVPIVVKVKKNNRIRRSTRQLEKSSEETTLKERKQKLNKLEAHKKKNLSFSWNVLKRPSFYVPAVVMLILVFLVVLGRSVATLCTCVVWYVVPTLSEYYDSSKPRNKSMMMNSKKRDYVRGWLNDVKMVNPEDLASPRSGDSKAYSNDNNSGKHGHQKSL

SEQ ID NO: 29328 - protein, 383 aa, Synechococcus sp. WH 5701
MQDKLTLMIPGPTPVPETVLLAMSRHPIGHRSGEFQAIVKRTTAQLKWLHQTQGDVLALTGSGTAAMEAGIINVLSRGDKVLCGDNGKFGERWVKVARAYGLEVEVIRADWGQPLDPEAFRLALEADSEKQIRAVILTHSETSTGVINDLETIARHVHAHGQALVVADCVTSLGACPVPVDAWGLDVVGSGSQKGYMMPPGLAFVAMSERAWEAHKRSDLPKFYLDLGKYRKSAAADSNPFTPPVTLYYALEAALGMMEQEGLDAIFARHSRLQRATQAAMRAIGLPLYAAEGHGSPAITAVAPEGLDAEVLRKKIKERYDILLAGGQDHLKGKVFRIGHLGFVCDRDVLTAVAAIEATLQELGAARQPVGAGLAAAARELAA

SEQ ID NO: 29329 - protein, 154 aa, Griffithsia japonica
HEARLHPRLYTPHTHHTSFLSRANQPPPHTMSGKVKKTSQSRSSKAGLQFPVGRIDRFLRKGGYADRVGAGAPVYMAAVMEYLTAEVLELAGNAARDNKKSRIIPRHIQLAVRNDEELNKLLGGVTIASGGVLPNIHQVLMPRKKSKGDASQEV

SEQ ID NO: 29330 - protein, 532 aa, Synechococcus sp. WH 5701
MSHPSPSTEQPESSRLPAIVILDFGSQYSELIARRVRETEVYSLVLGYATSVEDIKRLAPKGIILSGGPNSVYDEGAPLCDPAIWSLGIPVLGVCYGMQLMVQQLGGQVEAAGRGEYGKAPLYVDDPVDLLTNVEHGSTMWMSHGDSVQALPPGFSRLAHTDNTPEAAVADHQRRLYGVQFHPEVVHSRGGMAMIRNFVYHICGCEPDWTTAAFIDEALADVRDRVGDKRVLLALSGGVDSSTLAFLLHRAIGDQLTCMFIDQGFMRKGEPEFLTEFFDAQFHIRVEYINARDRFLAKLDGVTDPEQKRKIIGAEFIRVFEEESKRLGPFDYLAQGTLYPDVIESAGTNLDPKTGERVAVKIKSHHNVGGLPKDLQFKLVEPLRRLFKDEVRKVGRSLGLPEEIVRRHPFPGPGLAIRILGEVSAEKLNILRDADLIVREEVQEAGLYHEIWQAFAVLLPVRSVGVMGDKRTYAYPIVLRCVSSEDGMTADWSRLPYDLLERISNRIVNEVQGVNRVVLDITSKPPGTIEWE

SEQ ID NO: 29331 - protein, 422 aa, Physcomitrella patens subsp. patens
MEWIKPHTYTHTLIYISLSTYIYIYIYIDYKFTGKVDCCLQKCALADSSVSWNGRPVVPVVPNQNWNSVAGSKVLRDTVLHDIRLENRLKIFSGTANKALSQEIAYYMGLDLGKITIKRFADGEIYVQLQESVRGCDVFLVQPTCPPANENLMELLIMIDACRRASAKNITAVIPYFGYARADRKTQGRESIAAKLVANLITEAGANRVLACDLHSGQSMGYFDISVDHVYGQPVILDYLASKMISSNDLVVVSPDVGGVARARAFAKKLSDAPLAIVDKRRQGHNVSEVMNLIGDVKGKVAVMLDDMIDTAGTIFNGAALLHAEGAREVYACCTHAVFSPPAIERLAGGLFHEVITTNTIPVTEKNYFPQLTVLSVANLLGETIWRVHEEGAVSRVFTYSLSFSSVEILRMYIVGECVNCM

SEQ ID NO: 29332 - protein, 369 aa, Zea mays
MAAASLLEATRFLSTPHPRSRSRPLPFPPGSGLHPHLLRTPRLSTLRVHLHRPAPLGAQEPARPGALLAVDALRRSVLDSLAALKRPALALLLAGVLLAAASAGGPHAAALAASGGRVGGSAFSSRSSSPRSYGYSAPAPRGGYTAAPFYSPSPFVSVGPALGIGFGGSGFLVTLMGFAAFLYLAGFLSDSSGATSVLTETEKTTVLKLQVGLLGMARSFQKELDQIAEKADTSTPAGLSYVLTETTLALLRHPDCCISAYSSVDVKRSIDNGEKRFNQLSIEERGKFDEETLVNVNSIKRNKGGSQRSSGFSNEYIVITILVAAEGVHKVPVINSSNDLKTALQKMGAIPSRKILVFLASFFLSLVIS

SEQ ID NO: 29333 - protein, 214 aa, Triticum aestivum
NKFVQKSRLVPVRNSRDIVDPRVRAFPYVAMSDDEALENSLLSGFTENCEDGSGGNHITYTDTCTASSESVKKHLNMDSVQDLVKSRMGNNPSGPTELIVFCSGGFKDNAKTEGQLLLDLVSVLDKSGAKYTVLYASQPYGLLENPSDLPLARYLAEKTNTTKPVLEKCDGECQLKSTLLEGVFVGVVLLIILISGLCCMMGIDTPSRFEAPQD

SEQ ID NO: 29334 - protein, 293 aa, Bacillus subtilis subsp. subtilis str. 168
MRNICVIGSCSMDLVVTSDKRPKAGETVLGTSFQTVPGGKGANQAVAAARLGAQVFMVGKVGDDHYGTAILNNLKANGVRTDYMEPVTHTESGTAHIVLAEGDNSIVVVKGANDDITPAYALNALEQIEKVDMVLIQQEIPEETVDEVCKYCHSHDIPIILNPAPARPLKQETIDHATYLTPNEHEASILFPELTISEALALYPAKLFITEGKQGVRYSAGSKEVLIPSFPVEPVDTTGAGDTFNAAFAVALAEGKDIEAALRFANRAASLSVCSFGAQGGMPTRNEVEELLS

SEQ ID NO: 29335 - protein, 320 aa, Methanococcoides burtonii DSM 6242
MLDKRTKRCSMQYSIMGMSYRSKLPEIIDSVASSCSDKGCFEHIDSAVIPSRESIVEIIDLFKDVLFPGYFGDQTVERSNLIYHIGNEINELFEKLSKQVTNSILHECRRTEEDCAECIEKGQEETVMLLRKIPQIRSLLAADIIAAYEHDPAAKGYDEIIFSYPGIFALMVYRIAHELNEQDIKILPRIMTEYAHSVVGIDIHPGAKIGKGFFIDHGTGVVIGETSEIGDNVRIYQGVTLGSLSFPRGEEGQILRDLKRHPTIEDDVVIYSNSTILGGDTVIGARSVIGGNVWLTRSVPADTKVLIEEPKLVFKDRTSS

SEQ ID NO: 29336 - protein, 196 aa, Triticum aestivum
  misc_feature (19)..(19): Xaa can be any naturally occurring amino acid
  misc_feature (33)..(33): Xaa can be any naturally occurring amino acid
MAPTVMASSATSVAPFQGXSSPPAGLPVSRRSXNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESAPPSPAHSRQAIYKVPLQFCQL

SEQ ID NO: 29337 - protein, 221 aa, Clostridium difficile 630
MSIICASIMCADQMKLKEELEALEEAGVKLLHCDVMDGIFVKNLAMGPELLKSISENTTIPLDIHLATETPDKYIDMMSYIKPKYISFHVESSTNVKADIQKLRNYGIGPVLAISPQTSVDKIEEYISLVEGILVMTVNPGFAGQKFNLSVLDKLDKLTEILKDYDNPPFIEVDGNINKDTIKLMNGKKVDIYVVGTSALFNDKPPISYKDKIEELKESIK

SEQ ID NO: 29338 - protein, 306 aa, Clostridium difficile 630
MGIATREAYGQVLKELAENKDIVVLDADLGKATKSISFKEVAPDRFFDMGIAEGDMIGTAAGLATCGKIPFASTFAIFAAGRGYEQIRNSVAYPNLNVKIAATHAGVTVGEDGGSHQAIEDISLMRGIPNMVVLNPADALEARQAILASIDYNGPVYIRLGRAATPDVNSENYKFEIGKGTVLREGSDITVIATGIMVAKALEAAEELAKEGINVEVVNISTIKPLDEALIKETAKKTGKVVTAEEHSIIGGLGSAVCEALAETKDVVVRRIGVKDVFGQSGTPADLLKHYGLTTEDIVKNIKELL

SEQ ID NO: 29339 - protein, 172 aa, Brassica napus
LFNDTYVLSKNNQTLNVSKKGIAWKSDRKHKFGKNVFPKNFQMGNITGGGKLIPDVPLSEQEDLIVWMRTAALPTFRKLYGKIETDLQENDTIHVILKNNYNTYSFDGKKKLVLSTTSWLGGKNDFLGIAYLTVGGICFFLALAFTIMYLVKPRRLGDPTYLSWNRVPGGGR

SEQ ID NO: 29340 - protein, 338 aa, Haemophilus influenzae R2846
MAILVTGGAGYIGSHTVVELLNAGKEVVVLDNLCNSSPKSLERVKQITGKEAKFYEGDILDRALLQKIFAENEINSVIHFAGLKAVGESVQKPTEYYMNNVAGTLVLIQEMKKAGVWNFVFSSSATVYGDPKIIPITEDCEVGGTTNPYGTSKYMVEQILHDTAKAEPKFSMTILRYFNPVGAHESGLIGEDPNGIPNNLLPYISQVAIGKLAQLSVFGSDYDTHDGTGVRDYIHVVDLAVGHLKALQRHENDAGLHIYNLGTGHGYSVLDMVKAFEKANNITIAYKLVERRSGDIATCYSDPSLAAKELGWVAERGLEKMMQDTWNWQKNNPKGYRD

SEQ ID NO: 29341 - protein, 258 aa, Xanthobacter autotrophicus Py2
MIMGSPKWQGTDVPLAGAAEAEKASALSVWRLIREDVDCVKSRDPAARNTVEIVLTYPGVHAVIWHRLASRLWRRGIKFPARFLSWLGRFLTNVDIHPGATIGRRFFIDHGACVVIGETAEVGDDVTLYHGVTLGGTSWTSGKRHPTLRDGVLVGAGAKILGPITVGAGCRIGANSVVIEDVPPAMTVVGIPGRVVKPMADRRRVGDGRIDLEHHLMPDPVGEAIVSLLDRIEFLEARLAHLQSERPRGRSATADEAA

SEQ ID NO: 29342 - protein, 124 aa, Griffithsia japonica
MSAKVKKASQSRSSKAGLQFPVGRIDRFLRKGGYADRVGAGAPVYMAAVMEYLTAEVLELAGNAARDNKKSRIIPRHIQLAVRNDEELNKLLGGVTIASGGVLPNIHQVLMPRKKTKGDASQEV

SEQ ID NO: 29343 - protein, 446 aa, Zea mays
MAVTIQSVKARQIFDSRGNPTVEVDVFCSDGTFARAAVPSGASTGVYEALELRDGGSDYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLQTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 29344 - protein, 138 aa, Arabidopsis thaliana
  misc_feature (103)..(103): Xaa can be any naturally occurring amino acid
  misc_feature (109)..(109): Xaa can be any naturally occurring amino acid
  misc_feature (122)..(123): Xaa can be any naturally occurring amino acid
  misc_feature (129)..(129): Xaa can be any naturally occurring amino acid
  misc_feature (132)..(132): Xaa can be any naturally occurring amino acid
  misc_feature (135)..(135): Xaa can be any naturally occurring amino acid
MASSMLSSATYWLPLRAQATMVAPFNGLKSSAAFPATRKANNDITSITSNGGRVNCMQVWPPIGKKKFETLSYLPDLTDSELAKEVDYLIRNKWIPCFEFELXTDLCTXVSTGNLTRVTMIXXTGKCGXFPXSVXPIR

SEQ ID NO: 29345 - protein, 131 aa, Ustilago maydis 521
MVAALRSAVSSLVRARAPLAIARQATPVARAAIVTPRFAPVRFYAASAGLSKSDIETRIVDVLKTFEKVDPSKVSAASSFTTDLGLDSLDAVEVVMAIEEEFTIEIPDEEADNITTVQQAIDYIAKTPEAV

SEQ ID NO: 29346 - protein, 610 aa, Ostreococcus tauri
METKVIRLPNEPGSRMIVGRARGTGFMLPVRTVSGKHAELSLGANEDEGRVFVKDLGSKFGTSINGRALRRGETYEIFPGDFVTFGDEHLARYEAVAVVKIIPRKDDNSKPKPNDSLEQMLDVIKAGAVAAEQVGSAVSSMASTAALAAEEQAKSMQQPERAKTRGEAKKLEKQEFEANEEEVIKMEVRRQREESVTAPDTVTAERVLLAPVGWSGPVIDLELGERVVLGTSQKRGGADVILSSPGVDKSHAAVTLAGDGVVYVEDLRSSGGTFVRGRQIKAGLQYSLAAGDEFMLGDSGCVFQLSSNVEDDEEFEYQDVLEVGAPIDTPIDTAALAPRPTAEVEIVEAQDVTLNAVNNDDSTVSSPWDVLGGGLKGMGDNLGAAIFNSKINVNYSYKPTITLAGGKLAGLSDMKAALLLALADTERGLRVDKERRKKIEQLVRALEAKNPTKSPLKSPLMNGRWALQYTTQLSVIGRGKPDFMRPKGAIFQTLDIFTLQCLNEETFEPLPFLKFTNASTFDLKARTDSRAAITPRDVRIAGVRIKAPPTTAGRALRNMEMEASGSGSMAWQDTTFVDTEMRVSRTQSGDFFIFVRDDENDVDVNDPSMM

SEQ ID NO: 29347 - protein, 365 aa, Staphylococcus aureus subsp. aureus Mu50
MALTAGIVGLPNVGKSTLFNAITKAGALAANYPFATIDPNVGIVEVPDARLLKLEEMVQPKKTLPTTFEFTDIAGIVKGASKGEGLGNKFLSHIREVDAICQVVRAFDDDNVTHVAGRVDPIDDIEVINMELVLADLESVEKRLPRIEKLARQKDKTAEMEVRILTTIKEALENGKPARSIDFNEEDQKWVNQAQLLTSKKMLYIANVGEDEIGDDDNDKVKAIREYAAQEDSEVIVISAKIEEEIATLDDEDKEMFLEDLGIEEPGLDRLIRTTYELLGLSTYFTAGVQEVRAWTFKQGMTAPQCAGIIHTDFERGFIRAEVTSYDDYVQYGGESGAKEAGRQRLEGKEYIMQDGDIVHFRFNV

SEQ ID NO: 29348 - protein, 568 aa, Zea mays
MEAAPMRKASSQASLADPDDFDLTRLLNHKPRINVDRQRSFDDRSLGEISLAGAGTASRGGWGYGGGGMESYESMYSPGGGLRSYCGTPASSTRLSFEPHPLIGEAWDALRRSMVSFRGQPLGTIAAVDHSFGEVLNYDQVFVRDFVPSALAFLMNGEPEIVRNFLLKTLLLQGWEKRIDRFKLGEGAMPASFKVLKDPKRGVDKLVADFGESAIGRVAPVDSGFWWIIILRAYTKSTGDMTLAETPMCQKGIRLIMNQCLAEGFDTFPTLLCADGCCMIDRRMGVYGYPIEIQALFFMALRCALLMLKPDAEGKEIMERIVTRLTALSYHMRSYFWLDFQQLNDIYRFKTEEYSHTAVNKFNVNPESIPDWLFDFMPTRCGYFVGNVSPARMDFRWFALGNCVAILASLATPDQAAAIMDLIEERWEDLVGEMPVKICYPAIEGHEWQIVTGCDPKNTRWSYHNGGSWPVLLWLLTAACIKTGRLKIARRAIDLAEARLARDGWPEYYDGKLGRYIGKQARKLQTWSIAGYLVAKMMVEDPSHLGMISLEEEKPTKPVLRRSASWTG

SEQ ID NO: 29349 - protein, 173 aa, Brassica napus
  misc_feature (62)..(62): Xaa can be any naturally occurring amino acid
MARSGVDETSESGAFVRTASTFRSFVSQDPASQFPPESGRYHLYISYACPWACRCLSFLMLXGLDQAITFSSCHTIWGRTKETDDHRGWVFPDSNSELPGAEPDYLNGAKTVRELYEIASPNYVGKYTVPILWDKKLKTVVNNESSEIIRMLNTEFNGVAKNPSLDLYPSHLK

SEQ ID NO: 29350 - protein, 258 aa, Coccidioides immitis RS
MTRFRPCIDLHAGQVKQIVGGTLTAELGELKTNYVSALPAGHFAKLYKDHGLTGGHVVMLGPGNDDAAREALAAWPGGLHVAGGITDKNAQYWIDAGAEKVVITSFLFPEGKFSMQRLQAILTALGNDKSKLVLDLSCRRRENTWFVAMNRWQTITEMEINKETIRMLEPYCSEFLIHAADVEGLQQGIDDELVSKLAAWCSIPVTYAGGGRGLADLDRVKTSSKGKVDLTIGSALDIFGGSGVTFAECVQWNKANGD

SEQ ID NO: 29351 - protein, 378 aa, Streptomyces coelicolor A3(2)
MKADPRGTGSRTPGTATGGKTVPTVPPAPTADRRTTVDVTALLERGRTLATPVLRAAVDRLAPPMDTVAAYHFGWIDAQGNPADGDGGKAVRPALAVLSAEVTGAAPEVGVPGAVAVELVHNFSLLHDDLMDGDEQRRHRDTVWKVHGPAQAILVGDALFALANEVLLELGTVEAGRATRRLTKASRSLIDGQAQDISYEHRDRVSVEECLEMEGNKTGALLACASSIGAVLGGADERTADTLEKYGYHLGLAFQAVDDLLGIWGDPDATGKQTWSDLRQRKKSLPVVAALAAGGAASERLGEILTADAKASDFANFSEEEFAARAALIEEAGGREWTADEARRQHTIAIEALDAVDMPDRVRDRFTALADFVVVRKR

SEQ ID NO: 29352 - protein, 458 aa, Vitis vinifera
MENYYPYPDSHDSSPRSREIDTENASWDEPPSNYKVKFMCSYGGKIHPRPQDNQLAYVGGETKILSVDRNIKFPGFMSKISSICEGEVCLKYQLPGEDLDALISVTNDEDLEHMMLEYDRLCRPSNKQARLRLFLFPLTPPASTSFGSNETKSERQWFVDALNSVQIQPLEGSSPQAAASETNPDFLFGLDKGLAPPPPDPTPPPTVPDVLPKDYSVRSDPGSEDRHVVGDPVVSPADYQRQIQELQRLQIASQEQAMFQRKNDESNTRAYPAEYYAQKIPEKLAPAPQQMPVSIPATYWPERHMTTGGYPVAASTGTEQSVYLIHTSAGVYQTPGLRPMTGQLAQPYYGMQRVVSDVYREPQVYNAAPPHQQQKVGAYGEGMGMMRPSASGVGVTEQGYAQVTYDSTGRQVYYTTPGGAAPSYQAVTTAAAQGDVRQGGVTINQDGKVVAKTSQGSL

SEQ ID NO: 29353 - protein, 355 aa, Alternaria brassicicola
MAEFVRAQIFGTTFEITSRYTDLQPVGMGAFGLVCSAKDQLTSQAVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVQSLPKRERQPLSNKFKNAEPQAVDLLENMLVFDPKKRVRAEQALAHPYLAPYHDPTDEPIAEEKFDWSFNDADLPVDTWKIMMYSEILDYHNVDAAAQEQENNGS

SEQ ID NO: 29354 - protein, 446 aa, Kineococcus radiotolerans SRS30216
MSTAGSTAPRSVESLVVALVVQKFGGSSVADADGIKRVAKRIAATKRAGHEVVVVVSAMGDTTDELIDLAEQVSPMPPARELDMLLTSGERISMAVLAMAISNLGLEARSFTGSQAGVITDSSHGRARIIDVTPGRIRSALDEGAIAIVAGFQGVSQDTKDITTLGRGGSDTTAVALAAALKADVCEIYTDVDGVFTADPRIVPTARKINRIATEEMLEMAANGAKILMLRCVEYARNYDLPIHVRSSFSPHEGTWVTDFPIPAALSSHSPEEPVEQPIISGVAHDRSEAKITVVGVPDNPGTAAAIFKAVAEAEINIDMIVQNVAAGASGRTDISFTLPKAEGATAIAALDKAQAAIGFERVEYDDQIGKVSLIGVGMRSHPGVSATFFDALGSKAINMEMISTSEIRISVVTRLDQLDDAVRAIHTAFGLDTEAEAVVYGGTGR

SEQ ID NO: 29355 - protein, 343 aa, Clostridium difficile 630
MKAVVKTKPGYDNVEVLEVEEPKATGDKVKIKVEYSGICGSDIHSFKGEYANIKAPVTLGHEFSGIVVEVGEDVKNIKIGDRVTSETTFATCEKCIYCETKDYNLCPTRKGIGTQVNGSFAEYVLSREESIHVLPENVSLLSAALTEPLACCVHAALEKTTIESSDTVLIIGPGPIGLLLAQVVKSQGATVIMSGVTKDKERLEIAKNLGVDRTVNVMEESLADVVNEMTDGNGVNKGFDCSGFMPAVNEALRLLRKKGTFVQVGIFAKKLNEMDQEAIIQRELQYIGSRSQKPSSWITALDLMASGKVNTEALVTRTVGLDEFKEGITALMNGEEIKVAVKS

SEQ ID NO: 29356 - protein, 350 aa, Clostridium difficile 630
MKAAVLHGTNDMRFEDIEIKPCESDEVKIKVMAAGICGSDPPRVLKHWKYPVPAIPGHEFSGVIAEVGKDVKNVKVGDRVVAIPFIPCNECEYCKRGLFSLCDDHGMLGAKSFGAFAEYVNIKATNVLPIGDMDFEDAAMIEPLAVAMHGVLNIGVQVGDTVAVMGSGTMGQLVIQGLKIAGAGTIIAVDISDNKLRESKELGADIIINAKDINPVEKIKELTGGKGVDIALECAGSKITQEQCLLITKKKSKIGFLGIAYSDITLSEEAFENIFRKELELKGFWNSYSAPFPGQEWTKGINLVNEGKIKLKEMVSHRFSLEDTYKAFEMIRDRKEEFNKILILPQGVEK

SEQ ID NO: 29357 - protein, 166 aa, Oryza sativa Japonica Group
MGAADDANHRHEEASPLLPPGGGGGGGKKLHQSPPPSPPEAAKCCADGVPVVMGEPLGAPAPPRESWNSGVLSCLGRNDEFCSSDVEGSFEAFTKQCGCCHGLVEDEGNREHLEVACDLATHYFCHPCALCQEGRELRRRVPHPGFNGRSVLVMTPPKEQTMGRGM

SEQ ID NO: 29358 - protein, 400 aa, Xanthobacter autotrophicus Py2
MNIHEYQAKALLKKYGAPVSRGVPVLKVEDAEAAAKELGGPLWVVKSQIHAGGRGKGKFKEPEAGDKGGVRLAKSIDEVKTFVSQMLGNTLVTIQTGPAGKQVNRLYLEDGSDIEKEFYISLLVDRATSHVAFVVSTEGGMDIEEVAHSHPEKIVTFSVDPVTGVQGFHGRKIAKALGLTGDLAKQAGKLAEVLYTAFVDTDMAMLEINPLIITKDAQLRVLDAKVTFDSNAMFRHPELAELRDLTEEDAKEIEASKYDLAYIALDGTIGCMVNGAGLAMATLDIIQLYGESPANFLDVGGGANEEKVTAAFKIITADPNVKGILVNIFGGIMQCDVIARGVLAAVKAVGLEVPLVVRLEGTNVEEGKKIIRESGLNVIPADDLDDAAQKIVAAVKKEAA

SEQ ID NO: 29359 - protein, 401 aa, Salmonella enterica subsp. enterica serovar Typhi str. CT18
MNAFNPTQFRAQFPALADAGVYLDSAATALKPQAVIDATHQFYCLSAGNVHRSQFAQAQRLTAQYEAARAKAARLLNAPDEKSIVWTRGTTEAINMVAQCYARPRLRPGDEIIVSVAEHHANLVPWLMVAQQTGAQVIKLPLNDRRLPDVERLPELITSRSRILALGQMSNVTGGCPDLTGAISAAHAAGMVVMIDGAQGAVHFPADVQQLDIDFYAFSAHKLYGPTGIGVLYGKPELLEAMSPWLGGGKMIRDVSFEGFTTQSAPWKLEAGTPNVAGVIGLSAALEWLSDIDIEQAENWSRGLATLAEDALAKRPGFRSFRCQDSSLLAFDFVGVHHGDMVTLLAEYGIALRAGQHCAQPLLAELGVTGTLRASFAPYNTQHDVDALVNAVDRALELLVD

SEQ ID NO: 29360 - protein, 281 aa, Burkholderia pseudomallei K96243
MTSRLETVALPGGERVPKLGQGTWEMGERPAKRAAEIAALREGVDLGMTLIDTAEMYGDGVTETLVGDALADVRERLFIVSKVLPHHASRGGVVAACEATLKRLRTDRVDLYLLHWRGSIPLAETIAGFEALRDAGKIRYWGVSNFDVDDMEALVAEAGGAVCATDQILYNLARRGPEFDLLPWLARREMPAMAYSPIDHMRLPKRTALDEIARERGVSPTRVALAWVLGQPNVLAIPKAGSVEHVRDNRAALDLVLGEEELARLDAQFKSPRGKRPLEML

SEQ ID NO: 29361 - protein, 334 aa, Prochlorococcus marinus str. MIT 9312
MSSIKSNSIKNIHKLSIAPMMDCTDKHFRMIMRKISSKALLYTEMIVAQSLIYTNEKEKFLDFNNEEHPISIQFGGDNPKILKEGAKMAQDWGYDEINFNVGCPSPRVCSGNFGASLMKDPEKVAKCIESLKNSCSLPVTIKHRIGVDEDDSFVNLNNFVRYIANAGADRFTVHARKAILKGLNPKQNRTIPPLKYDVVKKLKKLNPELLIEINGGFTNINESLEALSNFDGVMIGRSVYKHPLRWSEIDQKVYGINTKPKSASDIIFSLIPYIEEHLSNGGKSWDICKHLINLVEGIPKAKVWRNQISTKSIKKELDIDYLLKLTSRLEEMGY

SEQ ID NO: 29362 - protein, 380 aa, Methanococcoides burtonii DSM 6242
MPSSRLERVEESETIKIANAANKMKSEGIDIISFSLGEPDFNTPDHICKAAADAMYRGDTHYAPSTGIPELREAIANKLQTENKLEVTSDDVLVTPGAKQAIFEVMMSVLDDNDEAILSDPSWVSYSPCIKFAGANPVWAPTDPDNGFMPYGIEELITNKTKLIVVNSPCNPTGGVFDNEMLKTVADLAVDHDLLVLSDEIYEKIIYDKKHISMGSLDGMHERTITVNGFSKAYAMTGWRLGYVTAIPELMKGFKKIHSHSVSSATTFAQFGGVAALEGPQEPVNDMLKEFKARRDILINGLNTIGIKCKRPDGAFYAFADVSEFGDGDAVAEKLLQDAHVAVTPGSAFGLSGKDFVRISYATSQERIKQALQRIEETLL

SEQ ID NO: 29363 - protein, 1066 aa, Arabidopsis thaliana
  misc_feature (1014)..(1014): Xaa can be any naturally occurring amino acid
MESEGETAGKPMKNIVPQTCQICSDNVGKTVDGDRFVACDICSFPVCRPCYEYERKDGNQSCPQCKTRYKRLKGSPAIPGDKDEDGLADEGTVEFNYPQKEKISERMLGWHLTRGKGEEMGEPQYDKEVSHNHLPRLTSRQDTSGEFSAASPERLSVSSTIAGGKRLPYSSDVNQSPNRRIVDPVGLGNVAWKERVDGWKMKQEKNTGPVSTQAASERGGVDIDASTDILADEALLNDEARQPLSRKVSIPSSRINPYRMVIMLRLVILCLFLHYRITNPVPNAFALWLVSVICEIWFALSWILDQFPKWFPVNRETYLDRLALRYDREGEPSQLAAVDIFVSTVDPLKEPPLVTANTVLSILAVDYPVDKVSCYVSDDGAAMLSFESLAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKAKKESDKKKSGRHTDSTVPVFNLDDIEEGVEGAGFDDEKALLMSQMSLEKRFGQSAVFVASTLMENGGVPPSATPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYNGRLKFLERFAYVNTTIYPITSIPLLMYCTLPAVCLFTNQFIIPQISNIASIWFLSLFLSIFATGILEMRWSGVGIDEWWRNEQFWVIGGVSAHLFAVFQGILKVLAGIDTNFTVTSKASDEDGDFAELYLFKWTTLLIPPTTLLIVNLVGVVAGVSYAINSGYQSWGPLFGKLFFAFWVIVHLYPFXLKGLMGRQNRTPTIVVVWSVLLASIFSLLWVRIDPFTSRVTGPDILECGINC

SEQ ID NO: 29364 - protein, 528 aa, Burkholderia pseudomallei K96243
MDKTKQPPRAAKRCCRATLLAAAAFACCCGSYAAAQEAASAAPSTTTQPRDEAPLSAPLQVVQDAISAGTADVSANASADADVAMPLAEVAPPCSAPGACGAELRLAGGMGGNGEGAGAGGIGSGGDNAGSGRGSSGGANDGNGAVGAAGIGVGGTTGSTAGGTAATGRGNSVGNASGGGTSGGGASGHGTSGRGAAGGGASSGGASGGGTSGGGASGGGASGGGTSGGGASGGGASGGGASGGGASGGGASGGGASGGGASGSGASGSGASGGGTSGGGASGGGTSGGGASGGGTSGGGTSGGGTSGGGTSGGGTSGGGTSGGGTSGGGTSGGGASGGGASGGGASGGGTSGGGTSGGGTSGGGTSGGGTSGGGTSSGAGHGGHGGGTGGGGGHSGGHGNGNGGGASGGSGSGNGHGSGNGGGNGNGGGGGNGGGSGNGTGNGGNNGGGHGNGSSGGGTSGGNGHGNGGGTSSGSGNGGGNGNGSGHGNGGGHGNGNGSGGAGNGGANGVGSGNGGHGNGGGHGNGR

SEQ ID NO: 29365 - protein, 268 aa, Salmonella enterica subsp. enterica serovar Typhi str. CT18
MSVVISDAWRQRFGGTARLYGEKALQRFAEAHICVVGIGGVGSWAAEALARTGIGAITLIDMDDVCVTNTNRQIHALRDNVGLAKAEVMAERIRQINPECRVTVIDDFITPDNVAGYMDAGFTYVIDAIDSVRPKAALIAYCRRYKVPLVTTGGAGGQIDPTQIQVADLAKTIQDPLAAKLRERLKHNFGVVKNSKGKLGVDCVFSTEALVYPQADGSVCAMKATAEGPKRMDCASGFGAATMVTATFGFVAVSHALKKIMAKAARQE

SEQ ID NO: 29366 - protein, 448 aa, Streptococcus suis 89/1591
MSNAKAYIQASFEAVKARNPHETEFLQAVEELFSTLEPVFEAHPEYIEENILARIVEPERIISFRVPWTDKDGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYAAEKATAKYFEGSVWNYDGKADIALPCATQNEINGEQAAALVKNGVYCVAEGANMPSDLDAIKVYKENGVLYGLAKAANAGGVAVSALEMSQNSLRLSWTHEEVDGRLKDIMANIFNTAKETAEKYDLGTDYLAGANIAAFEQIADSMIAQGLV

SEQ ID NO: 29367 - protein, 409 aa, Xanthobacter autotrophicus Py2
MTTEIRVPTLGESVTEATIGKWFKKPGDTVKADEPLVELETDKVTVEVPAPAAGVLAEIVAKDGDTVGVGALLGSIGAGSGAAAAAPAAAAPAPAAAAPAPAPAPAAAPAASGSSVNGPAVGRIAAESGVDPSGVAGSGKDGRVTKGDMLAAVAAGAAAAPAAAPIAVRAPSAPIDAVREERVKMTKLRQTIARRLKDAQNTAAMLTTFNDVDMSAVMSLRAQFKDAFEKKHGTKLGFMGFFTKAVIAALKDLPAVNAEIDGQDLVYKNYYNIGIAVGTEKGLVVPVVRDADQLSVAEIEKAIAGFGRKARDGKLGIEDMQGGTFTITNGGIYGSLMSTPILNAPQSGILGMHRIEERPVAIKGQVVIRPMMYLALSYDHRIVDGREAVTFLVRVKETLEDPARLVLDL

SEQ ID NO: 29368 - protein, 245 aa, Bacillus cereus ATCC 14579
MVTTDTIHMLEDKIQFIHQDGKDIYLVGPIKLPINLYGETKIFQWYSWLQCSEVTNSVEGIIKKLSSINLADMQQSSVLVYGDFENSEDALIRMHSICHTGDIFGSKRCDCGFQLKQSLQMITEHGSGALFYLANHEGRGIGLFSKAMTYLLQENGLDTVEANLNLGFEDDVRNYDDTIEVLKALRSKPVKLITNNPKKLEALQKAGLNVTSREPLWGDISEFNEKYLQTKIQRSGHFEGGHLHA

SEQ ID NO: 29369 - protein, 167 aa, Zea mays
AATPKPPALPFRVGHGFDLHRLEPNLPLIIGGIDIPHDRGCEAHSDGDVLLHCVVDAILGALGLPDIGQIFPDSDPRWKGADSSVFMREAVKLMHEAGYELGRLDATLILQKPKISPFKETIRLNLCNLLGADPSVVNLKAKTHEKVDSLGENRSIAAHTVFLLMRK

SEQ ID NO: 29370 - protein, 467 aa, Xanthobacter autotrophicus Py2
MSYDLTIIGTGPGGYVCAIRAAQLGLKVAVVEKRGTHGGTCLNVGCIPSKALLYASELFEEAGHKFGEMGIGVPAPKLDLKAMLAFKDKGVDGNVKGVEFLLKKNKVDVYMGAGKILGTGKVEVTLNADGKVEVLETKNIVIATGSDVAPLPGVTIDEQRIVSSTGALSLPKVPGKLLVVGAGVIGLELGSVWRRLGAQVTVVEFLDRILPGMDSDVAKSFQRILDKQGFAFKLGTKVTGVDTSGKTLKVSVEPAAGGAAEVIEADVVLVAIGRIPYTAGLGLDEAGVAKDGRGRVVTDHHFATNVPGIYAIGDVIVGPMLAHKAEDEGVALAELLAGKAGHVNYDVIPGVVYTFPEVASVGKSEDDLKAAGVAYKVGKFPFTANGRTKVNNTTDGFVKIIADAATDKVLGAHIIGPEAGEMIHECAVLMEFGGSSEDLARTCHAHPTRSEAVKEAAMAVEKRAIHM

SEQ ID NO: 29371 - protein, 219 aa, Escherichia coli
  misc_feature (42)..(42): Xaa can be any naturally occurring amino acid
  misc_feature (90)..(90): Xaa can be any naturally occurring amino acid
  misc_feature (92)..(92): Xaa can be any naturally occurring amino acid
  misc_feature (138)..(138): Xaa can be any naturally occurring amino acid
  misc_feature (174)..(174): Xaa can be any naturally occurring amino acid
  misc_feature (182)..(182): Xaa can be any naturally occurring amino acid
MTQDELKKAVGWAALQYVQPGTIVGVGTGSTAAHFIDALGTXKGQIEGAVSSSDASTEKLKSLGIHVFDLNEVDSLGIYVDGADEINGHXQXIKGGGAALTREKIIASVAEKFICIADASKQVDILGKFPLPVEVIPXARSAVARQLVKLGGRPEYRQGVVTDNGNVILDVHGXEILDPIAXENAINAIPGVVTVGLFANRGADVALIGTPDGVKTIVK

SEQ ID NO: 29372 - protein, 419 aa, Burkholderia pseudomallei K96243
MPYQHIKVPEGGDKITVNKDFSLNVSDQPIIPYIEGDGTGFDITPVMIKVVDAAVEKAYGGKKKIHWMEIYAGEKATKVYGPDVWLPEETLQVLKEYVVSIKGPLTTPVGGGIRSLNVALRQELDLYVCLRPIQYFKGVPSPVREPEKTNMVIFRENSEDIYAGIEWAAESEQAKKVIKFLQEEMGVKKIRFPQTSGIGIKPVSKEGTERLVRKAIQYAIDNDRKSVTLVHKGNIMKFTEGAFRDAGYALAQKEFGAELIDGGPWMKFKNPKTGNEIVVKDSIADAFLQQILLRPAEYDVIATLNLNGDYISDALAAQVGGIGIAPGANLSDSVAMFEATHGTAPKYAGKDYVNPGSEILSAEMMLRHLGWTEAADVIISAMEKSIKQKRVTYDFARLMEGATQVSCSGFGQVLIENME

SEQ ID NO: 29373 - protein, 454 aa, Arabidopsis thaliana
QRTIDGVFNRCCIARINGIMERYKILEELGDGTCGSVYKAVNLETYEVVAVKKMKRKFYYWEECVNLREVKALRKLNHPHIIKLKEIVREHNELFFIFECMDHNLYHIMKERERPFSEGEIRSFMSQMLQGLAHMHKNGYFHRDLKPENLLVTNNILKIADFGLAREVASMPPYTEYVSTRWYRAPEVLLQSSLYTPAVDMWAVGAILAELYALTPLFPGESEIDQLYKICCVLGKPDWTTFPEAKSISRIMSISHTEFPQTRIADLLPNAAPEAIDLINRLCSWDPLKRPTADEALNHPFFSMATQASYPIHDLELRLDNMAALPNLELNLWDFNREPEECFLGLTLAVKPSAPKLEMLRNVSQDMSENFLFCPGVNNDREPSVFWSLLSPDENGLHAPVESSPLSLSFSPMQQHTVGPPQSSGFTMTSSMQPNMLDRPWMAVSAPFQQSHYL

SEQ ID NO: 29374 - protein, 279 aa, Bacillus cereus ATCC 14579
MKNLQSKTVLSNGVEMPWFGLGVFKVEEGPELVEAIKSAIKAGYRSIDTAAIYGNEAAVGEGIRAGIETTGISREELFITSKVWNADQGYEETIAAYEESLKKLKLDYLDLYLVHWPVEGKYKDTWRALETLYKEKRVRAIGVSNFQIHHLQDVIKDAEIKPMINQVEYHPRLTQKELQAFCKEQGIQMEAWSPLMQGQLLDNETLQEIAEKHGKTTAQVILRWDLQNGVITIPKSTKEHRIIANADVFNFELTKEDMEKIDALNQNHRVGPDPDNFDF

SEQ ID NO: 29375 - protein, 656 aa, Streptomyces coelicolor A3(2)
MTILENIRGPRDLKALSEAELGELSDEIRDFLVHAVARTGGHLGPNLGVVELTVALHRVFESPDDRILWDTGHQSYVHKLLTGRQDFSKLRSKGGLSGYPSREESAHDVIENSHASTVLGWADGLAKARQVQGERSHVVAVIGDGALTGGMAWEALNNIAAARDRPLIIVVNDNERSYAPTIGGLANHLATLRTTDGYERALAWGKDVLQRTPVVGHTVYEALHGAKKGFKDAFAPQGLFEDLGLKYLGPIDGHDIGAVESALRRAKRFHGPVLVHCLTEKGRGYEPALRDEEDHFHTVGVMDPLTCEPLGPAGGPSWTSVFGEEIVRIGEERADVVAITAAMLHPVGLAPFAERFPDRVWDVGIAEQHAAVSAAGLATGGLHPVVAVYATFLNRAFDQLLMDVALHRCGVTFVLDRAGVTGVDGASHNGMWDMSVLQVVPGLRIAAPRDADQLRTQLREAVAVDDAPTLLRFPKESVGPAVPAVDRIGGLDVLHTADRSEVLLVAVGVMAPVCLGAAELLEARGIGCTVVDPRWVKPVDPALAPLAARHRLVAVVEDNSRAAGVGSAVALALGDAEVDVPVRRFGIPEQFLAHAKRAEVLADIGLTPVDVAGRIAASLALAEPAGDRAGGPAVEQPGDGRMSGDGRIVMPAQGEN

SEQ ID NO: 29376 - protein, 206 aa, Ostreococcus tauri
MATSLARARARGRSTTTTGATRVSNARRSRVRARASATKPPPLPFRVGHGFDLHRLESTTEFPDLKLIIGGIEIPHDRGCVAHSDGDVLMHCVVDAITGALGLPDIGQLFPDTDPKWKGQTSDVFVQEAIRLMKIEGYSLGNIDCTLIAQRPKISPHKDAIRKNVADVLGVHESVVNVKAKTHEKVDSLGENRSIACHTVVMLIKD

SEQ ID NO: 29377 - protein, 461 aa, Streptomyces coelicolor A3(2)
MTKEFDLAALLAERGAERYELHARHLNHQLPRMLHTIGFDKVYERAEGAHFWDADGNDYLDMLAGFAVMGLGRHHPVVRKALHDVLDASLADLTRFDCPPLPGLLAEKLLSYSPHLDRVFFGNSGTEAVETALKFARYATGRQRILYCPHAFHGLTAGSLSVNGEDGFRKGFAPLLPDTAVPLGDLDALARELKKGDVAALIVEPVQGKGVHEAPPGYLLAAQELLHRHKALLIADEVQTGLGRTGKFYAYQHSDGVEPDLVCVAKALSGGYVPVGATLGKDWIFQKVYSSMDRVQVHSASFGSNAQAMAAGLAVLSVMENEEIVANAAAVGERLKSRLAELVDRYELLADVRGRGLMIGIEFGRPRSLKLRSRWTMLQAARKGLFAQMVVVPLLQRHRILTQVSGDHLEVIKLIPPLIVDTDDADRFVDAFTEVMEDAHHGGGLMWDFGKTLVKQAVANR

SEQ ID NO: 29378 - protein, 126 aa, Haemophilus influenzae R2846
MAYSEKVIDHYENPRNVGSLDKKDSNVGTGMVGAPACGDVMQLQIKVDDNGIIEDAKFKTYGCGSAIASSSLITEWVKGKSLEEAGAIKNSQIAEELELPPVKVHCSILAEDAIKAAIADYKAKQG

SEQ ID NO: 29379 - protein, 388 aa, Geobacillus stearothermophilus
ASPRANDAPIVLLHGFTGWGREEMLGFKYWGGVRGDIEQWLNDNGYRTYTLAVGPLSSNWDRACEAYAQLVGGTVDYGAAHAAKHGHARFGRTYPGLLPELKRGGRVHIIAHSQGGQTARMLVSLLENGSQEEREYAKEHNVSLSPLFEGGHRFVLSVTTIATPHDGTTLVNMVDFTDRFFDLQKAVLEAAAVASNAPYTSEIYDFKLDQWGLRREPGESFDHYFERLKRSPVWTSTDTARYDLSVPGAETLNRWVKASPNTYYLSFSTERTYRGALTGNYYPELGMNAFSAIVCAPFLGSYRNAALGIDSHWLGNDGIVNTISMNGPKRGSNDRIVPYDGTLKKGVWNDMGTYNVDHLEVIGVDPNPSFNIRAFYLRLAEQLASLRP

SEQ ID NO: 29380 - protein, 258 aa, Ostreococcus tauri
MPAGVDGVSEPSRTSRRRVATTTETRPRANDDVRSNARGKCLCREVLSAAASRCKEPASNAYATYNCSRVSDILNATSGKHRAFGKSHWIDGEARVSEAVRQMHATDLGALVVMDRIALDADATGVISDEELALSAENDAIIGIFTERDYLNAVAKGVISPKTKVSEIMTGFRDASTQVSRLVCVSPQDTALAAMESMTTHRLRHIPVISSKGIDSKTKTPIEPRVLGVVSIGEVLKALLAESRSEIEHLESYILGLE

SEQ ID NO: 29381 - protein, 106 aa, Brassica napus
  misc_feature (15)..(15): Xaa can be any naturally occurring amino acid
  misc_feature (24)..(24): Xaa can be any naturally occurring amino acid
  misc_feature (26)..(27): Xaa can be any naturally occurring amino acid
  misc_feature (82)..(82): Xaa can be any naturally occurring amino acid
LDIGKERKEAWIKWXQAYIQEVSXSXXSDEERKARMDSVNPKYILRNYLCQSAIDAAEQGDFSEVNNLIRLMKNPYEDQPGXMEKYARLPPAWAYRPGVCMLSCSS

SEQ ID NO: 29382 - protein, 584 aa, Coccidioides immitis RS
MPSSVPAREDVRSPLLTENSRRSGEVWEDATAIARQSDKEGESKSSWYLFLLTLSIGGLQIVWSVELSNGSPYLLSLGMSKSLLAFVWIAGPLTGTLVQPYVGIRSDNCRVPWGKRKPFMIGGGIATVISLMALAWVREMVGGVLGIFGAGAQSQGVKVTTIVVATLFMFCLDFAINTVQAAIRAFIVDNAPAHQQESANAWASRLTGIGNILGYISGYLDLPKVLPFFGNTQFKVLCVIASLALGTTLLISCLYIQERDPRLEGPPRSKNPGVICFFKQVFASIKRLPPQIRKVCEVQLCAWLYVNPIFDQHPDLPEDAISAIWEEATRVGTFALLAYAVTSFVASMVLPLLVVPTYRPALAQDSDTDTTSSDRPYLSRHPSTSTLSFTASAGAAIETSHEAVQPSEKYNVLSKLQIPGLTLRRLCTFLIYSPQAGTVVIAIVGISWALTLWAPFAFISAEVAKSDAENRERRHQLRQGIPDLSHGHPGSECDENGSSEEKVDQAGVILGIHNVAISFPQIASTLISSAIFKALQKPRGEPWDDSVGWVLRFGGCAALGAAYITTRLGEGAGGKTSGENGDMA

SEQ ID NO: 29383 - protein, 284 aa, Borrelia burgdorferi B31
MDWDFEKIIFLLNESTRLALSGCAKLILDFKSDGSIVTQVDKQIEQFLFKEIKKPGNFVLGEETISTYKEEYIKDALISESTFIIDPIDGTSSFAAGLPSYGISLAYASGGKIIEGAISLPLSGEFFITSKDNVFYAKKNIGSYPLKKDFNKFIFDNSKCYNIHSLLAVSRSIIRLFNLDISSHIHINGSCVYSFAKLFTGSYKAYFSFVGLWDIAACLAIGNKLGMVGEFYCGNKMTLDILDSMYILEPNNHKRWSLKDFFIYSDNKSTIDIIRKDANKKINK

SEQ ID NO: 29384 - protein, 436 aa, Cunninghamella elegans [sequence omitted]

SEQ ID NO: 29385 - protein, 474 aa, Salmonella enterica subsp. arizonae serovar 62:z4,z23:--
MQYQLLINGALVNGEGERQSVYNPATGEVILEIAEASPKQVDAAVLAADNAFTAWGQTTPKVRAECLLELADSIKQNALQLAKLESQNCGKPLHCVINDEIPAIIDVFRFFAGAARCLNGLAAGEYLEGYTSMIRRDPVGVVASIAPWNYPLMMAAWKLAPALAAGNCVVIKPSEITPLTALKLAALAKDIFPPGVINVLFGRGQTVGDALTGHEKVRMVSLTGSIATGEHILRHTAPAIKRTHMELGGKAPVIVFNDADLDAVAQGIRTFGFYNAGQDCTAACRIYAQRGIYDTLVEKLGQAVSSLKMGAPEDESTELGPLSSQAHLARVTAAVEEAKALSHIRVIAGGRQTGGKGYYFAPTLLADAKQEDAIVQREVFGPVVSITAFDDEEQVLRWANESRYGLASSVWTQDVGRAHRLSARLQYGCTWVNTHFMLVSEMPHGGQKQSGYGKDMSLYGLEDYTLVRHIMIKH

SEQ ID NO: 29386 - protein, 525 aa, Bacillus subtilis subsp. subtilis str. 168
MNKSVIGTKQMVVSPHYLASQAGNRILDKGGNAFDAAVAVSACLAVVYPHMTGLGGDSFWLTFHQETKAVKVYNGSGRSGKNVTRDVYKGKSAIPLRGIDSAITVPGMVDSWDAVLKEYGRLSLADVLEPARDYAQNGFPVSADQCRHTEKNIELLASTPYTADIFTRRGKAPVPGERFVQKELADSLNLIAEKGRSAFYEGDLAQRIVSHLQNNGSYMTIDDFKAHRGEWAAPVSSDYRGYSVYQAPPNSQGFTGLLTLNILENYDFTQIEHGSFEYYHVLVEALKKSFLDRDAVLTDPAFADIPLERLLDKRYAKQLAEEIGYLAIPAESRPVGSDTAYAAVIDADGNAVSFIQSLYFEFGSAVTAGDTGILLQNRGSFFSLDENHVNTLEPRKRTFHTLMPAMVCKGGKPKILYGTQGGEGQPQTQTAIITRMLDYGMHPQQAISEPRWVWGRTWGEEYEGLRVEGRFTDKTIQKLKDSGHLVEVVGDYDPLMGQAAAIKVDEEGFLQGGADPRGDGAAVGI

SEQ ID NO: 29387 - protein, 304 aa, Brassica napus
MASIAATGVLKVPPPAAASCEAVPTMTLSFSSSVSLRATVSHRRGSVLSRNRVRNPMIVSPKAVSDSQNSQTCLDPDASRSVLGIILGGGAGTRLYPLTKKRAKPAVPLGANYRLIDIPVSNCLNSNINKIYVLTQFNSASLNRHLSRAYATNMGGYKNEGFVEVLAAQQSPENPNWFQGTADAVRQYLWLFEEHNVLEYLILAGDHLYRMDYEKFIQAHRETDADITVAALPMDEERATAFGLMKIDEEGRIVEFAEKPKGEQLKAMKVDTTILGLDDKRAKEMPYIASMGIYVVSKDVMLEL

SEQ ID NO: 29388 - protein, 500 aa, Agaricus bisporus
MPSIFTHQWDTPVYKGSTSINTGLFINGEFVDGVKNTTIDVVNPANGKLITKISEATEADIDIAVEAAHKAFETTWGLNCSGSKRGDMLYKLAQLMEKNIDDLSAIEALDNGKTFLWAKSVDLSLSISTIKHYAGWADKNFGQVIETDEKKLTYSRHEPIGVVGQIIPWNFPLLMLAWKIGPALATGNCIVLKPSEFTPLSALRMCALIQEAGFPPGVVNVVTGYGSTTGQAISSHMKIDKVAFTGSTLVGRKVMEAAAKSNLKNVTLELGGKSPVVIFDDADLEQSVNWTAHGLFWNHGQACCAGTRIFVQEGIYDKFLQKFTDKIKEIKLGDPFGLGIDQGPQVSQIQYDRIMSYIESGRAEGATVHVGGERHGNEGYFIQPTIFTDTTPDMKIVKEEIFGPVGAVIKFKDGKEVIKQANDSNYGLAAAVFSQDINKAIETAHAFKAGTAWVNCANTIDAGVPFGGYKQSGIGRELGEYALHNYTNVKAVHVNLNWKM

SEQ ID NO: 29389 - protein, 452 aa, Triticum aestivum
MATTAAAAAAAAATASTRANSLSRIFSSSSPIVQPPKRNPKTKSAPKPKPTPKPPAADAVSIADEKPPKPLGAQPAAKGDSDGKHKLPKPLGLLVKALSRQRDPDKLISGFIQASTVSSRFRDRHRVFEIAVSRLTSLGRQDGIEAIIEAQMPFLETSAEGFASRLIRLYGRASMPSHAAATFHKLPAQHKSNMTFNSLLSCYADAGDFDGLTAAFQEIPATYPSIVPTVYSYNVLIHALCRKPDVSAALDAVHLMEKIGVSPDIITFNTLLNGFCNNGRLDEAETVWEMIKERNLEPDAKCYNAKLRGLVAEGRIDDAAAVLEGLEKDGPKPDTVSYNELIRGYCKAGKLQEAKKLYDDLVKNECAPNKGTYETLLPHLLQAGELDCALTYCYKIFSHKRNLRVECGVLQDVVNALVDVLRVEEAAKIIVLGRKKYYPRKGLRMPDSTKRQ

SEQ ID NO: 29390 - protein, 517 aa, Zea mays
MSGGSDVSSPSSGRISTSSLSDLKDLELSSESGCLSIVVLGASGDLAKKKTFPALFNLFQQGFIQSGEVHIFGYARSDISDEGLRERIRGYLKGASDEHLSQFLQLIKYVSGSYDNGAGFELLNKTISENETSENNQPGNSRRLFYLALPPSVYPSVCKMIRSYCMTPSSHTGWTRVIVEKPFGKDLDSAEELSAQLGELFQEEQLYRIDHYLGKELVQNLLVLRFANRLFLPLWNRDNIANVQIVFKEDFGTEGRGGYFDQYGIIRDIIQNHLLQVFCLVAMEKPVSLKPEHIRDEKVKVLQSVEPIKHEEVVIGQYDGYKDDPTVPDDSNTPTFASVVLRVHNERWEGVPFILKAGKALNSRKAEIRVQFKDAPGDIFRCKKQGRNEFVIRLQPSEAMYMKLTVKKPGLEMATEQSELDLSYGMRYNGVKIPEAYERLILDTIRGDQQHFVRRDELRAAWEIFTPLLHDIDGGKLRSVPYKPGTRGPQEADELSRRMGYVQTHGYVWVPPTLSKV

SEQ ID NO: 29391 - protein, 295 aa, Actinobacillus pleuropneumoniae
MKVIIPVAGLGTRMLPATKAIPKEMLTIADKPLIQYIVNECVAAGIKEIVLVTHSSKNAIENHFDTSFELETMLEKRVKRQLLEEVRSIVPKDVTLMHVRQGQAKGLGHAVLCGRAVVGNEPFAVVLPDVILADFTANQKTENLAAMIKRFNETQHSQIMVAPVPREDVSSYGVADCDGVEIPAGETAKIVKMVEKPSVEEAPSNLAVVGRYVFSAGIWDLLEKTPVGVGDEIQLTDAIDMLIEQETVEAFHMTGRTFDCGDKLGYMQAFTEYSLRHDKFGNNFKEFIKKLAKTL

SEQ ID NO: 29392 - protein, 695 aa, Mycobacterium avium
MADISAIYVAAPEPETGKSTVALGLLHRLTATVAKVGVFRPITREGQDRDYILELLLSRTTAGLSYQQCVGVTYQQLHADGDAAIATIVDAYHAMAELCDVVVIVGSDYSELGQAIRPAELSTNARIAVNLGAPILLTVSGKGRTAAEVATVVQVCLAELDAQHAHTAAVVANRCEPAELDAVAEALRGFPQRCYVLPDEPLLSAPTVAELEKAVAGSPVSGEESLREREVTGILVAGMTADHVLERLADGMAVITPGDRSDVVLAVASAHAAEGFPSLSCIVLNGGFALHPSIAALVAGLRLRLPIVATALGTYDTASAAAAARGRVTATSQRKIDTALELMDRHVDIADLLEQLAIPIPTVTTPQMFIHQLTLQARADRKHIVLPEGDDDRILRAAGRVLQRRVADLTILGDEARIRQRSGELGVDLSDVKVIDPRTSALRPEFAQQYAQLRKAKGVTVEQAREIMRDATYFGTMLVYTSQVDGMVSGAAHTTAHTVRPAFEIIKTVPDVSTVSSIFLMCLPDRVLAYGDCAIIPNPTPEQLADIAISSARTAAQFGIEPRVAMLSYSTGDSGTGADVEKVRTATQLVRQRNPDLPVEGPIQYDAAIEPSVAATKLRDSPVAGRATVLIFPDLNTGNNTYKAVQRSAGALAIGPVLQGLRKPVNDLSRGALVEDIVNTIAITAIQAQGLPGGR

SEQ ID NO: 29393 - protein, 458 aa, Burkholderia pseudomallei K96243
MTQQQRTFDSIVEREKGLRRGLSSAQMAMIAIGGAIGTGLFLGSGFAIGLAGPGVLVSYAIGALIALLLMGALAEMTVAHPTSGSFGAYAEHYVGPLAGFLVRYAYWSAVVFAVGTEVSAIAVFMKYWYPGVPGWYWVVGFSAVLIAVNMTSVTLYGVVEYVFSMLKIAAIVAFIALGAYFVAAAPVSSGIGFANYSAHGGFFPKGFSGVWVAVIVAIFSYMSIETVAIAAGEARDPQRAVSRAFRSTVFRLVLFYLLTLALMLAIVPWTQAGTDESPFVKVMAATHVPYAAGVINFVVLVAALSAMNSQLYVTTRMMFSLSRARLAPAMFGRVGANGVPLAALAVSSSGVAVAAVLVALYPQTAFTLLMAIAMFGALFTWLMIFVTHLRFRARYRGPTPVFRMWLHPAGSLTGAALVGAVLVTTAFTREFRMTMMVGVAFIVLLTLAYRWHYRARHA

SEQ ID NO: 29394 - protein, 486 aa, Pseudomonas putida
MKEIKHFISGELVGSASGKLFDNVSPANGQVIGRVHEAGRAEVDAAVRAARAALKGPWGKMTVAERAEILHRVADGITARFGEFLEARMPGHRQAEVAGQPHRHSARRANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKPREKVPSYYQQAVDDGATVVTGGGVPEMPAHLAGGAWVQPTIWTGLADDSAVVTEEIFGPCCHIRPFDSEEEAIELANSLPYGLASAIWTENVRRAHRVAGQIEAGIVWVNSWFLRDLRTAFGGSKQSGIGREGGVHSLEFYTELKNICVKL

SEQ ID NO: 29395 - protein, 353 aa, Thermotoga naphthophila
MRHKIRLIDFILLRFIEERMKVARDVAKEKKKTDSPIDIRDIEEQKIKEILDRTDLNPVRMRRIFEEIMKLAKEEEYRLLGISKTVAVLGPMGSFSDEMAMKLIGSRIPLKYCSTTDEIIEMVEKGEVDYGIVPIENSTYGTVIPVLDALLNHEVEVFGEAKLEIHHCLVSKKKLDLKEIKRIYSHPQAISQSLGFINTYLSHAEIRYTSSTSDAVNLLDDESAAIMSENAARMYGLLILRRSIQDLKEKNITRFYIIRRKTGKMEGRYTSLFFGVQDRPGSLKAVLDIFANRGINLRKLESRPARTFLGDYVFFVEVEAPLKEEDIRDLEKVTAFYKIIGVFDEVEELDVFK

SEQ ID NO: 29396 - protein, 327 aa, Triticum aestivum
MAATGGSDEEVYFDFFPLVRQYKSGRVERFFNFPPIPAGVDPATGVTSKDVVIDPANGLWARVFLPPGAAGRLPVLVYFHGGAYVIGSASDPMTHNYLNGLVAAANVLAVALEYRLAPEHPLPAAYDDSWEGLKWVASHATAGAGAADGAEPLLVDHGDFSRVFLAGGSAGGTIAHVMAVRAGEQGALPGGVGIKGTIVVHPYFSGAAEIGKEATTGKAEKAKADAFWRFLYPGSPGLDDPLSNPFSEAAGGSAARIAGDRVLVCVAEKDGLRDRGVWYYESLKACGYGGEVELLESMDEDHVFYCMKPRSEKAIELQDRILGFLRK

SEQ ID NO: 29397 - protein, 224 aa, Zea mays
MEQTFIMIKPDGVQRGLFLAQIGDIISRFEKKGFYLKVIRMNFSAVEARFDVQILSNREVDKNHRSALLLEKKRKKRILGHGFQKQIFLPTVCAFHQVSNIPFPFQRQGMKFMNVERSFAQQHYADLSDKPFFPGLVEYIISGPVVAMVWEGKDVVLTGRRIIGATRPWEAAPGTIRGDYAVEVGRNVIHGSDSVENGKKEIALWFPEGVAQWKSNLHPWIYEA

SEQ ID NO: 29398 - protein, 285 aa, Glycine max
SRHILEECEELSSPRRHEDNDVDGPLRRHEISHEDHPLSLGKASLWSQYFQYTEIVEQIDRDLQRTHPDLPFFSGESSISCKNRSMKNILLLFAKLNPEIRYVQGMNEVLAPIYYVFSTDPDKQNAANVEADSFSCFVRILGDSVDHFCQQLDNSSSGILATLSRLSDLLEVNDEQLWRHLELRTKVKPQFYAFRWITLLLTQEFKFESILRIWDTLLSNPFGVQDMLLRICCAMLLCVKSKLLSGDFVTNIKLLQHYPDDINVEYLLQVAKDISPDTSNYCLSL

SEQ ID NO: 29399 - protein, 284 aa, Griffithsia japonica
  misc_feature (208)..(208): Xaa can be any naturally occurring amino acid
  misc_feature (224)..(224): Xaa can be any naturally occurring amino acid
ARGVGILADDTDPMVSVMKVDKAPLESYADIGGLETQIQEIKEAVELPLTHPELYEDIGIKPPKGVILYGEPGTGKTLLAKAVANSTSATFLRVVGSELIQKYLGDGPKLVRELFRVAEDMAPSIVFIDEIDAVGTKRYDTTSGGEREIQRTMLELLNQLDGFDSRGDVKVLLATNRIETLDPALLRPGRIDRKIEFPLPDEKTKRRXFSIHTGRMTLAGDVNXEEFVMNKDELSGADIKAICTEAGLMALRERRMKVMHADFKKARENVLYKKNQGVPEGLYL

SEQ ID NO: 29400 - protein, 462 aa, Mesorhizobium sp. BNC1
MATPTDLVAASFRPPAPSPRQTPPSTLQMMRIVYRNPLELWGEPSYNEPWVQLTGGIGGPLLIANDPGLIRHVLVDNARNYKMARVRQKILRPILRDGLLTAEGEVWRRSRKAMAPVFTPRHISGFAGPMLQKAEAFAERYEQAIGGTVDVSRDMTMLTFDILSETLFSGEVAGDPGGFAHQVDRLFETMGRVDPLDLLGAPDWLPRITRILGRNSLAFFRNIVARTMEMRKEKLAGGDAEVPEDFLTLLLRAEGPQGLSRGEIEDNIITFIGAGHETTARALGWTLYCLANLPEERERIEAEIDSVLSSEPDPVKWLDAMPLTRAAFEEAMRLYPPAPSINREAIENDSYSDLKIAAGTQVLVMPWTVHRHRKLWDDPDAYRPSRFHPENREKINRFQYLPFGAGPRVCIGATFAMQEAVIALAVLMSRYRFDLLPETKPWPVQKLTTQPQGGLPMGVSRR

SEQ ID NO: 29401 - protein, 340 aa, Vibrio sp. Ex25
MTKYEQIQQELVESPKTWLVTGVAGFIGSNLLEKLLKLDQTVVGLDNFATGHQHNLDEVKGLVSEAQWDRFTLIEGDIREPKTCQQAVKGVDYVLHQAALGSVPRSIADPLTTNAANITGFLNMLDAAKEERVSSFTYAASSSTYGDHPALPKVEENIGNPLSPYAVTKYVNELYAGVYARTYGFKTIGLRYFNVFGRRQDPNGAYAAVIPKWTAAMINGEDVYINGDGETSRDFCYIDNVVQMNLLAATAKEDAKDEVYNVAVGDRTTLNELYYAIKNALNDNGVLVDAEPKYRDFRAGDVRHSQAEISKAKNKLDYLPEFKVLKGISVAMKWYKNEVL

SEQ ID NO: 29402 - protein, 415 aa, Oryza sativa Japonica Group
MKHNNLLVRRAASTTGLLLILLLLVAFTVCNYSSLKLSTRQYIDGTSARSSSTRASYASGGGGGAACDVARGEWVPDPAAPYYTNETCPLIDSRQDCMKYGKPGLESILRWRWRPHGCDLPRFDAAAFLRLVRGKSMAFVGDSVARNHMQSLMCLLSKVEFPTEIEAKDCIHCTRKYHYRAHNFTVCVFWAPFLVRWNLTRAGALQFMDPHNVFLDEADPEWSRGVAGYDYVVLNGAKWFTRPTILYEGGRLVGCNNDCHGGDPNATAATAPPDYAVRASFRTALRALREHPVFRGTVIVRTVAPPHYENGKWYDGGNCLRTRPMRSDETGLPETEAAFHAAQVEEFRAAAAAAAGGRFLLMDVSGMMQMRGDGHPGQYGHWPHEKVGFGIDCVHWCLPGPVDAWNELLLHLLRG

SEQ ID NO: 29403 - protein, 426 aa, Vibrio sp. Ex25
MNFSLENARVGIIGLGYVGLPLAVEFGKKSPTIGFDINQDRIDELSAGRDSTLECSDNELAEAKYLSYTSSLQELKECNVYIVTVPTPIDEHKQPDLTPLIKASEALGTVVNQGDIIVYESTVYPGATEEDCIPVVERVSGLKFNQDFFAGYSPERINPGDKEHRVTNILKVTSGSTPEVAEFVDQLYKTIITAGTHKASSIKVAEAAKVIENTQRDVNIALINELSIIFNKLGIDTLEVLEAAGTKWNFLPFRPGLVGGHCIGVDPYYLTHKAQAVGYHPEMILAGRRLNDGMGQYVVSQLVKKMLKKRIHVEGANVLVMGLTFKENCPDLRNTKVVDIISELKEYNINVDVMDPWCSNDEAQHEYGLTLCEKEKQGHYDAIIMAVSHNEFKEMGVEKIRTLGKPEHVLYDLKYVLDKESVDMRL

SEQ ID NO: 29404 - protein, 735 aa, Coccidioides immitis RS
MMASVLQDLAWGSLRKRMEEETDPDESPEAGEQEFWTSWALFILILLLIAALFTSYMLKQKRVQAVHETVLSIFSGMVVGLIIRVSPGTLIQKSVSFNYQFFFNLLLPPIILASGYELHQANFFRNIGAILTFAFAGTFISALVLGLILYLWTRIPLDGLNISFVEAISVGATLSATDPVTILAIFNVYKVEPKLYTVIFGESILNDAIAIVLFETAQRYKPGSTAGSLTVLSLFEAIGIFLLVFFGSLLIGVVVGVVTALGLKYTHVRREPKIESCLIVLVAYASYFFSNGVHMSGIVSLLFCGITLKHYAYYNMSRRTQLTTKFIFQILAQLSENFIFIYLGLDLFTEENLQFKPLFILVTVVGICVARYMSVFPLSKAINWFIRYRARRRGKDVADELPFSYQAMLYWAGLRGAVGVALAAGLEGTNAPALRATVLVVVVLTVIIFGGTTARMLEILDIRTGVAEEVDSDDEFDIEMTDGGTYYKRSGTGIGHTPRRSDFTIPLDSVHITNGLDSSPHAGESYATSRHSGPSPQPGDGRGNLASRKPAGYNQRDRNPRSRDAASSQALLGSRSVSQNGSASGSSADEAAMHSRNRATSRAASKALADTDPDLEDFDLELDSISDDDHLPPAAPSHRASRTPSRLSTRAPHEPSPVSGQAASSSSPAPAVTAGQAQSQQGRPIFSGATSAFRDLLSGAGSRDHAEWFKQLDEEYIKPKLLLDQGSGHKEPGAA

SEQ ID NO: 29405 - protein, 192 aa, Ostreococcus tauri
MSGTSSDVATGGVFSAVHRVKDSAVHVWGQQRPMSEVLDASAYSRPANFGDATSRMQKNLNYFRINYLVFTCAVLSLFVLFHPSSLAVFGGVAAAWAYVFAVRSEPLKIGDRELSHREQLMGMTALSAFVIFMLTSAGTVLFSGMGVALLGIGAHAAARVPDDLFVEDAESNKGFFSFLEPPARNGVSSGTV

SEQ ID NO: 29406 - protein, 189 aa, Staphylococcus aureus subsp. aureus Mu50
MSLINKEILPFTAQAFDPKKDQFKEVTQEDLKGSWSVVCFYPADFSFVCPTELEDLQNQYEELQKLGVNVFSVSTDTHFVHKAWHDHSDAISKITYTMIGDPSQTITRNFDVLDEATGLAQRGTFIIDPDGVVQASEINADGIGRDASTLAHKIKAAQYVRKNPGEVCPAKWEEGAKTLQPGLDLVGKI

SEQ ID NO: 29407 - protein, 248 aa, Oryza sativa Japonica Group
MWWWPAFLYPPPAPAFVAAASVAQFALLANAGLGELRGEHMAYSKFWQVVAGKKKNGGGGGGGALLPSRQGMLVAYVPAFVAAAASFAVPGAVVGVRAQVLSAALTVHFLKRILEVLFIHQYSGSMPLNTAATISSSYLVITATMIYAQHLAAGLPDPPNAAGGSGGGERQYRIPTGGLFGLAACPHYLFEIVGFFGFAMIAQTAHALAVASGTVAYLAGRSCATRRWYESKFEDFPDSIKALVPYIL

SEQ ID NO: 29408 - protein, 363 aa, Haemophilus influenzae R2846
MGFKCGIVGLPNVGKSTLFNALTKAGIEAANYPFCTIEPNTGVVPMPDPRLDALAEIVKPERILPTTMEFVDIAGLVAGASKGEGLGNKFLANIRETDAIGHVVRCFENDDIVHVAGKIDPLDDIETINTELALADLDSCERAIQRLQKRAKGGDKEAKFELSVMEKILPVLENAGMIRSVGLDKEELQAIKSYNFLTLKPTMYIANVNEDGFENNPYLDRIREIAEKEGAVVVPVCAAIESEIAELDDEEKVEFLQDLGIEEPGLNRVIRAGYALLNLQTYFTAGVKEVRAWTVSVGATAPKAAAVIHTDFEKGFIRAEVIAYEDFIQFNGENGAKEAGKWRLEGKDYIVQDGDVMHFRFNV

SEQ ID NO: 29409 - protein, 124 aa, Triticum aestivum
  misc_feature (45)..(45): Xaa can be any naturally occurring amino acid
  misc_feature (82)..(82): Xaa can be any naturally occurring amino acid
MAARLAQLRTKAAQAAEFASKHGGAYYKEAMEKNKQYVVQPPSVXEKCQELSKQLFYTRLASLPGRYEALWKEVDGVKQLWXKNRKELKVEDLGIATLFGVELYAWFCVGEIAGRGFTLTGYKV

SEQ ID NO: 29410 - protein, 363 aa, Streptomyces coelicolor A3(2)
MRRARAAVVREPGAPFTVLEVELEDPRPREVLVRMTAAGVCHTDLGIQAGWPRRLTPMVFGHEGAGRVEAVGAEVTGLVPGDTVCLTFASCGGCGQCTAGHPAYCDAARDLNLSGGRGDGSTPLRLDGAPLHGGFFGQSSFATYAVVHEHGVVRVPADLPATLAAPLGCGGQTGAGTVLNRLRPEPGTSLVVLGAGGVGLSALMAAVAVGCDPVLAVDPVASRRDLARALGARAALPPDDALVAAVRQLTDGGAHHVVDTTGRPGMLDRAVAALRPRGALALLGLGGEVTFDMMRLMTKGVRLHGVMEGDSDPARFVPELIALHRRGLFPVDRLVTTFAFEEIGAAVAAMRDGSAVKPVLTFS

SEQ ID NO: 29411 - protein, 352 aa, Triticum aestivum
PRVRLSAHKGVNLPNTPVDLPALSEKDKADLRFGVEQKVDFIFASFVRRGQDVRDIRKVLGPDGKNIKIISKIENHQGVENFDDILAETDGVMVARGDMGIEIPLERVFIAQKMMITKCNLAGKPVICATQMLESMTYNPRPTRAEVSDVANAVLDGADCVMLSGETAKGNYPVDAVKTMHDICKLAESVLCYPAIFNELRNLTELPTETTETVACAAVAAAHEQNAGCIIVLTTSGNSARLISKYKPNAPIVVVTRNPQTARQIHLYRGCFPFLYPKASSAITSLLNSSSQGHLSPVENAPWQEDVDHRIRWGMEQAMKYGLLSRGQPVVAVQGWRGGLGNTNTLRIIYAP

SEQ ID NO: 29412 - protein, 499 aa, Mycobacterium smegmatis str. MC2 155
MTTGTTGTTGTFPRDELHGTPTRDIINPATGAVITTVPEHGAAEVDAAVARARAAFENGPWPRLARSERARLLLGIADAIEADSERLYTLEARNNGRPITETRAQLSRVPEWFRYNAGLLAAQRTAVLPGDGPYVTYQQRRPLGVCGIITPFNHPMLILARSLSAALANGNTVVVKPSEMTPLTTLALAEIIAAAAIPEGVVNVVTGGRPAGERLTEHPDVAKITLTGGTEAGRSASIATAARFARITAELGGKTPIAVFDDVDPRIAAEGAAFAAFVAAGQSCVAGSRFLVQRGIYDAFVDALSARADAIRLGDPELATTQMGPLISARQRDKVRALIDAGLAEGARLAAGGAIPDLPAPFDGGFYLRPTVLADATIDMTVSRQEIFGPVAVIVPFDTEADAVAMANDNRYGLGAGVWTVDVGRAHRVAAGIDAGMVWVNDHHRLEPSLPWGGIKESGSGKDAGTESFDDFSWIKTVVVRTAAEPVDWYGGEPQSRLN

SEQ ID NO: 29413 - protein, 265 aa, Oryza sativa Indica Group
MGCVSSKQFKRAAQHEDPAILAKETTFSVSEVEALFELFKKISHSIFRDGLIHKEEFQLALFRNSNKKNLFANRNLFLCENADSVSPQVQIFDLFDLKRNGVIDFGEFVRSLSIFHPETPLGDKIALFFFVVAFRLYDLRGTGCIEREELHEMVLALLNESDLFLSEEAVEQIVDQTFKQADLNDDGKIDPDEWKTFASKNPALLKNMTLPYLKDITMVFPSFILNSEVCHDDISDGSQKLRCIVFGRVSGRACLAQLQLQLHPS

SEQ ID NO: 29414 - protein, 488 aa, Coprinopsis cinerea
MGSAQSKQDGNPDRLKRISAAFKKPRSSEESTRPQAPPPPPVAAPAAQVSDAGSANESHLKKGGDNDERAVMHDSVQRNAPHPALKQPQQPQNQQGQPMPATVPCQYRTGKTLGSGTYAIVKEAIHITTGKYYACKVINKKLMEGREHMVRNEIAVLKKISSGHPNIVTLHDYFETAHNLYLVFDLCTGGELFDRICAKGNYYEADAADLVRTIFKAVEYIHNSGVVHRDLKPENLLFKTQAEEAAIMIADFGLSRVMEEEKFSLLTEICGTPGYMAPEIFKRTGHGKPVDVWAMGVITYFLLAGYTPFDRESQQQEMEAIIAGDYKFEPAEYWENVSETAKDFVRTCLTIDPNKRPTATEALAHKWLADKEPHFVANPADGTPADLLPNVKRAFNAKRAWKKAAYGIRAMNRMASLASGGLTNPEAALMRENLDKYKAESEKEDIQTASITYMPQHTPVTAEFPAGSQKSATDDELQKKLANATIQG

SEQ ID NO: 29415 - protein, 781 aa, Kineococcus radiotolerans SRS30216
MPPTVPELSSSAQGIALAVAVTALLSLVAAWVFRRQVLQAGEGTARMQEIAGAVQNGAAAYLRRQFRTLAWFAVAVLLLLLALPADGWDLRIARSAAFVLGAVFSAAIGYLGMSLAVRANVRVAAAAREGAGGRERGMRIAFRTGGVVGMTTVGLGLLGASVAVLAFGADAPTVLEGFGFGAALLAMFMRVGGGIFTKAADVGADLVGKIEQGIPEDDPRNPATIADNVGDNVGDCAGMAADLFESYAVTIVAAVILGSAAVGETGLVLPLLVPAIGAITAALGVVLVRARPGTSGLTSIQNGFYLSAAVALAGTAIACFAYLPATFAEFSGADESVAGLNGDPRVIAFAAVLLGILLAVLILAITGHYTGTEAKPTRDVADASTTGAATVVLSGIGLGLESAVYTTLVIAGAVFLAFLLAGGVLALAMFLVALAGCGLLTTVGVIVAMDTFGPVSDNAQGIAEMSGDVDAEGAAVLTELDAVGNTTKAVTKGIAIATAVLAATALFGSYQEAVVNRINEVAVAIETPSQYLQRTIGDFSVSTPTTLVGVLLGAAAVFLFAGLAINAVGRSAAAVVLEVRRQFADHPGIMDGTEQPDHGRVVDLCTRDALRELATPGLLAAFAPIAVGFGLGVAPLAGFLGGAIAAGVLMAVFLSNSGGAWDNAKKLVEDGLHGGKGSAAHEATVIGDTVGDPFKDTAGPSINPLIKVMNLVALLIAPAVVTLSIGAEANAAARYGIAAAATVVIVVAVVVSKVRRVDMAAPTGPATGVDLRSGDSAERLP

SEQ ID NO: 29416 - protein, 440 aa, Bacillus subtilis subsp. subtilis str. 168
MNITVIGTGYVGLVTGVSLSEIGHHVTCIDIDAHKIDEMRKGISPIFEPGLEELMRKNTADGRLNFETSYEKGLAQADIIFIAVGTPQKSDGHANLEQITDAAKRIAKHVKRDTVVVTKSTVPVGTNDLINGLITEHLAEPVSISVASNPEFLREGSAIYDTFHGDRIVIGTADEKTANTLEELFRPFQIPIYQTDIRSAEMIKYASNAFLATKISFINEISNICEKVGADIEAVAYGMGQDKRIGSQFLKAGIGYGGSCFPKDTNALVQIAGNVEHDFELLKSVIKVNNNQQAMLVDKALNRLGGVTGKTIALLGLSFKPNTDDMREAPSIVIADRLAALDARIRAYDPIAVSHAKHVLPQAVEYKETIEEAVKGSDAVMILTDWADIKQFPLAAYQDLMETPLIFDGRNCYTLDEALAAGVEYYSVGRKAVVPSGAIQ

SEQ ID NO: 29417 - protein, 166 aa, Wigglesworthia glossinidia endosymbiont of Glossina brevipalpis
MVNFEKNINELQEKLISVNRVSKTVKGGRIFSFTALTVVGDCQGKIGFGYGKSKEVPLAIQKAMDKARKNMIIIPIVCKTLQHEINGYHTGSRVFMKPASEGTGIIAGGAMRAVLEVAGVHNVLAKVYGSTNPINVVRATVNALKKMRFPMHIAEKRGKSIDDILG

SEQ ID NO: 29418 - protein, 257 aa, Solanum chacoense
MFSSDENLFNFIVFFILVMAFPTFILCQFVTSSYGKHYTSADSGTTISPPIAWAFMESPTLWLTFIVFRLGKNYTNPLAFILISPYLFHYINRTIIYPLRLRSRSTKNNFPLNIAVTGFIFNLLNAYIQSRWVSHYANYEEDESFWVRFGIGLGLFGSGMLVNIWADGVLLGLKSQGGGYKIPRGGLFDYVSSPNYLGEIMEWLGWALMTWSWAGLAFFVYTCANLVPRAVSNHKWYVEKFGEDYPKNRKVVFPFLY

SEQ ID NO: 29419 - protein, 522 aa, Oryza sativa Japonica Group
MANRRKFSQAGGGGGGGVFDPFGTKQAVSSLRKGGRLPVYVAGVFFVIFVIIMYGEDIRSLTLDPIARAGTTPARIVEPVVTEERHVARVNPPRREVSSAEKAAALPLDVDERPKLATPTPTEAAKEVPKVEKIRKPKKPKTTKKKPRKPRPAKKTVAAAAGGLLGVPETCDLSKGEWVFDNTSYPLYREEQCEFLTSQVTCMRNGRRDDTYQKWRWQPKDCSMPRFDAKLFMERLRGKRFMFVGDSLNRNQWESMVCLVQSAMSPGKKYVTWEDQRVVFHAVEYNATVEFYWAPFLVESNSDDPKIHSIQHRIIKADAIAAHAQNWRGVDYLVFNTYIWWMNTLNMKIMRPGGQSWEEHDEVVRIEAYRKVLTTWASWVNDNIDPARTSVFFMSISPLHISPEVWGNPGGIRCAKETMPLLNWHGPIWLGTDWDMFHAAANVSRTAATRVPITFVDVTTMSERRKDGHTSVHTIRQGKVLTPEQQADPGTYADCIHWCLPGVPDIWNLILYTRIMSRPQLV

SEQ ID NO: 29420 - protein, 285 aa, Mycobacterium sp. MCS
MSVRTALRPGELSPTLPVPKSIARPEYAWRPTVAEGSEPWVQTPEVIEKMRVAGRIAAGALAEAGKAVAPGVTTDELDRIAHEYMVDHGAYPSTLGYKGFPKSCCTSLNEVICHGIPDSTVIEDGDIVNIDVTAYIDGVHGDTNATFLAGDVSEEHRLLVERTHEATMRAIKAVKPGRALSVVGRVIEAYANRFGYNVVRDFTGHGIGTTFHNGLVVLHYDQPSVETVIEPGMTFTIEPMINLGGLDYEIWDDGWTVATKDRKWTAQFEHTLVVTDTGAEILTQL

SEQ ID NO: 29421 - protein, 748 aa, Salmonella enterica subsp. enterica serovar Typhi str. CT18
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNAWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKHGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 29422 - protein, 254 aa, Legionella pneumophila str. Lens
MGVTIKTPDEIEKMRVAGRLAAEVLEMIGPYVQVGITTDELNTICHDYIVNVQKAIPAPLNYNGFPKSICTSINHVVCHGIPGKKTLKDGDIINIDVTVIKNEYHGDTSKMFIVGTPSVKAKHVVQIAHECLYIGIDMVKPGVQLGDIGHAIQQHAEKNRCSVVRDYCGHGIGRVFHEDPQVLHYGVPGTGMRLEPGMTFTIEPMVNIGKHHTRLLPDHWTVVTKDHSLSAQWEHTLLVTDTGVEILTLRNEER

SEQ ID NO: 29423 - protein, 186 aa, Zea mays
MDYGPSDSSGTDDDLPQLPHRSIRGSGRVSGNGRTIVPAGSYARAPTDMEAQIQQLEQEAYCSVLRAFKAQSDAITWEKEGLMTELRKELRVSDKAHRELLNKVNNDNIICSIREWRSTGGLQASMSNNPQPIHDPVPSPTTSGRKRQKTSQSVPALPAPPGMHSQQLATPTQPSSSTARKAVPPV

SEQ ID NO: 29424 - protein, 583 aa, Oryza sativa Japonica Group
MAARRAASSLLSRGLIARPSAASSTGDSAILGAGSARGFLPGSLHRFSAAPAAAATAAATEEPIQPPVDVKYTKLLINGNFVDAASGKTFATVDPRTGDVIARVAEGDAEDVNRAVAAARRAFDEGPWPRMTAYERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFRFATLEFPRIPSDRDRLSTGIYTNTLRAMCSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 29425 - protein, 336 aa, Xanthobacter autotrophicus Py2
MKALLCEEPGRLSVISRPVPVPAAGEVLVRIRRVGVCGTDFHIFQGKHPFLEYPRVMGHELSGTVEAAPEGSRLKTGENVYIVPYLSCGKCVACRKGVTNACQNIAVLGVHKDGGMAEFLCVPEGNVVPTGTASLDDAAMIEFLAIGAHGVKRGQVTAEDKVLVVGSGPIGMSAIIFAKARGAQVSVMDMREDRLAFTRDMLGADHLVTADAGAEEAAKRITQGDFYDVVIDATGNAGAMQRGFGFIAHGGRYVLVSVVRQDITFSDPEFHKRETTLYASRNAQPDDFAEVVRQMEAGRVPTRALNTHRGALGDAPGLFQDWLKPEAGVIKAILEV

SEQ ID NO: 29426 - protein, 385 aa, Oryza sativa Japonica Group
MWWVLISLVWSRMADLWKLCGETVAIPLLQTYPVTVLCWWLLCPWGILVDSYIIFFSEEGGFCGVESCAQASLPDSFLADLDELSDNEAYPEGEDEEARNMEEDGDGGMPCCEFLNHDDLNSASELHKTQRYNDIMQLLGAKKKNLSGFSTAASQFRVGYLEQTEVFQSTIPSLRTHACRIISAKSTLAARIDSIRGDPTGKAGHSLLEEICKKTEKLQELPPAKILKPLPVPDCMPKKKRGGCRLRKMKERYAQTDMMKLANRMQFGVPEESSLGDGLGKGYGLLGQAGSGKLRLLAGQSRLAAKVAKRFKARSCDRSESRSGLTSTLAFTPVQGMELSNPLVHNDHSVSGTQSTYFSDVGTFSSIRGKDAIPIQSSEIQNPGV

SEQ ID NO: 29427 - protein, 270 aa, Mesembryanthemum crystallinum
MAANVPLSDFLATAVDAAKRAGEVIRKGFYVKKNVEHKGQVDLVTETDKSCEDIIFNCLKQQYPNHKFIGEETTAAYGATELTDEPTWIVDPLDGTTNFVHGFPFVCVSIGLTIGKVPTVGVVYNPIMNELFTGVRRQGAFLNGVPIHVSSKDELVNCLLVTEVGTKRDKSTVDATTNRINGLLFKVRSIRMAGSCALDLCGIACGRADLMYENGYGGAWDVTAGIVIVEEAGGVIFDPSGKDFDITVTRIAASNPLIKDSFVEAFKQAE

SEQ ID NO: 29428 - protein, 983 aa, Colwellia psychrerythraea 34H
MKNILPLMWVIILMFVISQGVSAKGKKEIPKSEYGSYIVIMDLNPAIAYEGDIKGFKATKPGKNKKINPKSANVRKYTSMLSKTHDAALAKANVKSKDKVHDYGIALNGFSAKMTHEQAVALSSQDGVAKVMPDVLRQKMTDNSPSFLDLGGPAGPWLKGYDGEGIVIGVIDTGIWPEHPSFTDDGSYSTPPILLDDSRPNCEFGNTGHRPDDVAFSCNNKLIGARQMLDTYRLIVGATSDEFDSARDEDGHGTHTSSTSGGNANVPANMLGNDYGLISGIAPRAHIVMYKGLGDLGGFGSDLAAAIDQAVADGVDVINYSIGSSSFAIGPDDVAFLFAENAGVFVATSNGNSGPAPATTGSPASTPWVTSVGASTQNRTYQGSASSVGEWEFFGASITAGTAELALIDSAEAGSELCIPGVLDPVAVAGKIVLCLRGAIARVDKSKAVNIAGGAGMILYNANDGESQVTDSHWVPSVHINNTDGLVIKGYISNDASTAVAQIMGGTYTEIDAPSMAGFSSRGPNLLSGDIIKPDVTAPGVNIIAGQTPASEGRGELFQMISGTSMSSPHVAGLFAMIKQAHPNWSPSTAKSALMTTAYQDVMKEDEATPADAFDMGAGHVNPGGKANKGSIFEPGLAYQAGLFEYAAYSCGAELGIFSPGTCGFLESLGIPTDPANLNLPSIGIANVIGSKTVYRSVTGVAKDSGWRTYSVDVDAPAGYEVSVLPASIKLKSGMSATYAVTITNTASPAGEWAHGSITWRDSNDHYSVYSPIAVKGALFEAPANITGSSETGSASIDVTFGYTGDYTASGYGLTAATVDIDSVVQDPDQIFDPGDTFSNAHAIVVSGAAYLRIAIPGVADPNADLDIFLLDSVGNIVGVSANGGTDELIEMELPGDDTYTLWVHGWSAPGGSTDYELYSWVVPMASGSLTVASAPSSATLGATETIGVDWTGATNGKWHFGVIGHSDAGGLIGATLVEVDNR

SEQ ID NO: 29429 - protein, 330 aa, Mesorhizobium sp. BNC1
MSQYDVLCIGNAIVDIIARCDDAFLVENGIIKGAMNLIDAERSELLYERMGPAIETSGGSAGNTAAGVANFGGTAAYFGKVSNDHLGAIYRHDIRAQGVAFDTPSLDGNPPTARSMIFVTPDGERSMNTYLGACVELGPEDVEEEKARNAKVTYFEGYLWDPPRAKEAIRKTAEIAHAAGREVSMTLSDPFCVDRYRAEFLDLMRSGTVDIVFANEHEVMSLYQTASLDAAISAFREDCRLGLITRSEKGSIAVTREETITIKPVPVSNLVDTTGAGDLYAAGFLFGYTHNRSITDCGRLGSLAAALCIEQIGPRVQVSLKEAAEQAGLL

SEQ ID NO: 29430 - protein, 475 aa, Ralstonia metallidurans CH34
MRQQQGFDAIVEREQGLHRGLSTGQLSMIAIGGAIGTGLFLGSGFAIGFAGPSVLVSYAIGALIALLLMGCLAEMTVAHPTSGSFGANAEHYIGPLAGFLVRYAYWSSIVFAVGTEVTAIAVYMKYWFPMVPGWYWIVGFSAALIGINATSVKVFGAVEYVFSMLKIVAIVGFILLGAYVVTRAPTGSGIGLANYTAHGGFFPKGMWGTWVAVIVSIFSYLSIEMIAVAAGEARDPETAITRAFRATMVRLVFFYLLTLALMLMIVPWTAAGAGESPFVRVMAATRVPGAAAVFNFVILVAALSAMNSQLYITTRMMFSLSRAGYAPKALGQVNGRGVPMTALLLSTVGIAFAVVLNVVYPDASFMLMMAISMFGAMFTWLMIFITHLFFRRQHRGRPLAFRMWGFPVTTLLGAGLMFATLVTTWFTPEFRMTLVAGVPFMLALSAAYWLWYRKRGGAAQGDGEDAGRAEVRNSW

SEQ ID NO: 29431 - protein, 513 aa, Staphylococcus aureus subsp. aureus Mu50
MEMAKEQELILVLDFGSQYNQLITRRIREMGVYSELHDHEISIEEIKKMNPKGIILSGGPNSVYEEGSFTIDPEIYNLGIPVLGICYGMQLTTKLLGGKVERANEREYGKAIINAKSDELFAGLPAEQTVWMSHSDKVIEIPEGFEVIADSPSTDYAAIEDKKRRIYGVQFHPEVRHTEYGNDLLNNFVRRVCDCKGQWTMENFIEIEIEKIRQRVGDRRVLCAMSGGVDSSVVAVLLHKAIGDQLTCIFVDHGLLRKGEGDMVMEQFGEGFNMNIIRVNAKDRFMNKLKGVSDPEQKRKIIGNEFVYVFDDEASKLKGVDFLAQGTLYTDVIESGTKTAQTIKSHHNVGGLPEDMEFELIEPINTLFKDEVRKLGIELGIPEHLVWRQPFPGPGLGIRVLGEITEDKLEIVRESDAILRQVIREEGLEREIWQYFTVLPNIQSVGVMGDYRTYDHTVGIRAVTSIDGMTSDFARIDWEVLQKISSRIVNEVDHVNRVVYDITSKPPSTIEWE

SEQ ID NO: 29432 - protein, 253 aa, Mesorhizobium sp. BNC1
MPILGLGTWQLTHETARTVRAAFDLGYRMVDTSGDYGTQSAIGEAIRASGLDRDDIYLVTKVEETEDAYNATQANLRELGLDYADLILIHRPPRHGAGEELWRALIRAREDGLTRDIGVSNYSIELIEELVDATGEIPVVNQVEWSPFGHDLELKHYADFNGIVIQAYSPLTRATRLDDAALCETAEKYGKTPAQVLIRWNLERGTVPIPKANLHSHMKENISVFDFTLEKSDLESLDSLNEHFSSLGRLPYV

SEQ ID NO: 29433 - protein, 463 aa, Streptococcus pyogenes SSI-1
MEFRMSIKEQTDNNELENGMVRGLENRHVQLIAIAGTIGTGLFLGAGRSIALTGPSIIFVYMITGAFMFMMMRAIGEMLYYDPDQHTFINFISKYIGPGWGYFSGLSYWISLIFIGMAEITAVGAYVQFWFPSWPAWLIQLVFLVLLSSINLIAVRVFGETEFWFAMIKILAILALIATAIFMVLTGFETHTGHASLSNIFDHFSMFPNGKLKFFMAFQMVFFAYQAIEFVGITTSETANPRKVLPKAIQEIPTRIVIFYVGALVSIMAIVPWHQLPVDESPFVMVFKLIGIKWAAALINFVVLTSAASALNSTLYSTGRHLYQIANETPNALTNRLKINTLSRQGVPSRAIIASAVVVGISALINILPGVADAFSLITASSSGVYIAIYALTMIAHWKYRQSKDFMADGYLMPKYKVTTPLTLAFFAFVFISLFLQESTYIGAIGATIWIIVFGIYSNVKFK

SEQ ID NO: 29434 - protein, 136 aa, Triticum aestivum
MEEFDEADVLWPDHHEDEEPVQVQDRQQQQRVSPAIKPNDKIDAARRPAGSSSAPMVIPVVPRHPMMMDHGSWARRCHSDGVGGASFVAPHVMTARRRCAYSEERSVCVGQGRTLKGRDLLYVRTAVLRMTGFLET

SEQ ID NO: 29435 - protein, 733 aa, Streptomyces coelicolor A3(2)
MDTTARPSTIRWEESEDGVVTLVLDDPGQSANTMNAAFIDSLDAVAQRLVERRDDIRGVVVTSAKKSFFAGGDLRDLISVTPATAQQSFEAGMRVKRSLRALETLGRPVVAAINGAALGGGYEIALACHHRVVLDTPAARVGLPEVTLGLLPGGGGVTRTVRMFGVVDALRTVLLEGTQYGPVDALEAGLVDEIAADPDELLAKARAFVAAHPESAQPWDRPGHRIPGGTPSHPNLAAQLSALPALLRKRTGGAPGPAPRNILAAAVETAQVDLDTAFVVEARYLTELVTGQITKNMIQAFFFDLQAVNSGANRPKGVEPGKVAKVAVLGAGMMGAGIAYSCARAGIDVVLKDVSLESALKGKAYSEKLCAKAVAKGRTIQEKADALLARITPTAEAADLAGCDAVIEAVFEDTSLKHKVFQEIEHVVAPDALLCSNTSTLPITALAEGVERQGDFIGLHFFSPVDRMPLVEIIKGERTGDEALARAFDLVRQINKTPIVVNDSRGFFTSRVIGHFINEGVAMVGEGIEPASVEQAAAQAGYPAKVLSLMDELTLTLPRKIREETKRAVQEAGRTWEPHPADHIVDRMIDEFERPGRSGGAGFYEYGEDGRRAGLWPGLREHFTKPGYEIPFADMRERMLFSEALDTVRLLEEGVLTSVADANIGSIFGIGFPGWTGGVLQYINGYDGGAGAGAGLPGFVARARELADRYGERFTPPPLLLRKAERGETFTDF

SEQ ID NO: 29436 - protein, 545 aa, Vitis vinifera
  misc_feature (237)..(237): Xaa can be any naturally occurring amino acid
  misc_feature (239)..(239): Xaa can be any naturally occurring amino acid
  misc_feature (241)..(241): Xaa can be any naturally occurring amino acid
  misc_feature (265)..(265): Xaa can be any naturally occurring amino acid
  misc_feature (427)..(427): Xaa can be any naturally occurring amino acid
  misc_feature (438)..(438): Xaa can be any naturally occurring amino acid
  misc_feature (467)..(467): Xaa can be any naturally occurring amino acid
  misc_feature (521)..(521): Xaa can be any naturally occurring amino acid
  misc_feature (535)..(535): Xaa can be any naturally occurring amino acid
MIAVLLRNLVNLVSEGWSWWWDGLTENTIFRVVAALSTAAIAISWYAWLIKKASRGLPPLPPGPRGLPLLGNLLFIEPDLHRYFSKLSQLYGPIFKLQLGSKTCIVISSSSVAKEILKDHDVIFANRDVPISALALTYGGQDIAWSHYSPEWRKLRKVFVQEMMSSASLDACSALRRREVQEMVRDVYGKVGTPINMGDQMFLTVLNVVTSMLWGGTLHGEDRSRIGMEFRRVIVEXVXLXGKPNISDLFPALAWFDLQGIESRXKKLVLWFDRIFESLIAQRTQLDGADGGGKNKSKESKDFLQFMLELMHQGDDKTSVSITQLKALFMDIVVAATDTSSTTVEWAMAELLQHPQTMQKAQEELEKVVGNENIVEESHLFQLPYLGAVIKETLRLHPPLPLLVPHSPSTSCIISGYTIPKGSRILXNAWAMQRNPEXWEHPLEFIPERFLEDAASADYKGNNFNFXPFGSGRRICAGLPLAEKMLLYVLASLLHSFDWKLPDGRTSVDLEERFGIVLKKXEPLLAIPTARLSNXGHYDPSERIF

SEQ ID NO: 29437 - protein, 406 aa, Borrelia burgdorferi B31
MNLLKKKSIGIIACPGGRVFASKIIEELDRIFINIENEIIESICQDSKALKEEIFKIEKVLSPFLEGLSLSTLKSKEPLEIPVKFVKFANGEFKTEILKTIRNKDIFIVQDVANAYEVEINSSEKIIMTVNDHIMNLMTTIDACMQAKANSVSVIIPSYPYSRQDKKHSRECLTASLIGRFLEELGIRHILTLDIHSKAIENVFRKVYFENLNVSYEIFNSLKDLIDIRDSNLVIVSPDTGAVSRNKFFASSLKSPLALLYKERDYSRVSNDVADSNISVTKLLGDVEGKNVFMSDDMLATGGTLIKAMKLLKSMGAKKIICGISLPFFNGDAIKYFDKAYEEGFFYKIIGTNAVCHNDELINKPWYHEANVAPLFAEAIFAIYNKVGLQKILDRKDDIQKLITKG

SEQ ID NO: 29438 - protein, 355 aa, Gerbera hybrid cultivar
MVIQATTRVESLSTSGIHQIPKEYIRPQEELRSITNIFDEEANKQKPQVPTVDLTDIESDDPEKRHKCLEELKKAAMEWGVMHVVNHGVSGDLIGRVKAAGEGFFGLPVEEKEKYGNDPDGGRTQGYGSKLANNASGQLEWEDYFFHLVFPEEKRDLTIWPTTPSDYTDATTEYAKQLRALATKILPALSLGLGLEEGRLEKEVGGIEELILQLKINYYPKCPQPELALGVEAHTDVSALTFILHNMVPGLQLFYDGQWVSAQCVPDSIILHIGDALEILSNGEYKSILHRGLVNKEKVRISWAVFCEPPKEKIVLKPLPETVSEAEPPLFPPRTFRQHMEHKLFRKNKDEVMQN

SEQ ID NO: 29439 - protein, 313 aa, Escherichia coli
MEKRKIILDCDPGHDDAIAIMMAAKHPAIDLLGITIVAGNQTLDKTLINGLNVCQKLEINVPVYAGMPQPIMRQQIVADNIHGDTGLDGPVFEPLTRQAESTHAVKYIIDTLMASDGDITLVPVGPLSNIAVAMRMQPAILPKIREIVLMGGAYGTGNFTPSAEFNIFADPEAARVVFTSGVPLVMMGLDLTNQTVCTPDVIARMERAGGPAGELFSDIMNFTLKTQFENYGLAGGPVHDATCIGYLINPDGIKTQEMYVEVDVNSGPCYGRTVCDELGVLGKPANTKVGITIDTDWFWGLVEECVRGYIKTH

SEQ ID NO: 29440 - protein, 355 aa, Gerbera hybrid cultivar
MVIQATTRVESLSTSGIHQIPKEYIRPQEELRSITNIFDEETNKQKPQVPTVDLTDIESDDPEKRHKCSEELKKAAMEWGVMHVVNHGVSGDLIGRVKAAGEGFFGLPVEEKEKYGNDPDGGRIQGYGSKLANNASGQLEWEDYFFHLVFPEEKRDLTIWPTTPSDYTDATTEYAKQLRALATKILSALSLGLGLEEGRLEKEVGGIEELILQLKINYYPKCPQPELALGVEAHTDVSALTFILHNMVPGLQLIYDGQWVSAQCVPDSIILRIGDTLEILSNGKYKSILHRGLVNKEKVRISWAVFCEPPKEKIVLKPLPETVSEAEPPLFPPRTFQQHMEHKLFRKNKDEVMQN

SEQ ID NO: 29441 - protein, 525 aa, Legionella pneumophila str. Lens
MNDLKKSPLLILDFGSQYTQLIARRVREMGVYCEIYPYNINHEQFKKLNPCGVILSGGPSTVTHDANPRAPQWLFESDLPLLGICYGMQTMAVQLGGQVHSSTLREFGYAELRLHGHSQLLSNIEDRTAMDGSALLDVWMSHGDKVTELPPGFKVICETRNAPIAGMADESRQMYGLQFHPEVTHTLQGLRILQRFVVDICKASTDWTPEHIIDEAINKIREQVGTEKVLLGLSGGVDSSVVAALLHRAIGEQLVCVFVDTGLLRLNEAEQVLSMFGRHMGIRIIAVNAEDKFLTALKGVTCPEEKRKIIGRTFIEVFDEEAQKLTDIKWLAQGTIYPDVIESAATSTNDAAVVIKSHHNVGGLPDTLNLKLLEPIRELFKDEVRQVGLELGLPHDMVYRHPFPGPGLGVRILAEVKKEYADILRKADAIFIEELHNAQLYHKISQAFAVFLPVKSVGVMGDGRRYDYVICLRAVETVDFMTAHWSQLPWDFLGKVSNRIINEVEGVSRVTYDISGKPPATIEWE

SEQ ID NO: 29442 - protein, 509 aa, Mycobacterium sp. MCS
MADDRLKSSGATYSQAGEGYFEKRQLKRTAGFWGLWGIGVAAVISGDFSGWNFGIGEAGWGGLAVASVLIVITYFGMLFSIGEMSAAMPHTGGAYSFARASMGPWGGFITGFAETIEYVFTTAVVVFFSASYADAVTSELFGLSMPGWVWWLILYAIFVGLNSWGAALSFKFALVVAIISIGILVLFGVLAIANGAVDFSRLFDIAPDPAAAGSSDFLPFGWVAVLYALPFAMWFFLGIEELPLAAEEAHDPARDIPKAGIWGLISLVGCGAIVFFLNPAVTGSEALGASDEPLLDGFRAFLPGSLAAVLSAFALIGLLASLQGIMYAYGRNLYSLSRAGYYPKVLSLTGSRQTPYIALILGAVIGFVALVVVSLNEGAGDVVLNIAVWGAVLAYMLQMISFVLLRRNFPNARRPWVSPTGNAGAIVALVIAAITFVGVLVNPTYRPAVIAIVVFYVIGLLVFGFYGRHRLVLSPEEEYAVTGGLHGYDPEAEGLGGTIEDEILKGHTD

SEQ ID NO: 29443 - protein, 142 aa, Wigglesworthia glossinidia endosymbiont of Glossina brevipalpis
MKIEQTLSIIKPNIISNNFIGNIINRLEQAKLYIIASKMIKLSWKEAVSFYIEHKNKSFFSDLINFMISHPIIVQILEGENAIKRNREIMGNTNPKIALAGTLRSDFSNDIIKNGVHGSDSEESADREIKFFFKKDRIFSRI

SEQ ID NO: 29444 - protein, 66 aa, Triticum aestivum
  misc_feature (38)..(38): Xaa can be any naturally occurring amino acid
  misc_feature (53)..(53): Xaa can be any naturally occurring amino acid
MTTSRRVADRKIAVFEKNITKRGSVPETVKKANDYPVXGPIVLGFFVFVVVGXTLFPDPGLQTPPS

SEQ ID NO: 29445 - protein, 464 aa, Lactobacillus brevis
MKEGIDMRESVAEEPKHKFFQSTEGENKSLDEVNGSVKVPKNAGFWRTLFAYTGPGILIAVGYMDPGNWITSIAGGAQFKYSLLSVILISSLIAMLLQSMAARLGIVTGKDLAQLTRERTSKTMGIILWLITESAIMATDVAEIIGSGIAIKLLFNIPLVVGILITTADVLILLLLMKLGFRKIEAIVATLVAVILLVFTYEVFLAGPQLDQMFAGYMPTKDIVTNKSMLYLALGIVGATVMPHDLYLGSSISQTRAVDRHDRQDVAKAIKFTTIDSNLQLTIAFIVNSLLLILGAALFFGTNSTVGRFVDLFNSLNNSHIVGAIASPMLSMLFAVALLSSGQSSTITGTLSGQIIMEGFIHLRMPLWAQRLLTRLLSVTPVLIFAIYYHGNEAKIENLLTLSQVFLSVALPFAIVPLVKFTSSKELMGEFVNKAWVKYSAWVATVVLVSLNIYLILQTVGVIG

SEQ ID NO: 29446 - protein, 455 aa, Mycobacterium sp. MCS
MTSSEVINPATEEVLRTVDLLDVGGVDDAVARAKSAQRTWARLAPAERAAALRSFAAVVDAHIDELAALEVANSGHPIGSAEWEAGHVRDVLQFYSASPERLSGKQIPVAGGLDVTFNEPLGVVGVITPWNFPMTIAAWGFAPALAAGNAVVLKPAEWTPLTSIRLGELAVEAGLPADLFQVLPGRGSVVGERFVTHPDVRKIVFTGSTEVGTRVMAGAAAQVKRVTLELGGKSANIVFDDCDLEKAAATAPYGVFDNAGQDCCARSRILVQRNVYDRFMELLEPAVKGVKVGDPAARDTEMGPLVSKKHWQSVASYVSDDAPVAFRGTAPEGRGYWFAPTVLTPQRTDRTVTEEIFGPVVTVLPFDDEADAVALANDTPYGLSGSIWTENLSRAVRVSRALESGNLSVNSHSSVRYNTPFGGFKQSGLGRELGPDAPLSFTETKNVFFAVQEAP

SEQ ID NO: 29447 - protein, 723 aa, Thermotoga naphthophila
MWLLFLIPLVALGFAAANFAAVVRKPEGTERMKEISSYIRSGADSFLTHETKAIFKVAIVIAILLMIFTTWQTGVAFLLGAVMSASAGIVGMKMATRANVRVAEAARTTKKIGPALKVAYQGGSVMGLSVGGFALLGLVLVYLIFGKWMGQLDNLNIHTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQKMGENLVHQIPKETIQALISYPIFFALVGLGCSMLGILYVIVKKPSDNPQRELNISLWTSALLTVVLTAFLTYFYLKDLQGLDVAGFRFGAISPWFSAIIGIFSGILIGFWAEYYTSYHYKPTQFLSKSSVEGTGMVISNGLSLGMKSVLPPTLTLVLGILFADYFAGLYGVAIAALGMLSFVATSVSVDSYGPIADNAGGISEMCELDPEVRKITDHLDAVGNTTAAIGKGFAIGSAIFAALSLFASYMFSQISPSDIGKSPSLVLLLNMLDARVIAGALLGAAITYYFSGYLISAVTEAAMKMVDEIRRQAREIPGLLEGKAKPDYNKCIEITSDNALKQMGYPAFIAILTPLVTGFLLGAEFVGGVLIGTVLSGAMLAILTANSGGAWDNAKKYLEAGNLEGYGKGSEPHKALVIGDTVGDPLKDTVGPSLDILMKIMSVVSVIAVSIFKHVHLF

SEQ ID NO: 29448 - protein, 366 aa, Pseudomonas putida
MEIKAAIVRQKNGPFLLEHVALNEPAEDQVLVRLVATGLCHTDLVCRDQHYPVPLPMVFGHEGAGVVERVGSAVKKVQPGDHVVLTFYTCGSCDACLSGDPTSCANSFGPNFMGRSVTGECTIHDHQGAEVGASFFGQSSFATYALSYERNTVKVTKDVPLELLGPLGCGIQTGAGSVLNALNPPAGSAIAIFGAGAVGLSAVMAAVVAGCTTIIAVDVKENRLELASELGATHIINPAANDPIEAIKEIFADGVPYVLETSGLPAVLTQAILSSAIGGEIGIVGAPPMGATVPVDINFLLFNRKLRGIVEGQSISDIFIPRLVELYRQGKFPFDKLIKFYPFDEINRAAEDSEKGVTLKPVLRIG

SEQ ID NO: 29449 - protein, 536 aa, Xanthobacter autotrophicus Py2
MLPAEAHESLHAMGGMVAAPHQLAAEAGREVLAEGGNAIEAMVAAAAAIAVVYPHMNHVGGDGFWLIREPSGRVRYIEACGFAGARATIPFYHEVGLGAVPTRGPLAAVTVPGAVDGWRLALEAAAVHGGRMTLKRLLEPAVRHAREGVAVSRSQAALTAQKKAELEDAPGFAAAFLTADRAVPQAGTLQRQQRLADTLDHLARAGLADFYRGDVGREIGTDLERIGSPVTREDLKRYAAVERPPLSVDIGVGRLFNAPPPTQGLASLLILALFDRLKVKRGDSFEHVHGLIEATKRAFMVRDKVVCDYDHLTHDLAALLTPEAIAKRADGIEMGRALPWPQAKAGGDTVWLGATDKSGLVVSYIQSIFFEFGSGCVLPSTGVLMQNRGASFSLEPGALNPLKPGRRPFHTLNPALAVLADGRVMAYGTMGGEGQPQTQSAIFSRHVLFDVPLGEAIARPRWLLGRTWGDVETRLRLEPRFDDEVVERLKLVGHDLALVPEAYSDTMGHAGAVVLHPGGRMEGAHDPRSDGGAAGV

SEQ ID NO: 29450 - protein, 763 aa, Psychrobacter arcticus 273-4
MDTALLLSGVVGIGIAAQWLAWYLKQPSILFLLLIGIIVGPVLGVFDPDLVLGELMFPFISLGVAIILFEGSLTLEFEEIKQHGSVVQMLVSVGVLITIAIVSLSTYLLFDIDPIIALLFGALVCVTGPTVIMPLLRSVRPNKTISNILKWEGIIIDPIGAIAVVLVYEYIISGGEGSSILLFAKIVVLAVAMGLAGAWALAFLMRRHMIPEFLRNVFTLAFVLVLFSISNHLEHESGLLTVTVLGVALANWPKFPRDTILEFNESLTILLVSVLFIILAARVELASLLSIGFAGLVLLAIVMFVARPLSVWVSSIGSNLKTKEKLMISWIGPRGIVAAAISSLFAIRLQEYDIQGVELLVPLVFLVIIGTVMIQGLGAKMVGNFLGVREPETNGILVVGSNPVALLVATSLKDQGFDVIVAHNNYTNIASARMSGLRTYFGNPVSDHADHHLDLIGIGRLFAMSMDKELNTLSEIHYRHEFGERKLYRLKFSDEKVKSERDDKQGNFHSQWLFGKDVTYTKLASMLSKKARIKITNITDSYSFEQYKADNKQFVPLYTVDKEGKLHVITDKFDGTVPRDRKLVSLVVDDDVQPKPVDVTPQQEQARAAADASFESDSKAPEKRQEKELADDDSNIEEASLIDSDKDAEQNLLNDVPAASLESKPSSITSVALHKKAANEKIATAESAGTIQANPQMVSADPTTPAIPKIISNNKNSGNGNGNAPKNKKGSLDPNRLPDSSSNKANNSTTAEVVLSKDLGKND

SEQ ID NO: 29451 - protein, 371 aa, Streptococcus thermophilus LMG 18311
MALTAGIVGLPNVGKSTLFNAITKAGAEAANYPFATIDPNVGMVEVPDERLTKLTELITPKKTVPTTFEFTDIAGIVKGASKGEGLGNKFLANIREVDAIIHVVRAFDDENVMREQGREDDFVDPMADIDTINLELILADLESINKRYARVEKIARTQKDKDSVAEFNILQKIKPVLEDGKSARTIDFTEEEQKIVKGLFLLTTKPVLYVANVDEDQVANPDDIDYVKQIREFAATENAEVVVISARVEEEISELDDEDKEMFLEDLGLTESGVDKLTRAAYHLLGLGTYFTAGEKEVRAWTFKRGIKAPQAAGIIHSDFEKGFIRAVTMSYDDLIKYGSEKAVKEAGRLREEGKEYVVQDGDIMEFRFNV

SEQ ID NO: 29452 - protein, 761 aa, Mesorhizobium sp. BNC1
MAEAEKNDRVGPSVSAQEALEFHAMGRPGKLEITPTKPMATQRDLSLAYSPGVAVPVKAIAEDPARAFDYTTRGNLVAVISNGTAILGLGNLGALASKPVMEGKAVLFKRFADVDSIDLEVETEDADEFVNCVKLLGPSFGGINLEDIKAPECFIIETRLRELMDIPVFHDDQHGTAIIAVAGLINALDLTGRDMKTTKLVCNGAGAAGIACIELAKAIGFAPGNILLCDTKGVVYKGRTEGMNQWKSAHAVETDKRTLAEALDGADVFFGLSAKGALTPAMVQSLAKNPIIFAMANPDPEITPEEVAEIRTDAIMATGRSDYPNQVNNVLGFPYIFRGALDVRATTINDAMKVAAAEALAALARQDVPDDVAAAYQGNRPKYGPNYIIPVPFDPRLITAVPVAVAKAAMDSGVARRPILNLERYEQELSARRDPIASTLQRIYDRVRRQPKRIVFAEGEEEQVMRAAVSYVNQRLGTAILLGREERIRETAVNAGVDLARSGIEIINARLSRRNGIYADYLYERLQRKGYLFRDCQRLINNDRNHFAACMVALGDADGMVTGVTRNYSTALDDVRRVIDAKPGHRVIGASIVLARGRTVIVADTAVHDMPDAQQIADIAEESANFARRMGYEPRVAMLAYSTFGHPAGERSERIQETVKILDKRRVDFEYDGEMAADVALNPQIMQQYPFCRLSGPANVLVMPAFHSASISTKMLQELGGSTVIGPLLVGLNKPVQIVSLNAKDSDIVNMAAVAAYTAGG

SEQ ID NO: 29453 - protein, 238 aa, Zea mays
MGALSRPEEVLALVKLRVAAGQIKRQIPPEEHWAFAYSMLQKVSRSFALVIQQLGPELRNAVCIFYLVLRALDTVEDDTSIPTEVKVPILQEFYRHIYNRDWHYSCGTNHYKMLMDKFRHVSTAFLELGEGYQKAIEEVTRRMGAGMAKFICKEVETVDDYDEYCHYVAGLVGYGLSRLFYAAGTEDLALDSLSNSMGLFLQKTNIIRDYLEDINEIPKSRMFWPREIWSKYADKLEV

SEQ ID NO: 29454 - protein, 477 aa, Colwellia psychrerythraea 34H
MSNNIKTQVVVLGAGPGGYSAAFRAADLGLDVVLVESRETLGGVCLNVGCIPSKALLHVAKVIDDAAAMASHGVTFGKPEIDLDKIRGWKESVIAQLTGGLGSMSKARKVATVYGYGKFTSDKTIEVEGNDGEKTTITFDNAIIAAGSSVIDLPFIPNDDPRVIDSTGALELKDVPEELLVLGGGIIGLEMGTVYSALGSNVSVVEFADQLVPAADKDIVRVYNNYNKKKFNIMLSTKVVAVEAKDDGLYVTFEGKKAPKEQVRYDKILVAVGRKPNGHLVAADKAGVNVDERGFINVTNELRTNVPHIFAIGDVVGQPMLAHKAVHEAHCAAEVISGKKHTFEPRCIPSIAYTDPEMAWVGVTESEAKEQGLNIEIANFPWAASGRAIASARTEGKTKLIFEKETGRILGGAIVGINAGEMLGEICLAVEMGADAEDIGLTIHAHPTLNESIGLAAEIFEGSITDLPNAKAVKKKK

SEQ ID NO: 29455 - protein, 224 aa, Brassica napus
MKSLASPPSLRLTLTRHHLPSRQPYSACYPHGVSSVIKSNNSLSFSSSASGFASPLAVEKELRLQTSAVRHVTGSLIRGEGLRFAIVVARFNEVVTKLLLEGAIETFKKYSVREEDIEVIWVPGSFEIGVVAQNLGKSGKFNAVLCIGAVIRGDTTHYDAVANSAASGVLSAGINSGVPCIFGVLTCEDMDQALNRSGGKAGNKGAETALTALEMASLFEHHLK

SEQ ID NO: 29456 - protein, 153 aa, Triticum aestivum
WHYSEEGVDLVVKDPNGGQVRDSRDKTSDKFEFIVQKRGVHRFCFTNKSPYHETIDFDVHVGHFSYFEQHAKDEHFAPLFEQIAKLDEALYNIQFEQHWLEAQTDRQAILNENMSRRAVHKALFESAALIAASVIQVYLLRRLFERKLGTSRV

SEQ ID NO: 29457 - protein, 722 aa, Oryza sativa Indica Group
MPRPAASSSSRPPPEGEPASSRATSSAESSIASLIDRATSTTSPSVDPALLRAIKSAARASDGAIRDAFRILLSLMSKPHAHVRLLAFTIADELFMRSKLFRSLLADVLDGFLPLAVGFRRAHPLPPPAASATLLRKAAVQALERWHHLFGAHYRQLRLAVEYLKESARVQFPGLRAAVEARAAREARTQEILTAKVEQLRRNLAAIKAEIRSAIDEIRNGLDIIRIESEKFNNYANDEDAEQEIASLAMRSIRMASLMAGEWVPETQENEAVFDALRESYRLLVSKHLVTVQEWISVLVRVNLANNRFRDSALKEFIDVKNEIRAVRNRCSELGLNLDNVHRRKGVQEEEDDDFWVEGNIEVPSPGRVGTSADVASSSKDTRKGKKPVGGTDTDDGKAPNAGNSPQELDPERAKLHAEAPVLPWSSVLDRWGSNRDALVNQRGLELESHWGRVDNDAVIPAAKIAELNVHSSIYREDPVEILPCLAPLKKGGLCQRRDLKICPFHGPIVPRDAEGNPIYQSDGHCDAEGNPVGQTDGRYDAAVSPIDPNEDSSDLRENMIMPDGSSDGECIYESSPSRTANINNDISDSDVGHDLGKITVEQLARQAVQNVRKRDRDDKKALEKAQRVRIRQHNQDVLREAALASTSRSAADYDLPSPAVSRRGRRGKTKGPTLASMLKKKVTSKDRIAERLLNARARDATIREVSHTEDMSYREAFPNQW

SEQ ID NO: 29458 - protein, 253 aa, Polaromonas sp. JS666
MRVKDKSIIVTGSGGGIGEGIARRLAAEGAKVIVNDINVAMGEKVVAAITKAGGTASFFAADVTKSAEVKALVDAAMQRYGKLDVMVNNAGWTHRNQPALDVSEDDFDKCYAINVKSIYLATIHATPVFRRQGGGSFINIASTAGVRPRPGLTWYNGSKGAVITTSKSLAAELGPDNIRVNCINPVFNPDTGLSAEFAGGPLDEERRERFRASIPLGRFSTALDVANAALYLASDEADFISGVCIEVDGARCV

SEQ ID NO: 29459 - protein, 565 aa, Salmonella enterica subsp. arizonae serovar 62:z4,z23:--
METTTKKARSLYIPYAGPVLLEFPLLNKGSAFSVEERRNFNLSGLLPEVVESIEEQAERAWLQYQGFKTEIDKHIYLRNIQDTNETLFYRLVQNHLEEMMPVIYTPTVGAACERFSEIYRRARGVFISYPNRHNMDDILQNVPNHNIKVIVVTDGERILGLGDQGIGGMGIPIGKLSLYTACGGISPAYTLPVVLDVGTNNQQLLNDPLYMGWRHPRITDDEYYAFVDEFIQAVKQRWPDILLQFEDFAQKNAMPLLTRYRDEICSFNDDIQGTAAVTVGTLIAASRAAGSQLSEQKIVFLGAGSAGCGIAEQIIAQTQREGLSEDAARQKVFMVDRFGLLTDRMPNLLSFQTKLVQKCDNLQHWDTENDVLSLLDVVRNVKPDILIGVSGQTGLFTEEIIREMHKHCPRPIVMPLSNPTSRVEATPQDIIAWTEGNALVATGSPFSPVIWKDKVYPIAQCNNAYIFPGIGLGVIASGASRITDEMLMSASETLAKHSPLVNNGEGLVLPALKDIQVVSRAIAFAVGKMAQQQGVAVKTSAEALQQAIDDNFWKPEYRDYRRTSI

SEQ ID NO: 29460 - protein, 487 aa, Ralstonia metallidurans CH34
MSLPSALYRNYVDGRFEEAANLFPNLSPVDGSIVGHVCEADASQVDRAVQAARAAMEGPWGNTSAAERARVLHAVADGIERRFDEFVAAEVADTGRTEQQARALDIRRGVLNFRTFADLASQAGGDYFDMRTAEGDVFSYTVRKPHGVVGIISPWNLPMLLMTWKVAPALACGNAVVVKPSEETPGSATLLAEVMHEAGVPAGVFNLVHGFGGGSAGEFLSRHPGIDALTFTGESRTGSTIMKAVADGVKEISFELGGKNAAVVFADCDFDKAVAGVMRSSFTNTGQVCLCSERVYVERPIFERFVAAMKARAEALRIGYPTVEGVEMGSLISRNHRDKVLSYYALAREEGATVVTGGGVPHFGDARDNGAYVQPTIWTGLPDSARCIQEEIFGPVCHIAPFDTDAEVVKRVNDSRYGLAASVWTRDLARAHRVTRQFDVGIVWVNTWFLRDLRTPFGGTRLSGIGREGGRHSLDFYSSLTTICVNP

SEQ ID NO: 29461 - protein, 485 aa, Arabidopsis thaliana
MATLEDSFLADLDELSDNEAELDENDGDVGKEEEDVDMDMADLETLNYDDLDNVSKLQKSQRYADIMHKVEEALGKDSDGAEKGTVLEDDPEYKLIVDCNQLSVDIENEIVIVHNFIKDKYKLKFQELESLVHHPIDYACVVKKIGNETDLALVDLADLLPSAIIMVVSVTALTTKGSALPEDVLQKVLEACDRALDLDSARKKVLEFVESKMGSIAPNLSAIVGSAVAAKLMGTAGGLSALAKMPACNVQVLGHKRKNLAGFSSATSQSRVGYLEQTEIYQSTPPGLQARAGRLVAAKSTLAARVDATRGDPLGISGKAFREEIRKKIEKWQEPPPARQPKPLPVPDSEPKKRRGGRRLRKMKERYQVTDMRKLANRMAFGTPEESSLGDGLGEGYGMLGQAGSNRLRVSSVPSKLKINAKVAKKLKERQYAGGATTSGLTSSLAFTPVQGIELCNPQQALGLGSGTQSTYFSESGTFSKLKKI

SEQ ID NO: 29462 - protein, 415 aa, Triticum aestivum
  misc_feature (102)..(102): Xaa can be any naturally occurring amino acid
  misc_feature (124)..(124): Xaa can be any naturally occurring amino acid
  misc_feature (146)..(146): Xaa can be any naturally occurring amino acid
  misc_feature (155)..(155): Xaa can be any naturally occurring amino acid
  misc_feature (157)..(158): Xaa can be any naturally occurring amino acid
MGLGPWSPWAALPFSPRSRKGGGGGWGLGGLKAIGWILFAGVSFRLLCSFSSSSSLSPDIKEGKCDLFNGEWLPNPSGPAYTNSSCRFIDDHQNCMMNGRPXTGYLHWRWKPYECDLPPFDEIXFLGAMRNKAWGLIGDSILRNQXQSLICLLSXAXXPVEVYHDKEFKNRRWHFQSYNFTVSLVWAPFLVKSEVFENENGESTSEIQLHLDILEPTWISQYERFDYVVIAGGQWFLKTAVYWESGKVLGCHHCQDKNLTEVGFEHLYRRTLQEVLKFITSAHHKPVVLFRTWAPDHFENGEWFSGGTCNRVLPYKKGEYGGKYMEHVMRGIELEEFNKAVAAANSSRDVVKLKLLDTYSISSMRPDGHAGPYRMFHPFAQGNKDGSSVQNDCLHWCVPGPIDAWNDLIMKLVLN

SEQ ID NO: 29463 - protein, 486 aa, Zamia furfuracea
ALGVSTLVEKNVGRIVQIIGPVLDVAFTPGNMPNIFNSLIVKGQDTAGQEIRVTCEVQQLLGNNKVRAVAMSATDGLTRGMKVIDTGAPLSVPVGGATLGRIFNVLGEPVDNLGPVDARTTSPIHRPAPAFIQLDTKLSIFETGIKVVDLLAPYRRGGKIGLFGGAGVGKTVLIMELINNIAKAHGGVSVFGGVGERTREGNDLYVEMKESGVINEQDISRSKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPWIVGEEHYETAQGVKQTLQRYKELQDIIAILGLDELSEEDRLTVARARKIERFLSQPFFVAEVFTGSPGKYVGLIETIRGFQMILSGELDGLPEQAFYLVGNIDEATAKAMNLKVES

SEQ ID NO: 29464 - protein, 333 aa, Legionella pneumophila str. Lens
MHSYLKKDLILHYIQINNPGPHSELTLVEGPNPGFNESQILVRVKATALNRADLMQKYGKYPPPPGESDIPGLEIAGEVIVTGSKVKQFKPGDKIYGLVGSGGYAEVCPVDASLAHHIPSHWSYSLAAALPEALTTVYATLYDLGALSSGQTLLIHGAGSGIASLAIQMAKLTNTKVITTVGDSSKIEKALALGADQVIHYKEQDFELLIEDNSVDLIIDFVGGDYFNKHLHLLKPQGKLIQIACLKGSKVECSLALLMQKRLHIIGFVLRSQSIKEKARLWKLAHDHWFNAFENDKIKPVIDSEFDLNQIETALQRMQQGSHFGKIVIRVSK

SEQ ID NO: 29465 - protein, 487 aa, Pseudomonas putida
MRETKEQPIWYGKVFSSNWVEARGGVANVVDPSNGDILGITGVANGEDVDAAVNAAKRAQKEWAAIPFSERAAIVRKAAEKLKEREYEFADWNVRECGAIRPKGLWEAGIAYEQMHQAAGLASLPNGTLFPSAVPGRMNLCQRVPVGVVGVIAPWNFPLFLAMRSVAPALALGNAVILKPDLQTAVTGGALIAEIFSDAGMPDGVLHVLPGGADVGESMVANSGINMISFTGSTQVGRLIGEKCGRMLKKVALELGGNNVHIVLPDADLEGAVSCAAWGTFLHQGQVCMAAGRHLVHRDVAQQYAEKLALRAKNLVVGDPNSDQVHLGPLINEKQVVRVHALVESAQRAGAQVLAGGTYQDRYYQATVIMDVKPEMEVFKSEIFGPVAPITVFDSIEEAIELANCSEYGLAASIHTRALATGLDIAKRLNTGMVHINDQPINCEPHVPFGGMGASGSGGRFGGPASIEEFTQSQWISMVEKPANYPF

SEQ ID NO: 29466 - protein, 233 aa, Wigglesworthia glossinidia endosymbiont of Glossina brevipalpis
MNNNFFISPSILAANFANLGEEIRKVIDAGADIIHFDAMDNHYVPNLSIGPIVLKSIRKDGIIIPIEVHLMAKPIDELVVSFIKTKANCIIFHPESTKNVNFLLKLIRKNNCKAGLAFTLTTSLNYLKNKNIVKNLDIVLIMSVSPGFSGQKFQKSAIKRLKIARKLIDDSGYNILIGIDGGVNDDNIYDVAYAGADIFVIGSSIFSKNNYFKTIKNMKKKIKSAKINILKNL

SEQ ID NO: 29467 - protein, 550 aa, Thermotoga sp. RQ2
MLMKGIPASEGIELGKAYVLQEEADTDSGFQEYNGKHYELERFFKAIDEAKKQIRELKKKAQEELSEKDAMIFEAHLLILDDPEFLKMVERKIDEGKNVSVAVKESIRFFEEMLLGLNDEYMKERAVDVKDVGIRLIRILSGKSEPDLWNIPEDCVLVAKDLTPSQTAKMRKERIKAIVLEKGGKTSHAVIIARSFGIPLILGVKEATRMIKNGDLLIVDGNIGLVHVNPEKSVLENYRERIIDQYKERMELRDILHLETRTSDGRRIKLFANIGNLEELDIALKNNAEGIGLMRTEILFMNREKPPSEEEQFKFYRTVLERMRGKPVIIRTLDVGGDKIIPYLYAEIGKEENPFLGYRSIRLCLNRKDIFKTQLRALLRASIYGNLKIMFPMISCEEEVLKAKTILEECKEELRKEGISFDRNVKVGIMVETPAAALISDILAKEVDFFSIGTNDLIQYTLAVDRTNESVSYLYNPSHPAILRLIKMTIENAHKNGIEVGVCGEVASDENFVPKLIKLGVDELSVNPSKILVIKKKVLQTKSNEDIINM

SEQ ID NO: 29468 - protein, 669 aa, Triticum aestivum
MSSSSQVRVGTLVPFVEGKSGSPSASSLPMPSIPIFKGSNVVGRSNLVAVDKRVSRKHLSLRALPDGSLEVVVEGPNPIVVRSEGQRRKVCAQQRAKIMHDDVLELIPGEYFMKYVNMSDERKSSTSVESHDLKKGKRHSEEDSVVAKRNRQVMEDEALARTSQESFAEESTSVTEVVSSLDSAGSSERNKERTHSVGPLKDVLPLTFRLMRVQRLPSWTNTSTVTIPDVIQGEVLLAVLSNYMVDMDWLLTACPSLRKVPHVLVLHGEDGASLERLKKTKPANWILHKPPLPISFGTHHSKAMLLVYPQGIRVVVHTANLIHVDWNNKSQGLWTQDFPWKKANDTSTNIGFENDLVDYLRALKWPEFRVNLPVAGDVNINAAFFRKFDYSSSTVRLIGSVPGYHVGPNMKKWGHMKLRSVLEECVFEKQFCKSPLIYQFSSLGSLDEKWMSEFACSLSAGKADDGSQLGIGKPLIVWPTVEDVRCSIEGYAAGSCIPSPQKNVEKDFLRKYWSRWKADHVGRCRAMPHIKTFTRYNGQNIAWFLLTSSNLSKAAWGALQKNNTQLTIRSYELGVLFLPKTLQSVPQFSCTDKSRSNLDKLALGKNIKTKLVTLCWKGDEEKDPSAEVVRLPVPYQVPPQLYGPEDVPWSWDRRYTKKDVYGSVWPRHG

SEQ ID NO: 29469 - protein, 179 aa, Glycine max
  misc_feature (126)..(126): Xaa can be any naturally occurring amino acid
  misc_feature (146)..(146): Xaa can be any naturally occurring amino acid
  misc_feature (158)..(158): Xaa can be any naturally occurring amino acid
MAAVGGSSAAATTSSSLFSSARFRHSLRPPPSQLFFPRARFSVNATCPFFSDNNNSLPQNVVASKPSPLELLKASSADRYTKEKSCIICIGLNIHTAPVEMREKLAIPESHWAHAIMDLCALNHIXEAVVLSTCNRMEIYVVALSXHRGVKEVTEWMXKVSRYSQPELCEHQVLLYYAV

SEQ ID NO: 29470 - protein, 341 aa, Burkholderia pseudomallei K96243
MIATRILRRPRVLIVGCGDVGMRCAAQLRARRENLRILALTSRRSRCVELRAAGVVPVVGDLDARATLKRIARVAPVVLHLAPPQATGDVDRRTQALVAALASPRRPSRQLAPAYGRLRAWRTAARSARPPFQASAIVPDALPRPVVVYASTSGVYGDCGGARVDETRAVRPANPRARRRVSAERQLRRATARGALSARIVRIPGIYAANRLPLARLEKGTPALVEADDVYTNHIHADDLASILLRAAVRGKPARVVHASDDTELKMGDYFERVARAFGLRSPPRIARAEAERQLEPMLLSFMRESRRLANARMKRELRIALRYPSVDDFLRTVSAPRPLK

SEQ ID NO: 29471 - protein, 315 aa, Thermotoga sp. RQ2
MNVLCTGEILIDFISEDKGKNLSQSELFRKKAGGSPLNVAVALRRLGREVSFLGKLGGDQFSEFLLEVMKKEGIDTTHIIFDSSCKTTLAFVARDAQGNPDFVFFREKPADTNLRPEEVNINPAQFSFLHIGSYSLAVEPSRSAYLKVMETFLEEGKPVSYDPNVRPSLIEDRNTFVKDFLEISSKVDIVKLSDKDLEYIFQEDLETAVDRIPIKENGLLFVTMGERGCLVKFKGEKRVVSSFKVKPVDATGCGDSFTAAVIHKYLEKTPETIEDAVEIGKFANAVAAIVITRVGGVDAMPVLDEVEMFLSNQER

SEQ ID NO: 29472 - protein, 620 aa, Oryza sativa Japonica Group
MAAEAAAEIVREIAAVGAPDLAAAAEPLRADCFRLGWEGLAAVAPGRGGRRGGGRGWGRGRGGFVVGGSGQGAAGRQEDAVCNNVAVQFKFVTWQLQTVLARLPQSCFQISDEVQEEVDLVRAQLRREMEKKGDIDVNIFSKFHDILALHVSTVGSQSEQSHGQPDTPQMENLCNGHLELQNIIMLVSEISGVPKSDAERITSQLIEGLENMRVTDSKKPVSVSQSSDETKASPETHKKSDAVAIPEDFRCPISLELMRDPVIVSTGQTYERAFIQRWIDCGNRTCPKTQLKLQNITLTPNYVLRSLILQWCEEKGIEPPTRSKNDGAYLEVGGERVAIETLVRNLSSSSLDERKSAAAEIRSLAKKSTDNRILLAESGAISALVKLLSSKDLKTQEHAVTALLNLSIYDQNKELIVVAGAIVPIIQVLRKGGMEARENAAAAIFSLSLIDDNKITIGSTPGAIEALVELLQSGSPRGRKDAATALFNLCIYQANKVRAVRAGILAPLIQMLQDSSRNGAIDEALTILSVLVSHHECKIAIAKAHAIPFLIDLLRSSQARNKENAAAILLALCKKDAENLACIGRLGAQIPLTELSKTGTDRAKRKATSLLEHLSKLQVL

SEQ ID NO: 29473 - protein, 303 aa, Salmonella enterica subsp. enterica serovar Paratyphi B str.
MNTLEQTIGNTPLVKLQRLAPDNGSEIWVKLEGNNPAGSVKDRAALSMIVEAEKRGEIKPGDVLIEATSGNTGIALAMIAALKGYRMKLLMPDNMSQERRAAMRAYGAELILVTKEQGMEGARDLALAMSERGEGKLLDQFNNPDNPYAHYTTTGPEIWRQTSGRITHFVSSMGTTGTITGVSRFLREQEKPVTIVGLQPEEGSSIPGIRRWPAEYMPGIFNASLVDEVLDIHQNDAENTMRELAVREGIFCGVSSGGAVAGALRVARATPGAIVVAIICDRGDRYLSTGVFGEEHFSQGAGI

SEQ ID NO: 29474 - protein, 189 aa, Mesorhizobium sp. BNC1
MFIQTEATPNPATLKFLPGRVVLEEGTADFRSADSAQAVSPLAARLFEVPGVTGVFFGFDFITVTKDGADWQHLKPAILGTIMEHFMSGQPVMAANDGSERETASSEFYDEADEEIVTTIKELLETRVRPAVAQDGGDITFRGYENGTVFLHMKGACAGCPSSTATLKHGIQNLLHHFVPEVQQVEQVA

SEQ ID NO: 29475 - protein, 515 aa, Physcomitrella patens subsp. patens
MPSAKLVEQPVFSLPVDSEHKAKSIQIFSFAQPHMRALHLSWISFFTCFLSTFAAPPLIPIIRDNLNLTKTDIGQASIASVSGSIMSRLMMGTVCDLVGPRYGSAFLIMINAPAVFSMSLVDDAEGFLICRFFIGFSLATFVSCEFWVSNMFTTKIMGTANGIAAGWGNLGGGATQIIMPLVFHLMLHSFHNPAFTAWRLSFFLPGTAHIVVGLLVLCLGQDLPDGNHSTQLQKQGGDVKDGFNKVLYFAVTSPKTWIFFILYGYSFGVELTVDNIIAEYFYDRFDLNLNTAGTIASAFGLMNIVSRPAGGYLSDCVARRFGMRGRLWILWTLQSLGGLLCIVLGLMSDLTAAIVAMIFFSICVQAACGAVFGIVPFISRRSLGVVIGLTACGGNVGSVLTQALFFTSSSYHTETGLIYMGVMILCCTLLIIAVYFPQWGGMFFPPSKSVSEEDYYVSEWTAQEQEQGLHLASLKFAVNARSERGGYCSSSSADPEGDHPTADGLGLSMWKSYSH

SEQ ID NO: 29476 - protein, 373 aa, Physcomitrella patens subsp. patens
MWTRIFSSVWMIGGFILIVYMGHLYIWAMIVVIQLYMAQELFTLARGKTGRDNKLPGFRLLNWHFFLTAMLYVYGRFLNKHLVKTIYSDHMIPHLFKYGLIKYHMLICYSLYIAGFVWFILTLKKGSYKYQFGQFAWTHMILLVVFAQSSFTVANIFEGIIWFLLPASLIVINDIMAYFFGIFFGKTPLIKLSPKKTWEGFIGASITTVMSAFMLAYVMGQSEWLTCPRRDLSTGWLECDPGPLFKPKYYPLPAWTPQWFPVKEFGVMPVQRHAMAFGLFASLVAPFGGFFASGFKRAFKIKDFGDSLPGHGGMTDRMDCQMVMAVFSYIYYQSFIATHRYTTKSLLDQILMNLTVEEQMILFRQLGEALQLT

SEQ ID NO: 29477 - protein, 143 aa, Acinetobacter sp. ADP1
MTNVAQVLNDKREHVVYTISPDASVLEAISLMADKGIGAIVVVEKESVVGILSERDYTRKVELMDRSSNSTVVSEIMTPKVFTVDKSYSVEDCLQLMTDRHLRHLPVVEHDKLLGLISIGDLVKAAMEEQRQLIEQLKQYISG

SEQ ID NO: 29478 - protein, 207 aa, Oryza sativa
  misc_feature (106)..(106): Xaa can be any naturally occurring amino acid
  misc_feature (120)..(120): Xaa can be any naturally occurring amino acid
  misc_feature (135)..(135): Xaa can be any naturally occurring amino acid
MTSVWKTKVLTGLNKLFDKDGKKAAAAEFLKSFNKEEIGKEIDDKKTELEPKVVEVVESSPPEIKALLKDKKTASKIKKNGPAVTKFLEELAKIDFPGAKPVSDAXVAKSGTTPLSPAIXAFILEKVAPFVPKEXEPKPEPEAEAAAETTSREVAVEEEKKEEEAAPAEPAAAAAEAAAPSTEVVEEKKEEEKPAEAAAPAAEPEKQ

SEQ ID NO: 29479 - protein, 253 aa, Physcomitrella patens subsp. patens
MNAIVPDGFASESDAGTKLTQDELKKIAAEKAVEYVKSGMVLGLGTGSTAAFAVAKIGELLKEGKLTDIVGVPTSKRTAEQAASLGIPLSVLDDHPKIDLAIDGADEVDPDLNLVKGRGGALLREKMVEAASAKFVVIVDETKLVKGLGGSKLAMPVEVVQFCWKYNAERLKNLPELAGCEVKLRMDGDKPYVTDNSNYIIDLYFEEPIVDANAAAQAISALEGVVDHGLFLNMASAVIIAGSDGVTVQTKDT

SEQ ID NO: 29480 - protein, 640 aa, Saccharomyces cerevisiae YJM789
MRRERQRMMSFEDEDKDDLDNSNSNNSSEMTDTAMMPPLKRLLITGSSDDLAQGSSGKKKMTMATRSPSSSPDLATNDSGTRVQPLPEYNFTKFCYRHNPDIQFSPTHTACYKQDLKRTQEINANIAKLPLQEQSDIHHIISKYSNSNDKIRKLILDGILSTSCFPQLSYISSLVTHMIKIDFISILPQELSLKILSYLDCQSLCNATRVCRKWQKLADDDRVWYHMCEQHIDRKCPNCGWGLPLLHMKRARIQQNSTGSSSNADIQTQTTRPWKVIYRERFKVESNWRKGHCRIQEFKGHMDGVLTLQFNYRLLFTGSYDSTIGIWDLFTGKLIRRLSGHSDGVKTLYFDDRKLITGSLDKTIRVWNYITGECISTYRGHSDSVLSVDSYQKVIVSGSADKTVKVWHVESRTCYTLRGHTEWVNCVKLHPKSFSCFSCSDDTTIRMWDIRTNSCLKVFRGHVGQVQKIIPLTIKDVENLATDNTSDGSSPQDDPTMTDGADESDTPSNEQETVLDENIPYPTHLLSCGLDNTIKLWDVKTGKCIRTQFGHVEGVWDIAADNFRIISGSHDGSIKVWDLQSGKCMHTFNGRRLQRETQHTQTQSLGDKVAPIACVCIGDSECFSGDEFGCVKMYKFDLND

SEQ ID NO: 29481 - protein, 298 aa, Saccharomyces cerevisiae YJM789
MSTSVPVKKALSALLRDPGNSHCADCKAQLHPRWASWSLGVFICIKCAGIHRSLGTHISKVKSVDLDTWKEEHLMKLIQFKNNLRANSYYEATLADELKQRKITDTSSLQNFIKNKYEYKKWIGDLSSIEGLNDSTEPVLHKPSANHSLPASNARLDQSSNSLQKTQTQPPSHLLSTSRSNTSLLNLQVSSLSKTTSNTSVTSSATSTGAANTKTGNRVGEVGQRNDLKKSILSLYSKPSAQTQSQNSFFTSTTPQPCNTPSPFVNTGITATNNNSMNSNSSSNISLDDNELFKNVWS

SEQ ID NO: 29482 - protein, 143 aa, Colwellia psychrerythraea 34H
MAIERTFSIVKPDAVAKNFIGQIYNRFETAGLKIVASKMIHLSQEKAEGFYAEHSERPFFGALVEFMTSGPVMVQVLEGENAVLKNREIMGATNPAEALAGTIRADLADSIDENAAHGSDALESAAREIAYFFSDDEICARTR

SEQ ID NO: 29483 - protein, 732 aa, Polaromonas sp. JS666
MTGNSALILALVCGLIAVGYGFWARSWILSQDAGNARMQEIAAAIQTGAAAYLARQYKTIAIVGVVLALLIGFFLDGKTAIGFCVGAVLSGACGFIGMNVSVRANVRTAQAATRGIGPALDVAFRGGAITGMLVVGLGLLGVTSFYWFLVGNGNYTPDRKLAELLNPLIGLAFGASLISIFARLGGGIFTKGADVGADLVGKVEAGIPEDDPRNPAVIADNVGDNVGDCAGMAADLFETYAVTLIATMVLGALLVAAAPLNAVVYPLALGAVSIVASIIGCFFVKASPVMKNVMPALYRGLAVAGVLSLIAFYFVTMWLMPDNAIAASGTQIRLFGACAVGLILTGALVWITEFYTGTQYSPVQHIAQASTTGHGTNIIAGLGVSMRSTAWPVLCVCIAIMTAYSLAGLYGIATAATAMLSMAGIVVALDAYGPITDNAGGIAEMSKLPASVREITDPLDAVGNTTKAVTKGYAIGSAGLAALVLFADYTHKLEGYGNAISFDLSDPMVIVGLFIGGLIPYLFGAMAMEAVGRAAGSVVVEVRRQFREIKGIMEGTAKPEYGKAVDMLTTAAIKEMVIPSLLPVVVPIVVGLVLGPKALGGMLMGTIVTGLFVAISMCTGGGAWDNAKKYIEDGNHGGKGSEAHKAAVTGDTVGDPYKDTAGPAVNPLIKIINIVALLIVPLMMKFHGGPASAAPVMPMAAPAAVSAPAPAMPAPAVATPMAPAAPAASASK

SEQ ID NO: 29484 - protein, 392 aa, Vitis vinifera
MDLINSLLNLVVPPASLVMLAFAWPALSFINACEWVYNTLYSENMEDKVVIITGASSGIGEQVAYEYAKKGAKLVLVARRENRLLGIGENARQLGAKHVMIMAADVVKLDDCRRFVTETVNYYGRVDHLVNMASLGHTFYFEEAIDTSVFPPLMDINFWGNVYPTYVALPFLRQSNGRVIVNASVENWLPLPRMSLYARKRIGITIATHGWIGSDMTRGKFQYVGGWCLEMQWKEEREAAKAALINFYETLRFEAKEVGITIATHGWIGSDMTRGKFMLEDGAEMQWKEEREVTGGPVEEFARLMVAGACRGDAYVKYPSWYDIFLLYRVFAPNVLGWTFRLLLSTNGARRSTSLIGTGRPLLESSSPPKLLTGGPFTFPQHNPQQHQQKME

SEQ ID NO: 29485 - protein, 179 aa, Polaromonas sp. JS666
MSLDKVSPGKNVPDSFNVIIEIPMNADPVKYEVDKESGAIFVDRFMSTSMHYPTNYGYVPKTISGDGDPVDVLVITPVPLIPGVVVTCRVIGILKMTDEAGEDGKVLAVPIDKKCSLYSHWQKPEDMNPLRLKTIAHFFEHYKDLEEGKWVKVQGWEGPEAAKKEITDGIANYAKANKA

SEQ ID NO: 29486 - protein, 173 aa, Glycine max
GGGEYHTCALTDSGEVYTWGNDVCCADLLIEGRTRSQWIPQKLGGSLDGISISSVACGEWHTAIVSSCGRLFTYGDGTFGVLGHGDLRSYSSPKEVESLSGLRVRSAACGSWHTAAIVEVMFDRFRYNSASGKLFTWGDGDERRLGHVDNGSKLVPTRVTQLVDYDFVQVSCG

SEQ ID NO: 29487 - protein, 220 aa, Musa acuminata
MLILCCSIAPMMDWTDNHYRTLARLISKHAWLYTEMVVAETIVHQSENLDRFLAFSPIQHPIVLQIGGSNLTNLAKAAELANSYSYDEINLNCGCPSGKVAGHGCFGARLMFDPEFVGDAMSAIASNCDVPVSVKCRIGVDDRDSYDELFRSLLPYSLRPPLLSSSSWFPLLPSSSLCNFLLFFLLIHVDLGQIYKDLGWIHADQGSIGADLGPLDADLV

SEQ ID NO: 29488 - protein, 180 aa, Musa acuminata
MVSSMMVSSAATFTRASPAQSSMVAPFTGLKSASAFPVTRKPNADLSHLPSNGGRVQCMKVWPIEGLKKFETLSYLPTLKDEALLKQIEYLLRSKWIPCLEFCPKGFVWRENHRSPGYYDGRYWTMWKLPMFGCTDAVQVAKEVEECKKEYPHAFIRIIGFDNNRQVQCISFIAYKPTGY

SEQ ID NO: 29489 - protein, 147 aa, Vibrio sp. JL-73
HDDLPGMDDDSLRRGQATCHIAFDEASAILAGDALQTLAFGILAEGKLSAEGDIYRIHMVKELAAASGAMGMCLGQALDLAAEGKRVDLEALETIHRNKTGALIRCAVRLGAYAAGEKGVACLKRLDTFSNAIGLAFQVQDDILDVE

SEQ ID NO: 29490 - protein, 881 aa, Cryptococcus neoformans var. neoformans B-3501A
MQPQQHTHNNNPSPVARPHPLHVVYSPTIPPPNRGTRNSELAQGSKIPLTAPLPSRTAAATSPNRKRPTPLVLGKPREAGPEDWEIQLERPVAASSGASDDHSLDNELQDLSKLRKAVRQNLLARPIDSPLEPSDSDKSAFNTPGQQSSFSSSSKPMESIPIELVFDRVESGSVLLVDTRPLASFLNSHLPNSIPLSVPTLLSKRFQKSQSQSNPSAISWATLSPFVSLPSARERWDSADQNKVEIAVICQGEEGRVVEDILKSLINDRTKVVKGGWAAVLNYERARRTLVSGQATTRPCLDMGVSETDSKPRPEPTSILLPPKSAPPCEIPLPPIPASPSPSSPKSLNHRPSLPSLRPPFAGPTRNLPSLSINAGQASQRRTPKLSLNLDRPLKSATLGGYHDIPPTPHGFLCTRTRPQRSPGLSLNIPHTPFQPQQGQVQDRIVGDSRSNGSASIQTIAYEQSHFPPSASTFGDAKQIENEGEDMAPNQYDGRTPRAPISHIPRKSQEYQAARFYSSPPSMNGALPSSPPTIRTAVAPFNPSVILPSFLYLGPDIQSESDVQYLLRLGVKRILNVALECDDNQGLSLKERFKYRKVGMRDIVEENGVGKGMRDACEFLDDARLHSAPTYVHCQAGKSRSVTIILAYLIHANAWTLKTSYAYVAERRKGISPNIGFVAELMQWEETELGVKQSGGVHGDGNGRAKTAGCGGGGGSSRHKEDGDDDEGRGKTHLRDSLPPTWSSSVDTYTRPAKVYSPVGGDDGGEEEGGREGRIAVGDEREVRKNGVWVHHRRAPVDRTTLQPGRRVSKAGLESLQPFLITSADPSSPSAAPNNGDNIDNEHQLNNNNDSETRPSPRAISGMGMRGHAMTPAGDGPLRWI

SEQ ID NO: 29491 - protein, 363 aa, Photobacterium phosphoreum
MTLSTAQEIIEDIRQGKMVILMDDEDRENEGDLIIASDKITPEAINFMATYGRGLICLTLNKARCLQLKLPLMVKNNTDKFATPFTLSIEAASGVTTGISVKDRARTVQAAVAAMATSEDIVMPGHIFPLMAQDGGVLTRAGHTEAGCDVARLAGLEPSSVIVEILNDDGTMARRPQLEVFANKHGLRLGTVADLIEYRNKYETMIERISECKLKTEYGEFNMITYRDKINHQIHYALQKGNIEPNSQTLVRVHLQDTFKDILQTGSNRWTLPAAMSRISSENGVLVIVTKPEDPEIVISKIQNLALGNQETPVINSQSRQVGLGSQILSDLGVRKMRLLSSSRQLYHSLSGFGLEIVEYVCD

SEQ ID NO: 29492 - protein, 175 aa, Photobacterium phosphoreum
MVNVRERVPLNVGINSDIPAELLSFNGLESGKEHIALIFKEADKILVPLVRMHSECLTGDVFHSSRCDCGEQLVETIEKMTEQGGIILYLRQEGRGIGLYNKIDAYKLQSQGMNTYEANNYLGFDDDLREFSEAAQMLTALGIQNIHLVTNNPKKIFDLQQNGINIVEVVGTNVH

SEQ ID NO: 29493 - protein, 419 aa, Clostridium difficile 630
MSQSMVGKHAMWPKENDVIFSISGRAQAAEKAFGMDNVINATIGALMDDSGKLITMKTVYEEYKALDNCEIGAYAALEGQPDYLEAVKKVFFRDYLPEGHIRVLASPGGSGAIKLAVWNYTNEGDEVLTSDWFWSPYVSIAEEANRKVVNYQLFDENRRFNFESFKEKFVNIAEKQGRVFTIINTPAHNPTGYSVADDEWDKILDLSKEVAKDKDKKIIFFVDSAYIDFAGDDDVCRKFFKKFSNLPENVLVLVGFSMSKGFTAYGMRMGAIICISSSEDVAEEFHYSCVHSCRANWSNCNRSAMAVLSNIVNDPKKFKEYEDEKEIYKNMLTRRADVFVKEAERVGLEILPYIAGFFVSIPCDNPKEVCEELTKHNLFAVPLKMGLRFAVCAVSEDKCKKAPSIIKEALESLEVKINN

SEQ ID NO: 29494 - protein, 341 aa, Streptococcus suis 89/1591
MKAVVVNPESTGVVVVDKELRSLEAGEALVQIEYCGVCHTDLHVANGDFGKVPGRVLGHEGIGIVTEIAPGVTSLKVGDRVSVAWFFQGCGMCEYCTTGRETLCRTVKNAGYSVDGGMAEQCIVTADYAVKVPEGLDPAQASSITCAGVTCYKAIKEAHLEPGQWIAIYGAGGLGNLAVQYAKKVFNAHVIAVDINNNKLELAKEVGADVTINGLEVEDVPGYIKEITGGGVHSTVVTAVSKVAFNQAIDSVRAGGYVVAVGLPSEYMDLSIVKTVLDGIKVVGSLVGTRKDLEEAFHFGAMGLVVPVVQKRPVEDAEAVFNEMVAGTIQGRMVLDFCHSH

SEQ ID NO: 29495 - protein, 308 aa, Xanthobacter autotrophicus Py2
MTFSLKDRLDASAAATEARLALALADAALPGERLRPERLMAAMRHGALGGGKRLRPFLVIESAALFGIPADQAVTAATAIECIHCYSLVHDDLPAMDDDDLRRGRPTVHRAFDEATAILAGDGLLTLAFDLLAGEDAHPDPAVRIALVRALARASGIGGMVGGQMLDLAAEGRFSGGTPLALAEDAIRDLQAMKTGALLAVSVEAGALLGGATADERAALLAYGRALGAAFQIADDILDVEGTAEEVGKKVGKDAAAGKATLVSRLGLPAARTLLDRLVADASAALAPFGARGAVLAEAALFVANRRN

SEQ ID NO: 29496 - protein, 449 aa, Triticum aestivum
  misc_feature (5)..(5): Xaa can be any naturally occurring amino acid
  misc_feature (382)..(382): Xaa can be any naturally occurring amino acid
  misc_feature (393)..(393): Xaa can be any naturally occurring amino acid
  misc_feature (441)..(441): Xaa can be any naturally occurring amino acid
GEACXKYGSIFRRPQGLYVSLSHAAEVIDVLRNWPERNIQVIVVTDGERILGLGDLGCQGMGIPVGKLSLYTALGGVRPSACLPITIDVGTNNEQLLNDEFYIGLRQRRATGEEYHELMEEFMDAVKQIYGEKVLIQFEDFANHNAFDLLAKYSKSHLVFNDDIQGTASVVLAGLLSSLKVVGGTLAEHTYLFLGAGEAGTGIAELIALEISKQTNAPIEECRKKVFLVDSKGLIVSSRKNSLQPFETSWAHEREPVTTLLDAIKSIRPTVLIGTSGVGRAFTKEVIEAMASFNERPVIFSLSNPTSHSECTAEEAYKWTKGRAVFASGSPFDPVEYDGKIHVPGQANNAYIFPGFGLGVVISGAIRVHEDMLLAASETLAXRATQENFRQGXSSFPPFTNIRKISALIAASVAAKAYELGLATRLPRPRDLEKYAESCMXTPVYRSYR

SEQ ID NO: 29497 - protein, 277 aa, Psychrobacter arcticus 273-4
MSVLDNKKISFIGGGNMAQALISGMVSCGIKPNLITVSDPSSEAREQLAAKGLNTVDPMTDAKAAVIDADIVVLAVKPQVMKAVVSAFADVLDKQLVISVAAGLSTDVLSSMLGGYRNIVRAMPNTPAMIQMGATGLYGTDDISAEQKQLATAVMEASGLVMWVEDEAHMHAVTAVSGSAPAYMFYIIEAMVDGAVALGLDKEQASALAMQTMLGAAKMAMGSEDAPAELRRKVTSPNGTTQAAIESMQANDIGRQISEAMQACYDRSQALSEEMSK

SEQ ID NO: 29498 - protein, 355 aa, Oryza sativa Japonica Group
MEQVVNAVLDLVVPPASMVMLAFAWPTLSFLRGVEWVVKTLTVENMHNKVVLITGASSAIGEQIAYEYARRNANLVLVARREHRLFAVRENARALGAGQVLVIAADVVKEDDCRRLVGDTISFFGQLNHLVNTVSLGHDFCFEEAGDTVAFPHLMDVNFWGNVYPTYAALPYLRRSHGRVVVNAAVEIWLPMPRMTLYSAAKAAVIDFYESLRYEVGDEVGISVATHGWIGGEASGGKFMLEEGAEMQWKGEEREVPLAGGQVEAYARMVVAGACRGDAHVKHPNWYDVFLVFRAFAPDVLAWTFRLLLSTPSPSPPASARRHQLAALPAPPLHPLLEYPSARSPGRAAQQHKLE

SEQ ID NO: 29499 - protein, 325 aa, Streptococcus thermophilus LMG 18311
MEEIMSYTNLKLFALSSNQELAAKVADKIGIELGRSSVREFSDGEIQVNIEESIRGHHVFILQSTSSPVNDNLMEILIMVDALKRASAETINVVMPYYGYARQDRKARSREPITSKLVANMLEVAGVDRLLTVDLHAPQIQGFFDIPVDHLMGAPLIADYFDRAGLTGDDVVVVSPDHGGVTRARKLAQCLKTPIAIIDKRRSVDKMNTSEVMNIIGNVEGKTCILIDDMIDTAGTICHAADALAEAGATNVFASCTHPVLSGPALDNIQKSAIEKLVVLDTIYLPEERLIDKIEQISIADLISEAIIRSHEKRPLSPLFEMGHK

SEQ ID NO: 29500 - protein, 290 aa, Acinetobacter sp. ADP1
MIQSVAFIGLGAMGYRMASHLPRHFDTVYVWNRSFEKAKQHATEYGTQAVELSQAVQADIIFSCLPTSADVAQLVENLELKPGTIWVDCTSGVPDLARQLVTQLKNQGVDYLDAPVSGQTIGADNATLTVMVGGDFTAFERAYPAMQAFGKLIKHVGESGAGFAVKAVNNMLLAVNLWSVAEGFTTLKAHGVNLGEALDCINASSGKSGVTETIFPQRVLNRSFPVTFALPLLAKDAGIALDLVHAAKLPAPLIALTQSLIQAANQTAEENSDFSAAVKMYESWSKITLE

SEQ ID NO: 29501 - protein, 269 aa, Rhizomucor miehei
SINGGIRAATSQEINELTYYTTLSANSYCRTVIPGATWDCIHCDATEDLKIIKTWSTLIYDTNAMVARGDSEKTIYIVFRGSSSIRNWIADLTFVPVSYPPVSGTKVHKGFLDSYGEVQNELVATVLDQFKQYPSYKVAVTGHSLGGATALLCALDLYQREEGLSSSNLFLYTQGQPRVGNPAFANYVVSTGIPYRRTVNERDIVPHLPPAAFGFLHAGSEYWITDNSPETVQVCTSDLETSDCSNSIVPFTSVLDHLSYFGINTGLCS

SEQ ID NO: 29502 - protein, 394 aa, Streptococcus thermophilus LMG 18311
MTVMDLTQRFNKNLDKIEVSMIRQFDQSISDVPGIKKLTLGEPDFTTPDHVKEAAKTAIDANQSHYTGMAGLPDLRQAAANFVKEKYNLTYNPDNEILVTIGATEALSASLTAILEPGDTILLPAPAYPGYEPIANLVGAKIVEIDTTANDFVLTPEMLEKAILEQGDKLKAVLLNYPTNPTGVTYSRQQIEDIAEVLKKYDIFVVSDEVYSELTYVDQHVSIAEYLPEQTILINGLSKSHAMTGWRIGLIFAPASLTAQLIKSHQYLVTAAATMAQFAAIEALSAGKDDAQPMKVEYLKRRDYILEKMTELGFKIIKPDGAFYIFAKIPEGYNQDSFKFCQDFAREKAIAIIPGVAFGKYGEGYVRLSYAASMDTIETAMTRLKEFMEEHAEA

SEQ ID NO: 29503 - protein, 406 aa, Deinococcus radiodurans R1
MWMNLLLAFLPVSLLLEYVFHAPPLWVFFTATIAIIPLADWLRQATEQIAERVGQTIGGLLNVTFGNLAELIIAIFVLLSGNAVVVKAQITGSIIGNALLGLGLAILIGSVGRQRQKFSWQNAGQLNSMLVLVTIALLIPALFDYTERLPGFAAGSDLARSDLDERLSLAVAVVLIAAYALNLVYTLVTHKDIFALDDGTEEGSAEGPAESTAEGAGHSHVAPWPVWKAVGVLVGATVLIAWMSEILSGALEATSQTLGLSPFFLGIIVLAVVGNFAEYISGSYFARQGKIGLAINIAVGATIQVALFTAPVLVLISYLIGKPMNLVFGSPLELVAIVAVAITVSTVTRDGEATWFEGVLLLTVYVLLALAFFFVTPRGEEGAPAALYAPAPALVQAAPERLALAS

SEQ ID NO: 29504 - protein, 501 aa, Ralstonia metallidurans CH34
MSTDTLRYFDYAATTPADPRVMEAMFGCLGAAGVFGNPASNSHAAGLKAKDLVEQARAQVAALIGAEPSEIVWTSGATESNNLALKGFFDREPTRRHLVTSKLEHKAILDTASYLERLDVSVSYLLPDPSGEISQAAVEAACSHHTGLVSLMMVNNEIGTLTNIAEISRLVHAAGALLHVDAAQAVGKTAIDVKAMGVDLLSMSAHKVYGPKGIGALYVSREVASRIACQMHGGGHEQGLRSGTLATHQIVGMGTACELARTEMASDNERIAQLSERLLSGVRATGAITQNVSSAVRIPHTLSLTVELPNFLPSMLADNLAISSTSACNSAAGKPSHVLTCIGLGKDSAERTVRLSLGRFTTEADVDFAVDCFRGAIERCLEVGAGRQDMQIRQLSNDVSVAPQLSGADVRAAHAIGFRSIVCNRHDGEAAGQTQFAKIAEVASSLGMAAHYLPVESGDVTVEAAAAFGLLVAELPKPVLAYCRTGTRSATLWNLASSRQG

SEQ ID NO: 29505 - protein, 815 aa, Wigglesworthia glossinidia endosymbiont of Glossina brevipalpis
MRVLKFGGTSISSLKCFSKVVNIIKKNYKKDQIAVVLSAPKKVTDNLFYMIEKSCQTKDIKEIFNNTKDIFFYLIKSLFDSNENYYYLNIYNFIELKFNRLLYLLNIVFNLKFCPNSINAEIVCMGEIISVKLMELYLKNKNIDVFVIDPKKIFLSKGQYLESFIDIKESERRIKKINFPKNKVILMAGFIAKNKYGELVALGRNGSDYSATALAACLKANVCEIWTDVDGIYTGDPNKIKNTKLINKLSCKEAISLSYLGAEILHKRSIFPILEFNIPCIIKNTNNSNSYGTSILNIVNDEKEIIKGITFLKDIAMISIFICYNIKTINIYNRILVAFKKSNIKIIFMMQSSSESNINIFIFQNNLSESKCIIEYEFCFEINNKLFESIHYKSDLFILSMIGSNIFKNKNIFINIVKFFNFIHKKMISILYGGYLSNAFSVVLESCNIVNDLNNMHKIFFEKKNFIEIFIIGNKNIKNCLFNLFYKKKFFFKKKHIELKICGISDAKKLLINENGINLKHWKYNLSNSKIIFDSDIIIECLKKNNFLNPVIVDCTQNKIISKKYADFLIQGFHIVTSNKQPNISSIDYYKKIRNMSIISNKKFLYNANFNTQFPIIENIKSFLNLSENKNYYFSGVLSSAISFIFERLNKGMSFYKIIVLALQSGFSLKDIYHAILGKDSAENLLIIARELGYNIEIKDIEIKPIISKKFLKKNIKKEIFNISISVDNKFKKKLQKAKIQGNVLNYVSNIKNGKFIIKIQEASPNNPLFKVKSKENIFIFYTNSHKSFPIILKSFSYKKNIYIFNILNDLLKLT

SEQ ID NO: 29506 - protein, 122 aa, Triticum aestivum
  misc_feature (88)..(88): Xaa can be any naturally occurring amino acid
MAQPLTRRRLLLPPPLLLLMLLLALAAHHQAASDPPATHGGMRASGTRSLLQQQPPPPRLDCPKVCAGRCANNWRKEMCNDKCNVCCXRCNCVPPGTGQDTRHICPCYATMTNPHNGKLKCP

SEQ ID NO: 29507 - protein, 623 aa, Vitis vinifera
MASVSGICSSSYPFKSKHFTARSSPSSTIMPSFRIDSLTFPTRPKLDDRTLVLTPSVAREVSADLSKSDPSPKKKGLEKDPGALWRRYVDWLYQHKELGLFLDVSRIGFSEEFVEEMEPRFQAAFRAMQELEKGAIANPDEGRMVGHYWLRSSKLAPNPFLKLQIENTLEAVCKFAEDVVSGKIKPPSSPEGRFTHVLSVGIGGSALGPQFVAEALAPDNPPLKIRFIDNTDPAGIDHQIAQLGPELASTIVIVISKSGGTPETRNGLLEVQKAFREAGLDFAKQGVAITQENSLLDNTARIEGWLARFPMFDWVGGRTSEMSAVGLLPAALQGIDIREMLAGASLMDEANRTTVVRNNPAALLALCWYWASEGVGSKDMVILPYKDSLLLFSRYLQQLVMESIGKEFDLDGNRVNQGLTVYGNKGSTDQHAYIQQLREGVHNFFVTFIEVLRDRPPGHDWELEPGVTCGDYLFGMLQGTRSALYAKDRESVTVTVQEVTARSVGAMIALYERAVGIYASLVNINAYHQPGVEAGKKAAGEVLALQKRVLAVLNEASCKEPVEPLTLDEVAERCHAPEDIEMIYKIIAHMAANDRALIAEGSCGSPRSIKVFLGECYVDDLYA

SEQ ID NO: 29508 - protein, 323 aa, Triticum aestivum
  misc_feature (254)..(254): Xaa can be any naturally occurring amino acid
  misc_feature (269)..(269): Xaa can be any naturally occurring amino acid
  misc_feature (286)..(286): Xaa can be any naturally occurring amino acid
MASQQPSLAILVREPDGFTVWPGPPYPPGSSPPQRLPKTACSATSFSSDGSRLLATVASASATVYDCSSLSVIRSFDLPGLTAAALSPTGSYLQTFQKSSSPQVKNVTVWHVDTATALYQHYQKNLSKANWPMVQFSADESVACRMATNEMQFFDTNDFTKGIVYKVRLPGIAAMQLASAPGSHVAGFVPEAKGVPASVQIFSCDKDAQNQVVARRSFFRCSTVQFHWNKGSTGLLIVSQADVDKTNQSYYGEXTQLHYLTTDRALEGXIVPLKKEGPVHDVQWSXLQVQRFAVVSMDICCQAPYQQKGILFIAGEALYTIDG

SEQ ID NO: 29509 - protein, 173 aa, Kineococcus radiotolerans SRS30216
MSTPVVFDATIEIPKGQRNKYEVDHETGRIRLDRMLFTSTRYPHDYGFIEGTLGEDGDPLDVLVILEEPTFPGCLISCRAIGMFHMRDEAGGDDKVLAVPAGDPRWEKIQDLGDISEFDRLEIQHFFETYKDLEPGKSVEGANWSGRAEAEKEIAASYERAAGTSYEAGAGHH

SEQ ID NO: 29510 - protein, 609 aa, Glycine max
ENKLYGEFLINAQGEDVVAGIRTPEDLEVMKTCMPEAYKELEENCEILEKHYKDMMDIEFTVQENRLWMLQCRSGKRTGKGAFKIAVDMVDEGLVDIRSAIKMVEPQHLDQLLHPQFEDPSTYKDKVIAIGLPASPGAAVGQVVFTADDAEEWHAQGKSVILVRNETSPEDVGGMHAATGILTARGGMTSHAAVVARGWGKCCVSGCSDILVNDAEKVFVVGDKVITEGEWVSLNGSTGEVILGKQPLSPPALSDDLETFMSWADEIRHLKVMANADTPEDAVTARQNGAQGIGLCRTEHMFFASDERIKAVRMMIMAVTPEQRKAALDLLLPYQRSDFEGIFRAMDGLPVTIRLLDPPLHEFLPEGDLEHIVSELTSETGMKEEEIFSRIEKLSEVNPMLGFRGCRLGISYPELTEMQARAIFQAAVSVSNHGITVLPEIMVPLIGTPQELRHQVNLIRNVADKVLSEMGSSLSYKVGTMIEVPRAALVADEIAKEAEFFSFGTNDLTQMTFGYSRDDVGKFLPIYLSSGILQHDPFEVLDQKGVGQLIKICTEKGRAARPNLKVGICGEHGGEPSSVAFFAEIGLDYVSCSPFRVPIARLAAAQVAV

SEQ ID NO: 29511 - protein, 154 aa, Zea mays
MGPQLIGQGLGGRPFKMKFGLHGGNPPVCVFRSGGVDISAQTHNYAVAPESFPEGAEVTPVIFNANSCVGLQYPKRKLGFFQSHPDFSPGPQDSDPPFGGFIEFMKSTSLWGGGVLAKVNNFFGVFSHQAQKNLFLFSVFFWDVHVLEFWVRGT

SEQ ID NO: 29512 - protein, 548 aa, Wigglesworthia glossinidia endosymbiont of Glossina brevipalpis
MKNINPTKTKSWNLLKKHFNNMKKVNIKDLFEKDKNRFSSFSICFDDIILIDYSKNIITKETIKKLIQLAKECDLNNAILSMFCGKKINYTENRAVLHTALRNHKNISIEIDGINIIPKIKKVLNKMKNFCSDLIDGNWKGFTGERITHIVNIGIGGSDLGPYMVTEALKFYKNHLNVYFVSNIDGTHITEILKYLSPKNTLFLIASKTFTTQETITNAYSAKDWFLKYAKDKKYLSRHFIALSSNIDEVKKFGINTENIFELWNWVGGRYSLWSCMGLSIALSIGFNNFEKLLRGAYAMDQHFLKQPFEKNIPIILGLISIWYNNFFNFETESILVYDQYMHLFSSYFQQVNMESNGKSIDRNGNLVNYQTGSILWGGYGTNSQHAFYQLMHQGTKIVPCDFIVPIISHNPVSDHHQKLLANFFAQTKALAFGKKSENNHIKLYKYDSNKIKILPFKILPGNRPTNSILIKEINPYNLGSLIAMYEHKIFTQGVVLNINSFDQWGVELGKQLSKKLFSILRKEKILNTSSYDSSTNGLINFYKLWKK

SEQ ID NO: 29513 - protein, 449 aa, Legionella pneumophila str. Lens
MAIYQTQLHKILSGTRNKHHSGLLHCGRISRAIGLTIEAKGFNQPIGARCLVKINDEHSVQAEVVGFSNESVYLMSIGDIQGIAPGMKIIPTGRIAQVNVGHQLLGRILNGSGMFIDDGPPGEMVETYPLIGQVINPLKRAPIEVPLDVGIRAINGLLTVGRGQRIGLFAGSGVGKSVLLGMMTRFTEADVVVVGLIGERGREVKEFIECNLGLEGLKRAVVVAAPADESPLMRLHGAKVATSIAEYFRDQGKHVLLLIDSLTRFAQAQREIALSIGEAPATKGYPPSVFAKLPKLVERAGNGTAGGGSITAFYTVLTEGDDLQDPIADAARAILDGHVVLSRALAEQGQYPAIDLEASISRVMQGVVSEQHMKDMLLFKKYLSVYEKNKDLILLGAYAKGSDPLVDKAILAVNKLKDYLAQGMDEQVSYGESLLSLSKLISTLVGNDQ

SEQ ID NO: 29514 - protein, 297 aa, Escherichia coli
  misc_feature (1)..(1): Xaa can be any naturally occurring amino acid
  misc_feature (35)..(35): Xaa can be any naturally occurring amino acid
  misc_feature (165)..(165): Xaa can be any naturally occurring amino acid
  misc_feature (212)..(212): Xaa can be any naturally occurring amino acid
  misc_feature (232)..(232): Xaa can be any naturally occurring amino acid
  misc_feature (264)..(264): Xaa can be any naturally occurring amino acid
XKPQVYHVDAFTSQPFRGNSAGVVFPADNLSEAQXQLIARELGHSETAFLLHSDDSDVRIRYFTPTVEVPICGHATVAAHYVRAKVLGLGNCTIWQTSLAGKHRVTIEKHNDDYRISLEQGTPGFEPPLEGETRAAIINALHLTEDDILPGLPIQVATTGHSKVXIPLKPEVDIDALSPDLNALTAISKKIGCNGFFPFQIRPGKNETDGRXFSPAIGIVEDPVTGNANGPXGAWLVHHNVLPHDGNVLRVKGHQGRALGRDGXIEVTVTIRDNQPEKVTISGTAVILFHAEWAIEL

SEQ ID NO: 29515 - protein, 315 aa, Psychrobacter arcticus 273-4
MPYLAIFTGNAHPELAKTVADHLHIPLGKADITRFSDGEIAVEIKEHVRGKDVFIMQPTCAPTNDNLMEIMMMADALRRSSAGRITAVMPYFGYARQDRRPRSARVPISAKVVADMLNIVSIDRVMTVDLHSDQIQGFFDIPVDNIYGTPVLLNDLQKQNYDNIMVVSPDVGGVVRARAMAKQLGDTDMAIIDKRRARANESQVMHIIGDVRDRDCVIVDDMVDTAGTLCKAAEALKANGARRVVAYITHPVLSGNALKNISESELDEIVVTDTIPLSDAAKACSKIRQVSIAPMLAESLRRINNEESISAMFDA

SEQ ID NO: 29516 - protein, 459 aa, Psychrobacter arcticus 273-4
MRLVVIGVNHKTAPVALRERLALVGDDVNIALAQLQGFSDGSVIVSTCNRTEIYALVPESILSPNTLLASSALSVVESSISLNSSTNISSTIISAHILKIKTWLADFKQLSLDEIDPYLYVHRDMHALTHWLRVAAGLDSMILGEPQILGQIKRAVHLAQDQKALSNQLGWIVDQVFAAAKRVRNETQVGAQAVSLSYAAAKLVTQIFDDLPSRTLLVVAAGEMNRLVAMHIAGLGVGRIIICNRNPERAEALAAELRNPKRQIEVRTLQELPQVLAEADIVSSCSGSMDILIDKTMTLRALKSRRYQPMLMIDLAVPRDIDSTVSRIDDVYLYSVDDLQHVIAGNIEQRRQAAVDAELLVSQLVVEMDRRFQVRQVGKDIQQYRSRTHEQVDKLLQESIAKLQGDNANPEDIMIELTRRLTQNLTHAPSKLMRKAAREGDNELLDFVVSGLQDAHRHH

SEQ ID NO: 29517 - protein, 600 aa, Mesorhizobium sp. BNC1
MNDVAQTAEGKAAYRVLARKYRPRDFSQLIGQEPMVRTLTNAFAAGRIAQAWMLTGVRGVGKTTTARILARALNYRTEAVDRPSVDLSVPGEHCEAILEGRHVDVIEMDAASHTGIDDIRDIIEQVRYAPVSARYKVYIIDEVHMLSNQAFNGLLKTLEEPPPHVKFIFATTEIRKVPITILSRCQRFDLRRIDSGLIKQHLAHIGDLEGVDADSDALAMIARAAEGSMRDAQSIFDQAIAHSSGKVTAETVRDMLGLADRARVIDLFEHLMKGDVAAALAEYRAQYDAGADPAAVLTDLAEFNHLVTRMRFVPDAANDGSLPQEERTRGLEFSKNLSVRVLSRTWQMLLKGIQEVQGSSRPISAGEMVLIRIAHAANLPTLDEALKTLEGLPAGNGSGRSSAGSYAPSPPGNGGAQAISSQRMPSGGGGQTMRLIQSSPAEYAASPQPAEAEAPSVPVKSLADITELADANRDIAFKVQFKRCVRLVQIEPGRLSVNLTEDAPKTLLGDLTNRLQKWTGRRWIVSLSNEPGSKTLAEEESGRRETALADARADPTVAAILQSFPGARILDVRIPDAAAEEEAEGAPPEPDLGDDDDDDL

SEQ ID NO: 29518 - protein, 378 aa, Psychrobacter arcticus 273-4
MTALRQDIDPNGLLEYSVVYTDRALNHMSKAFQEVMNDLLSNLKTVYNAEAAVIIPGSGTYGMEAVARQLTIDEDCLIIRNGWFSYRWTQILEKGKFAKSSTVLTAERTEDTEAPKPFAPVDIETAVAKIKEDKSAIVYAPHVETSSGIILSEEYIKALSEAVHSVGGLLVIDCIASGCVWLDMKELGIDVLISAPQKGWSSTPCAGLVMLSAAAIKKVESTESNCFSLDLKQWLTIMRAYENGGHAYHATMPTDSLRQFRDAILEAKEIGFDILRDAQWELGNRVRKVLTDKGIESVAAEGFEAPGVVVSYTERDDMHKGSAFAEAGLQIAAGVPLKVGEPDNFKTFRLGLFGLDKLTDIDGTVERFEKALDEVLAK

SEQ ID NO: 29519 - protein, 522 aa, Physcomitrella patens subsp. patens
MTIPCEYQLMNQNSRKYVVCHARRKPSNEVSVLLDDIHSNKADGNGRATHWEMREWVTSEIQERKCWPASERGRKDAGQGSKETGKLRHRSSRSGKGLSRHTLLDGSVYTTTGLSSVVALARSLYTVLNALLAIAVSSRRARGPWRSGMVTIVREKKSLEAEFPRICVLVHVSQHWLAEGVFSFFLFRVLRVCAGCCVCTLCGDDPEHVGVVKAGYEAAAVVGGRCLSATGRVGYDQDSGGIALGICERETTERVWGMGIWAGHEGRRFGGRGAASGFDGVVACGEGSRWTQGGEVMRSSGVARAKGRPSGNGKPSSSFHIELQIRQLELDAYLSLLRAFSAQSEVITWSKEGLMSDMRKELRVADEQHREMLGKVGQDETLQRIRTWRQTGEDPGMVAHHREPSPSPSVSQNRKKQKMESQQPADATQEPSFADLPDETLRLSQPSRRRNRDEDLQERHVLPRIDETWSTSWPCATHVVSLKIKLTMWPTRRKTCLVSQGMCPTKSTHIGGPIERRHVAPS

SEQ ID NO: 29520 - protein, 330 aa, Catharanthus roseus
MASKTLFFLVILSFSALSTFAENEAEADPGLVMNYYKDSCPQAEDIIREQVKLLYKRHKNTAFSWLRNIFHDCFVESCDASLLLDSTRRVLSEKETDRSFGMRNFRYLEDIKEALERECPGVVSCADILVLSARDGIVSLGGPFIPLKTGRRDGRRSRAEILEQHLPDHNESLTVVLERFGSIGINTPGLVALLGAHSVGRTHCVKLVHRLYPEVDPAFPESHVQHMLKKCPDPIPDPKAVQYVRNDRGTPMKLDNNYYRNILDNKGLLLVDHQLATDKRTKPFVKKMAKSQDYFFKEFARAITILSENNPLTGTKGEIRKQCNVANKLH

SEQ ID NO: 29521 - protein, 294 aa, Candida albicans SC5314
MSSELLQEVPKSIEHVKHIILILSGKGGVGKSSVTTQVALTLVNKGFNVGVLDIDLTGPSLPRMFGVENKQVHQSTQGWVPVSVYNNNNNQGTDSKRGNLSLMSLGFLLGDRGNSVVWRGPKKTAMIKQFLKDVVWGSTETPLDYLLIDTPPGTSDEHIAIAEELRWANPIDGAIIVTTPQQVATADVRKEINFCKKVNFQILGIVENMSGFICPHCSECTNIFSSGGGKALSEQLNLTYLGNVPIDPQFVELVELQNEQENKKLIELYDDCELKPILNGIVDKILDKNLPSRI

SEQ ID NO: 29522 - protein, 1053 aa, Musa acuminata
MAFLIVLALSFSLLAPSSPSPGPASTDQAALLAFKSSVALDPASLLSGWSPVARRHCTWRGVTCDAVSGRVTALNLTGTPSSPLSGRLAAALGNLTELRVLSLPHNAFSGDIPAAAIGSLCRLEVLDLRRNNFSGKIPDEISRLPSLSVLDLSHNSLSGAIPESLIGSSNLQSVDLSFNQLSGKITVDPLGSCSCLTHLRLSSNLLVGRIPPAIGRCTKIQTLLLDRNILEGRIPAAIGQLLDLRVLDVSRNSLTDRIPRELALCQKLSVLRLTNLMDFDSTGGSSNVEEFNAFIGSMPAEIFSIPSLEILWAPRANLDGSLPDSRNGSCSLGILNLGQNYIAGVIPEWLGTCRNLSFLDLSSNYLQGLLPASLGIPCMAYFNISQNSVTGSLPGFLDLDCSYNLASLSKSGDLLVEDNLLIAYSADLLQSTQRDNPFALVLDNSFVVLHDFSQNRFIGPLPSFVMPLDDSFPYGLSLNNNGFNGSISGKLFGSCQVGSGFAVNLTVNKMSGGVNDILTDCWLLKSFEAANNRLHGSIPSEIRNLNLLRHLDLRNNYFNGSTPDKLRGLKSLGQVLLGGNNFSGGIPTQFDGLSSLTVLDLSRNSFTGSIPPSLANATNLEVLLLNNNQLSGTIPPSFSALHRLIELDVSFNNLSGDIPHLEHSTDCKFFLGNSFLKPCQDPSMSAPSGIPFKTEIPDQGHRKSRLKYFTIAAVASASVLVSVLLVLTFVLVSGRRKFVRITSLRKKLVVTFTDVPAELTYENVVRATGNFSIQNLIGTGGFGATYKGELVPGFLVAVKRLSIGRFQGLQQFDAEIRTLGRVRHKNLVTLIGYHMGEIDTFLIYNYLSGGNLETFIRHMSNRNVTWYEVHKIALDVAQALSYLHYSCVPRIVHRDIKPSNILLDEKLNAYLSDFGLARLLEVSQTHATTDVAGTFGYVAPEYATTCRVSDKADVYSFGVVLLELMSGKRSLDPSFSEYGNGFTIVAWGRLLIQENRAGELFSQLLWENGPKDKLVSMLKLALSCTVESLSVRPSMKQTYTENGWHGLMLAGCQ

SEQ ID NO: 29523 - protein, 425 aa, Bacteroides fragilis NCTC 9343
MEELKIAVIGLGYVGLPLARLFSTKYECIGFDLNQSRVDALNSGHDMTLEVSDDLLRKALENGFKCTSNIDEISNCNFYVVAVPTPVDLNNRPDLTPLIGASTTVGKVISKGDIVVYESTVYPGVTEEECLPVVEEVSGLTYNVDFYAGYSPERINPGDKEHTVEKIKKVTSGSTPEIADIVDSVYNSVLVNGTHKAPSIKVAEASKIIENSQRDVNIAFMNELSKIFNAMGIDTNDVIEAASSKWNFIKLKPGLVGGHCISVDPYYLIQKAQVYGVLPRIMSAARRLNDGMGDYVANQVIRLMNKKGILVKDSKILLLGFTFKEDCPDIRNTKVIDIYSTLHEYTSDITVYDAWANSAKVAHEYGISILTAGLDNLVGQFDAVVLCVGHKEFRHMNIRGFLRSDMGVVYDVKAVLSKDIIDGRL

SEQ ID NO: 29524 - protein, 163 aa, Polaromonas sp. JS666
MKHIIAVLLENEPGALSRVVGLFSARGYNIESLTVAPTEDPSLSRMTIQTTGSDDVIEQITKHLNRLIEVVKVVDLTEGSYTERELMMVKVRAVGKEREEMKRMADIFRGRIIDVTEKSYTIELTGDQSKNDAFLEAIDRSAILETVRTGSSGIGRGERILRV

SEQ ID NO: 29525 - protein, 534 aa, Oryza sativa Japonica Group
MLRAALLRSGSGLRRPPMAAPLSTAAAASWLSDSASSPPRVRLLIGGEFVESRADEHVDVTNPATQEVVSRIPLTTADEFRAAVDAARTAFPGWRNTPVTTRQRIMLKYQELIRANMDKLAENITTEQGKTLKDAWGDVFRGLEVVEHACGMGTLQMGEYVSNVSNGIDTFSIREPLGVCAGICPFNFPAMIPLWMFPIAVTCGNTFVLKPSEKDPGAAMMLAELAMEAGLPKGVLNIVHGTHDVVNNICDDEDIKAVSFVGSNIAGMHIYSRASAKGKRVQSNMGAKNHAIILPDADRDATLNALIAAGFGAAGQRCMALSTAVFVGGSEPWEDELVKRASSLVVNSGMASDADLGPVISKQAKERICKLIQSGADNGARVLLDGRDIVVPNFENGNFVGPTLLADVKSEMECYKEEIFGPVLLLMKAESLDDAIQIVNRNKYGNGASIFTTSGVSARKFQTDIEAGQVGINVPIPVPLPFFSFTGSKASFAGDLNFYGKAGVQFFTQIKTVTQQWKESPAQRVSLSMPTSQK

SEQ ID NO: 29526 - protein, 237 aa, Saccharomyces cerevisiae YJM789
MTKFIGCIDLHNGEVKQIVGGTLTSKEEDVPKTNFVSQHPSSYYAKLYKDRDVQGCHVIKLGPNNDDAAREALQESPQFLQVGGGINDTNCLEWLKWASKVIVTSWLFTKEGHFQLKRLERLTELCGKDRIVVDLSCRKTQDGRWIVAMNKWQTLTDLELNADTFRELRKYTNEFLIHAADVEGLCGGIDELLVSKLFEWTKDYDDLKIVYAGGAKSVDDLKLVDELSLRESRFDIR

SEQ ID NO: 29527 - protein, 84 aa, Kandelia candel
KFADENFVKKHTGPGILSMANAGPGTNGSQFFICTAKTEWLDGKHVVFGQVVDGMDVVKAIEKVGSGNGRTSKPVVIADCGQLS

SEQ ID NO: 29528 - protein, 278 aa, Musa acuminata
MRALPEKPLFAAAAGATLVASALLVSSFLDRGLHCSLNPGFSRSADATSELAKALLYYATTTVVPQQSRDEIRLSFDVLRRRSPCNFLVFGLGRDSQMWAALNPGGTTIFLEEDPQWYAAVKKDSPELRAHHVKYRTQLSQAEQLLRGYRKNAECRPGRVDGVEGLQHNGGCPLALVGLPGEVYEREWDVLMIDAPKGYFPEAPGRMAAIYSAAVMARGRRGEGETDVFLHDVDRRVEKSYAMEFLCEKYRVGGTGRLWHFKIPPANDTSAIAADTFC

SEQ ID NO: 29529 - protein, 216 aa, Pseudomonas chlororaphis
MFSTLNPRHRRLASFSLLAVALSLAACNASAPSHTALPPAPEIAWGYRTDLQVQHADRHMAAAANPLAAEAGREMLRKGGSAIDAAIAMQAVLTLVEPQSSGIGGGALIVLWDGKAVRTYDGRETAPAGATEKLFLQADGKPMPFPQAQIGGRSVGTPGVLRALELAHEKHGRLPWAQLFEPAIRLADQGFPISPRLHSMIKTDPYLAKSPDMAAY

SEQ ID NO: 29530 - protein, 274 aa, Picea sitchensis
MSILPQSDSLIIREVWADNLMEEFALIREIVDDYPYIAMDTEFPGIVVRPVGNFKTASEFHYYTLKSNVDILNLIQLGLTFSDEDGNLPRCGTDKYCIWQFNFREFNLDKDMYAIDSIELLQQSGIDFKKNNEDGIDAQVFGELLMSSGIVLNDTVHWVTFHSGYDFGYMLKLLTCQQLPPTPAGFFNLINMYFPTVYDIKHLMKFCNSLHGGLNKLAELLDVKRIGVCHQAGSDSLLTSCAFRKLREGFFNGSTEKYAGVLYGLAFDNGQSVH

SEQ ID NO: 29531 - protein, 216 aa, Zea mays
HNDSLLPEGVSRVQQFVEKPDEKRATEFVKSGGYFWNSGMFLFRASRFLEELKKHDPDIYDTCVLTLERSNHTADTIDIDESTFACCPDNSIDYAVMEKTQLACVVPLTAGWSDVGCWASLWDVNEKDANGNVSKGDVVIQDSKNCMIHGNGKLVSVIGLENIVVVETKDAMMIAHKDKVQGVKQMVNTLNEQGRSETQNHCEVYRPWGSYDSVDI

SEQ ID NO: 29532 - protein, 332 aa, Oryza sativa
  misc_feature (252)..(252): Xaa can be any naturally occurring amino acid
YQQSFTTIESAESATAATSIETAESTTAARDVSPPPAAAPAARDVSPPAAASAARDVSPPPAAARDVSPPSAAHDVSPPAAVSAPPPAVVPAAARDAPPPAVAMAAEMEVDDVDVHEVPECIASMIDRGSVESHRLFLARRTAMEMLRDRGYSVPEAEIARTLPEFRAWWAEKPGIERLAFTTTLVSDPSKKVQLVFCPPEPVKIATIREIYLQTKEENLSRLVLILQSKILSRAREAIKEIFKFKVDIFQXTDLLVIITKHVLKPKLEVLSADQKAKLLKEYNVEDSQLPRMLETDAVARYYGFDKGTGWLKLHYDDGELTGKRVAYRCVF

SEQ ID NO: 29533 - protein, 339 aa, Salmonella enterica subsp. arizonae serovar 62:z4,z23:--
MKSIVIEKPNTLTIETRALPQPAPGEVRVNVKLAGICGSDSHIYRGHNPFAKYPRVIGHEFFGVIDAVGDDINSARIGERVAVDPVISCGHCYPCSVGKPNVCTSLVVLGVHRDGGFSEYAVVPARNAHRIPDSVADHHAVMVEPFTIAANVTGQVNPTEQDVALIYGAGPMGLTTVQALKGVYQVNTVIVVDRIEERLAMAKQSGADWTLNNGQHSLAEFLQEKALKPTLIVDAACHPAILQEAITLASPAARIVLMGFSSDPCEFIQQGITGKELTIYSSRLNANKFPVVIDWLNKGLIDPDKLITHTFDYQHVTDAIELFEKDQRQCCKVLLSFAK

SEQ ID NO: 29534 - protein, 465 aa, Deinococcus radiodurans R1
MTRDRNDRYDNSRDDRFDRQGQGRGVGRPGDMNDRYGHYDYGSMPMDPASGMQQGGQRYGQSSGQGYDRDQRDYSDRGYGGGMGSMGMGRSYSEDQGRYRSMGGQDYGRQGMGQDYGRQDYGRQDYGRQSSGMGSYDDRSGMGSMSYGQRGMGGGGYGQSQSYGSYGDDSRYGQGMGNQRGGMGSGRDEYSYGQSSYGMGGQGYSQQGSQGYQGGGYQGGQSYQGGYGSQGMGQQGYGGSMGGQGMGMSGMGRDYASSTSMSMGSMGTQGGYGQSYGQSQSYGQSGMGSGQQQSYRGKGPKGYQRSDDRVKEAVSDALEDADHVDAENIEVQVQNGEVTLTGTVSDRGQKRRAEECVEHLRGVKDVHNQLRVQQSQGQQAGMSSYGSQMAQGGQSGIGSMGMGSQSGSSSSSSQSSNLGHDAMTSAGNETSSDSSSTGSGSSSATGSTGASSTGSSTSTSSSTQK

SEQ ID NO: 29535 - protein, 522 aa, Wigglesworthia glossinidia endosymbiont of Glossina brevipalpis
MNNQYILIIDFGSQYTKLVARRMKDIGAKFIISSWEIKKKELLKKNIKGILLSGSPMSVLDDKSPYVSKDILNMKVPILGICYGMHTLVKQLGGKVERKSVREFGYASIKILKNHSNLFYDNFEVSEKNYTKRQKVWMSHEDSVINIPKGFSIIASTKNCKYAAIFNKKNKFYGVQFHPEVTHSEKGYLILNRFVKNICNYTNVIKYSLSIRKIILKIKNKVNDEKVILGLSGGIDSFTSAILIHKAIGNNLFCICIDNGLLRNDEILKIKNLIKKVGKINVIYINHKKRFLKSLNGITDPEKKRKTIGNLFFKIFQEQADILKAKWLAQGTIYPDIIESSQNNLLKKDNFIKSHHNVCPLPKGIKLKILEPLKHLFKDEVKKIAKKIGIPKEIIFRHPFPGPGLAVRIIGEIKEEYCNILRMADEIFISELKSENLYFNISQAFSVLLPIKSVAVMGDMRKYEWVISLRAIETLDFMSANWANIPYKILNNVSNRIINEVRGISRVVYDISNKPPSTIEWE

SEQ ID NO: 29536 - protein, 364 aa, Zea mays
MGSRVLHLDVPANSEAYLMRNVPGSVSSPPMNGEKGLFRNQNAGFTALASPVRREIGNRHQLLFKLTPSAMFLDNNGVSCSPDRRQGPSVLMTMTWKMNIVSVTIVSTLSLSGAVPTEPLTWNLIKVWLPVNIIFVGMLITSMFSLKYINVAMLTILKNVANVLTASGETYFFKKQHGTQVWVALMLMIISAVAGGITDLSFHAVGYIWQTLNCVLTAAYSLTLRHVMDSAKQVTKSGNLNELSMVLLNNVLSLPLGIILVLGLNEMEYLLQTSLLRMPEFWLVITASGVLGLGISFTSMWFLHQTSATTYSLVGSLNKIPLSIAGIVLFNVRTSVQNSLSILFGLLAGVFFARAKLRDNSPTL

SEQ ID NO: 29537 - protein, 322 aa, Mycoplasma mobile 163K
MLFTEKIKTSVKNLAKKYKVLLVDGDDSRAQEAARMLQDSDLVEVSLLVENPTNAKGLKFINMNDNKNLKTEFITKILEFRKGKETEESAKSAVETRPFYAAMLLKENYFDAVVGGLLYKTSDILRAAFKIIGSKKGQKTISSSMIMHKNDEAFLFSDISVQIKPDATQLAEIGLNASEFAKALGLKDTVAFLSFSTAKSAVSPESETVSQATEIYNSKTSGIKAIGEIQLDAAIDLKVREAKFGKSSFESKPDVFVFPDLGAGNIGYKLVQRFGNYGAIGPIVNGISKPMNDLSRGSTSEDVFYTVLISVLQAAHNEKESK

SEQ ID NO: 29538 - protein, 387 aa, Oryza sativa Japonica Group
MGDNLMDKVNALGERLKVSGAEVSRKMSAGVSNMSFKMKEFFQGQNMADKIVDEATLETMDAPDWATNLEICDMVNTGNVNSIELIRAIKRRIMLKNPRVQYLALVLLETVVKNCEKAFSEIAAERVLDEMVKLIDDPQTVVNNRNKALMLIEAWGESGDELRYLPVYEETYKSLRSRGIRFPGRDDESLAPIFTPPRSAPSAEPYSAAAQEGYQEIPDESFAPVHVVPAVQVNEAFEVARNSVELLSTVLSSSPQKEALKDDLTTTLVQQCQQCQRTIQRIIETAGDNEAQLFEALSVHDELEKVLSKYKELKEPVVAEPEAEPAMIPVTVEPENSPRTKDGTVGKRAGSGADELLQDLDDMIFGKKGGTSSQQDRKEQKDDFISF

SEQ ID NO: 29539 - protein, 365 aa, Photobacterium mandapamensis
MTLSSAQEIINDIRLGKMVILMDDENRENEGDLIIAADMITPEAINFMATYGRGLICLTLTKDRCQTLNLPLMVQNNHDKFSTAFTVSIEAAADVTTGISAYDRAKTVQAAIAPNASADDIVMPGHIFPLMAQDGGVLIRAGHTEAGCDVARLAGLEASSVIVEILNEDGTMARRPQLEVFGQKHGLKLGTIADLIEYRTQRESHIERLSESELCTEYGVFNLITYRDTIDNQLHYALCKGDINPDSETLVRVHVKDTLKDILHTGATQWSLQAAMQRIQADGGILVIISQIEPSAMILNQINHLDSEHQASLPLPITPQSRQIGLGSQILSELGLCKIRLLSSQSQQYRSLSGFDLEVVEYICN

SEQ ID NO: 29540 - protein, 429 aa, Mycobacterium sp. MCS
MDDTTVRRTTLPGGLRVVTERIPSVRSASVGVWVNVGSRDEGPTVAGAAHFLEHLLFKSTPTRTAVDIAQAVDAVGGELNAFTAREHTCYYAHVLDADLELAVDLVADVVLRGRCAVEDVEVERDVVLEEIAMRDDDPEDTLGDVFLSAMFGSHPVGRPVIGSVESIEAMTRNQLHSFHVRRYVPERMVLAVAGNIEHDDVVAMARKYFGPRLIRGQSAVPPRKGTGRVPGRPTLQLINRDAEQTHLSMGVRTPGRHWDHRWALAVLNTALGGGLSSRLFQEIRETRGLAYSVYSTVDTFSDSGALSIYAACQPERFDEVVRVTTAVLENVARDGITESECRIAKGSLRGGLVLGLEDSGSRMHRIGRSELNYGKHRSIDHTLEQIGAVTRDEVNAVARQLLTRSFGAAVLGPHRTKSSLPKPLQTVGR

SEQ ID NO: 29541 - protein, 229 aa, Glycine max
  misc_feature (56)..(56): Xaa can be any naturally occurring amino acid
  misc_feature (164)..(164): Xaa can be any naturally occurring amino acid
MVKNKVPDWLNSSIWSSSSPSSPPSSAVASPFKQPPRPPSPAVVTPFEPPPPRPTXPSPPAVHDPLPTQRIDDSPREDHGDGFRSAHDVSRQAQLLAELSKKVVDMSELRSLACQGIPDAAGDTFYCLLLGYLPPDRGLWSAELAKKRSQYKQFKEEIFMNPLXSEITRKMFNSTNCDTGDANCARALLSRYEITHGEHPLSLGKTSVWDQFFPDTEIIDQIDPNVSAL

SEQ ID NO: 29542 - protein, 279 aa, Penicillium camemberti
DVSTSELDQFEFWVQYAAASYYEADYTAQVGDKLSCSKGNCPEVEATGATVSYDFSDSTITDTAGYIAVDHTNSAVVLAFRGSYSVRNWVADATFVHTNPGLCDGCLAELGFWSSWKLVRDDIIKELKEVVAQNPNYELVVVGHSLGAAVATLAATDLRGKGYPSAKLYAYASPRVGNAALAKYITAQGNNFRFTHTNDPVPKLPLLSMGYVHVSPEYWITSPNNATVSTSDIKVIDGDVSFDGNTGTGLPLLTDFEAHIWYFVQVDAGKGPGLPFKRV

SEQ ID NO: 29543 - protein, 226 aa, Psychrobacter arcticus 273-4
MTESTHLPPQETSSTQSNKSIFNLPNNLTIARILMIPLFVAIAYWPPAMGIGMPAISDNVIAKVGMSEFSDSLLRHLLLTGVFILAAITDWLDGYFARKLNVVSAFGRFLDPVADKLMVAAALIILVQWHPNIIMAIAAIVIISREIAVSALREWMAELGKSTSVAVSYVGKLKTTFQMIAITVLLLNWESLETIGYVLMVAAVILTLWSMMIYLKAAWPYLKQSG

SEQ ID NO: 29544 - protein, 195 aa, Chlamydia muridarum Nigg
MGSLVGKQAPDFSGKAIVCGEEKEISLSDFRGKYVILFFYPKDFTYVCPTELHAFQDRLGDFEERGAVVIGCSVDDIETHSRWLAVERRAGGIQGTQYPLLADDSLEISKAFGVLNPEGSVALRATFLIDKDGVIRHAVINDLPLGRSIEEELRVLDSQIFFENHGMVCPANWQSGERGMVPSEEGLKEYFQTID

SEQ ID NO: 29545 - protein, 241 aa, Triticum aestivum
  misc_feature (51)..(51): Xaa can be any naturally occurring amino acid
  misc_feature (63)..(63): Xaa can be any naturally occurring amino acid
LAWSRPRSPPTPAPRERRQSEHTNPNPNPPTSPLKPSPATDATQAPNPSEXERGGGGGNPVDXGEMVFFALLVGAELDGLTNLQPRGGCDDPSYPYYFKLRCESCGETSAKTTCVSLNEVVELPTGKGTSNLLQKCKLCSRDGSVVMIPGQGTPLTAEQSQKGEMTCLMVFECRGYEPIEFAFGNGWKAESVHGTPFDIDLSEGEFDEYDEKGECPVALSKLQSTFKVVKKQGFHGKTRYV

SEQ ID NO: 29546 - protein, 392 aa, Salmonella enterica subsp. enterica serovar Paratyphi B str.
MGPAFIAAIGYIDPGNFATNIQAGASFGYQLLWVVVWANLMAMLIQILSAKLGIATGKNLAEQIRDHYPRPVVWFYWVQAEIIAMATDLAEFIGAAIGFKLILGVSLLQGAVLTGIATFLILMLQRRGQKPLEKVIGGLLLFVAAAYIVELFFSQPDMAQLGKGMVIPALPNPEAVFLAAGVLGATIMPHVIYLHSSLTQHLHGGTRQQRYSATKWDVAIAMTIAGFVNLAMMATAAAAFHFSGHTGIADLDQAYLTLEPLLSHAAATVFGLSLVAAGLSSTVVGTLAGQVVMQGFVRFHIPLWVRRTITMLPSFIVILMGLDPTRILVMSQVLLSFGIALALVPLLIFTSNATLMGELVNTRRVKQVGWIIVVLVVALNIWLLVGTVMGLS

SEQ ID NO: 29547 - protein, 263 aa, Candida albicans SC5314
MFIRSLYHRISNTKTITNLIIRNMSSTSKVESAKKLAAYKAVDENFPKDAKVIGIGSGSTVIYAAERIGQLDNKDSFICIPTGFQSKQLIIDNGLRLGTIEQYPDIDIAFDGADEVDPQLNLIKGGGACLFQEKLVAASAKKFVVVADYRKKSDKLGQSWRQGVPIEIVPNSYSKIIQELSKKLGAKNVDLRQGGKAKAGPIITDNNNFLLDADFGEIEIDNVGKLHEQIKLLVGVVETGLFTNMANKAYFGEEDGSVSVWSK

SEQ ID NO: 29548 - protein, 1415 aa, Ustilago maydis 521
MGSQSRNKTALQHVPIAASASSSNDDGSAATQSRPPSEESLPSVQQETNVLSKQLGDLGSARRKDRHLTDKTGILTSEEHKLGDLNVVAAYKAHFRESPFEFLQQFVAYGQGTGWRGYSNYIGAPILYTGCSEESIRSVLNSEQVQERIRKLASSRVEHILPEQPPVSPAGPNKTQKQLAIFKERKKRQIEQQLREEALAILQVSVARIDSLSFIKFFAATVNNILARMYHQGIHISVPQVLELRRVAAYAAERKQSILFLPCHKSHIDYLTVSWLMFRLGIALPHIIAGENLDLPVLGDVLRKGGAFFIRRSFSGDQLYPAVIKEYVETLLASGKNLECFIEGTRSRTGKLLPPKLGILKYVVEGLLDGRTDDVWICPVSLQYDSVIESETYVSELLGKPKEAESLLGLLSGSSSLLQLKMGRIDIRFDTPWSLQGFINEQKERRAAPGYKSERVELDPTSNEMHKVLLLKALGYRVLADINKVSVVMPAALIGTVVLTLRGRGVSRSELIRRVDWLRASINKKGFIVADFGTMNTGEVVDRALNTVMKGLISEERDVMEPTFVPQKRFELSFYRNQVIHIFVSESLAAAALYTKVKQGGTAPMQRMTRKDLLSECLFISSVLRNEFVFGIDSLEVNVDRTIDGMVADGVLEKHPDIKAEEGGSIELSAKERENGREQFDSFLFLIWPFIEGYWLAAVSLFSLIPKEAEAKGYPTEKLPWFAAKDFEKHTQLLGKTLYAQGELSYLESINAATLSQAFTRMEEMGMILRKKSSHQKPVPIMALHPSFWPSQTTKLTDYMDRLSQFRREGKDRREQSIRPKSRVSLYAAGPTFSAESAVGVFGRCWSDFDRKALSYLLSSSIQHPASRQSLALDSRFHITKLSAHVLFKLVSAASLRLRQTSVASPSTSSMSTASSTAVAAVMDKSTKQDDIAAARRFLRYVDASPTPFHAVATTSAMLDAAGFQRIKESELWDDKVKRGGKYYFTRNQSAIVAFAVGAKYEPGNGVHVVGAHTDSPNFQIKPISRKTKEGYLQCGVETYGGGIWASWFDRDLGVAGRVIVSDSKSHDKFTGRLVHIKRPILRIPTLAIHLNRTVNEAFKFNIEDNTVPILGLATEHLNKRADEAAEAAKVTPQAVGTPVMAEKHHSVLLDLLASELGISVEQIQDFELSLYDTQPASIGGINNEFIHSPRLDNQMSCFCATEALIDSLGSAESLNASSSIRAIALFDNEEVGSVSSHGAESNMLPSLIQRLVALPVSSSSSSSSSNPAASNLYEQAIARSFLLSSDMAHGFHPNYPSFYEENHRPKINQGPVIKTNVKQRYATTGPTAFLIRRIAQRAQVPLQSFVVKNDMPCGSTIGPMLSKLGIRTLDLGNPQLSMHSIRETCGTKDVEYKIQLFKHFFDSFEQIDAQLVID

SEQ ID NO: 29549 - protein, 278 aa, Glycine max
MADRGGERGGDRGGERGGFGRGFGRGGRGDRGGRRGGRRGPRQEEEKWVPVTKLGRLVKEGRFTKMEELYLHSLPIKEHQIVEQLCPGLKDEVMKITPVQKQTRAGQRTRFKAFVVVGDSNGHVGLGVKCAKEVATAIRGAIILAKLSIVPVRRGYWGNKIGLPHTVPCKVTGKCGSVTVRMVPAPRGSGIVAARVPKKVLQFAGIDDVFTSSRGSTKTLGNFVKATFDCLMKTYGFLTPDFWRETTFTKAPYQEFTDILAKPTKALMLDAPAEKIEA

SEQ ID NO: 29550 - protein, 166 aa, Candida albicans SC5314
MVKFLLKASAELSNVTGLEPSDTPEHPYEYTFQIECTKCRTTHDKDIQINQYEKHEISGSRGEASFVFRCKECKHEHSASILRTNEKLSTTEDSVNDKASATILEIDARGIDFLKFIPIGEFSAVGSETNTKFADIDLSEGEWYDVDEKSNDEVSIVDVSWEISRS

SEQ ID NO: 29551 - protein, 478 aa, Spiroplasma citri
MDKFNINEKMKRTKIITTIGPSTHSPGAIEELFKTGMTTIRLNFSHGDHAEQGARIVWAREVSAKIGKPISVLLDTKGPEIRAGIMKGGKQEIVAGATVTIYSLPTEYQNREGTGTEITVSYDMSQDLKVGDVVLVDDGKLQLNVTGIKPGIIETKAFNHHIVKTNKRINLPGVDFTLPFLAEKDINDIKFGVEQGIDYIAASFVNTAGNIKEIRKLLKECKAEHVQIIAKIESQIGINNIDEIIAAADGIMVARGDLGLEIPYYDVPYWEKIIIRKCREAGKIVIVATQMLETMTENPSPTRAEVTDVYFATELGSDATMLSGESANGDYPFIAVHTMAMINKRAEHEFYSKLYYEKQLEDAMNSTTGPRADIAKKLANKCKDGKYEYAVVVSNTGELLKTISKFRPNVVILGVSPLPELYTAFGSWHSIFMNKVDNYEAFKTDEKAICEVAKKWGAKIGSTILFARNEEIKEITIK

SEQ ID NO: 29552 - protein, 387 aa, Spiroplasma citri
MSKLLTTTPQEEGFYLPGETSNHIQTWMIWPHMKDKQQKDAFPAQKIFALVAKIISNYEPVQMIVNEQNYLRVKKMLANSNINLIKTHYYDSWARDIGALYLLNEKGEHGAVSFEFNGWGMQNSLMLKAKNFKWDYNVDNKVAITMANTSGVDYYVCPLVLESGSINVDGEGTLYTTEECLLNPNRNPTLTKLEIKQYLKQYLNVKKIIWIPRGLYNDEACGHINNLLQIVEPGHVLLAWTDNKDDLQYERSVEALSLLESTTDAKGRKLKITKIYRPIPLFLTQREAIDHESSLCFKHRMPGFRPPASYLNFHFVNKALISPIFGDPVYDQKAIMVLRKCFPKRKVIPIYACEIIIGGGYGITKMFSKAESNSYLCMRNNYWWWGH

SEQ ID NO: 29553 - protein, 456 aa, Brucella suis 1330
MTAQPNSLEARDIRYHLHSYTDAVRLEAEGPLVIERGDGIYVEDIAGKRYIEAMSGLWSVGVGFSEQRLAEAAARQMKKLPFYHTFSYRSHGPVIDLAEKLVAMAPVPMNKAYFTNSGSEANDTVVKLIWYRSNALGEPERKKIISRKRGYHGVTIASASLTGLPNNHRSFDLPIDRILHTGCPHHYHDALPGESEEQFATRLANELEQLILAEGPHTIAAFIGEPVMGAGGVVVPPKTYWEKVQAVLGRYNILLVADEVICGFGRTGNLFGCQTFDIKPDILVMSKQLSSSYLPISAFLINERVYAPIAEESHKIGTLGTGFTASGHPVAAAVALENLAIIEERDLVANARERGARMQKRLRELQDHPLVGEVRGVGLIAGVELVIDKEAKTGLEQPGALGARANAALQERGVISRAMGDTLAFCPPLIINDQQVDTMVSALEAALNDVQASLGK

SEQ ID NO: 29554 - protein, 365 aa, Photobacterium mandapamensis
MTLSSAQEIINDIRLGKMVILMDDENRENEGDLIIAADMITPEAINFMATYGRGLICLTLTKDRCQTLNLPLMVQNNHDKFSTAFTVSIEAAADVTTGISAYDRAKTVQAAIAPNASADDIVMPGHIFPLMAQDGGVLIRAGHTEAGCDVARLAGLQASSVIVEILNEDGTMARRPQLEVFAQKHGLKLGTIADLIEYRTQRESHIERLSESELCTEYGVFNLITYRDTIDNQLHYALCKGDINPDSETLVRVHVKDTLKDILHTGATQWSLQAAMQRIQADGGILVIISQIEPSAMILNQINHLDSEHQASLPLPITPQSRQIGLGSQILSELGLCKIRLLSSQSQQYRSLSGFDLEVVEYICN

SEQ ID NO: 29555 - protein, 455 aa, Mycoplasma mobile 163K
MSAIMRIHAREVLDSRGNPTIQIEVESEYGYGSAMVPSGASTGEKEAKELRDKGTKYEKNWYGGKGVQTAVDNVNNIIAPKIEGYDVLDQRAIDYEMIKLDGTEFKEKLGANAILGVSLAVAKAAADELNIPLYRYVGGTNGFKLPVPMLNVINGGEHASNTVDFQEFLIMPIGAKTFKEAMQVANKVFHNLKDLLASQGHSTAVGDEGGFAPDLKSHEEVLDFIVSAIKKAGYEPSKKGDKAVAIAIDAASSELFDKKSKTYTFKKLKKAILTKQPGFENLGKVKVEYSSDELVEYFKDLFKKYPIISLEDGFSEHDWDAFTKLNNSVGATHQIMGDDLVTTNPKFIKKAIETKAINSVLIKLNQIGTLSETMDAIEMAHKAGMTCVVSHRSGETEDTTIADLAVALNTGQIKTGSISRTDRVAKYNRLLVIEEELGIVASYEGIQVFHNLKVK

SEQ ID NO: 29556 - protein, 386 aa, Shewanella sp. MR-7
MEVALTKSALLVLEDGTVFTGTAIGADGLSVGEVVFNTSMTGYQEILTDPSYSRQIVTLTYPHIGNTGTNNEDVESNGVHACGLIIRDLPLIASSFRNQQTLSDYLKANNVVGIADIDTRKLTRILREKGAQAGCIMAGADLDEAKALAAAKAFPGLKGMDLAKEVTTETAYQWRKGSWRLVGGLPEDTPAEALKYKVVAYDYGVKQNILRMLVDRGCDVTVVPAKTSAADVLAMNPDGVFLSNGPGDPEPCDYAIEAIQQILKTDTPIFGICLGHQLLALASGAKTLKMKFGHHGANHPVSNIEKGNVMITSQNHGFAADEATLPANIKVTHKSLFDGSLQGIHLTDKPAFSFQGHPEASPGPNDAAPLFDHFIELIEQYRQNAK

SEQ ID NO: 29557 - protein, 550 aa, Salmonella enterica subsp. enterica serovar Paratyphi B str.
MQNPYTVADYLLDRLAGCGIGHLFGVPGDYNLQFLDHVIDHPTLRWVGCANELNAAYAADGYARMSGAGALLTTFGVGELSAINGIAGSYAEYVPVLHIVGAPCSAAQQRGELMHHTLGDGDFRHFYRMSQAISAASAILDEQNACFEIDRVLGEMLAARRPGYIMLPADVAKKTAIPPTQALALPVHEAQSGVETAFRYHARQCLMNSRRIALLADFLAGRFGLRPLLQRWMAETPIAHATLLMGKGLFDEQHPNFVGTYSAGASSKEVRQAIEDADRVICVGTRFVDTLTAGFTQQLPAERTLEIQPYASRIGETWFNLPMAQAVSTLRELCLECAFAPPPTRSAGQPVRIDKGELTQESFWQTLQQYLKPGDIILVDQGTAAFGAAALSLPDGAEVVVQPLWGSIGYSLPAAFGAQTACPDRRVILIIGDGAAQLTIQEMGSMLRDGQAPVILLLNNDGYTVERAIHGAAQRYNDIASWNWTQIPPALNAAQQAECWRVTQAIQLAEVLERLARPQRLSFIEVMLPKADLPELLRTVTRALEARNGG

SEQ ID NO: 29558 - protein, 590 aa, Oryza sativa Japonica Group
MAMQTMQTEQQQQQRRKGSPEMDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSMDTVTRIRNEKARRYLSSMRKKQPVPFSERFPKADPAALKLLQRLLAFDPKDRPTAEEALADPYFKGLAKAEREPSCQPITKMEFEFERRKVTKEDVKELIFREILEYHPQLLKDYMNGTEKTNFLYPSALDNFRRQFANLEENGGKNGDAVPSDRKHVSLPRTTTVHSAPIPPKDHQNITSQVPQRIPGRTGRGACPVIPFENLSAMGPYNQRRVVRNPVLPPATTNLSAYAYHRKSDSSERELQQELEKDRMRYQPSEHFMDAKVVSHMSHDLRASSYYVSKAKSDVADRAALQSNMMQGIGPFNGIAAVGGNYNKVSTVQYGVSRMY

SEQ ID NO: 29559 - protein, 718 aa, Psychrobacter arcticus 273-4
MQTILLVPISRGIGVTSAALGLIRAFDYNGIKAGFMKPFLQDDALDKQNSLDSSSALAMHAFGLKPPKSISRQHVERMIGDDNLDDLMEEVVVNYHTLGDDYDVVICEGLVPTTETSYASQINRAIAHALDARIIFVSTADTSKPAYLADKLDVHAREFGGMASDRMLGCILMRMHDLPNTQSTLENQIVAPGEAIVSLDSGFIQEVQRLSPHFNSEQFRLIGVVPFSDSLSVPRTWDIAAELDATWLNVGEAKSRRINRISLTARSVARVDEVFKRGTLIVVPGDRDDLLLAAGLACINGVPLAGLVLTGGVLPSSTVAELWQSALKTGIPVMSVETDSYETVQNLVHMSAEIPSDDTERAEEVARYVAAHLDLSWIKAYFSQNHEPRLSPSAFRHQVVKKAQIAKKRIVLPEGSEPRTVEAACICQSRGIANCVLLAKRSDVEQVAKNRDLVLPEGLEIIDPDSLDMSKYIAAVVERRKGKTSAEVAAEYLQDTVYLGTTMLQMDEVDGLVSGAIHTTANTVRPAFQLIKTAPEYSLVSSIFFMLLPEQVVVYGDCAINPNPNAEELAEIAIQSAQSAAAFGIDPKVAMISYSTGSSGMGADVEKVTRATQIVRERAPNLKVDGPLQYDAASVMSVGKQKAPDSPVAGQANVFIFPDLNTGNTTYKAVQRSANVVSVGPMLQGLNKPVNDLSRGALVDDIIYTIALTAIQAHSDVI

SEQ ID NO: 29560 - protein, 387 aa, Candida albicans SC5314
MALPSSKKTHSEQHKQILKQLLKEDANRTCADCKVSKNPRWASWNLGCFICIRCSGIHRSMGTHISKVKSVDLDAWTDDQIENMVKWGNANVNQYWEDKLPSGYIPDQSKIENFIRTKYDLRKWTMSKNLPDPLSLNKNKAATTATIQQPKHESKSHSNTTLSNDINLLDDNSGNKSNDEEFGSFTATRSPHKRSNKLAPPPTKTVLPAAPTTSSSPQQQHQHQPLQSAQNTGGSVSSMGRPDLKKSILSLYASPSSSNSFIQQQPQQQQQPQQPLGMNSLSNSLSSLNIQGGNSTTNNNNVYRSSTTVNTQNNHTQRHPLVNSTPSLNNNQPKQNWNNEWTTDTFTSSPSIPSSSASSLAGTSNYKTTSSLNVNGLDDDLFKNVWG

SEQ ID NO: 29561 - protein, 116 aa, Triticum aestivum
ARKVLELERIPRFETNFVLEGGSIHVDGEGTCITTEQCLCHGNRNPHMSKDEIENQLKTHLGVSKVIWLPKGLYGDEMISGHVDNICCFTGPSTVLLSWIDDKSDPQYEHSGAAFD

SEQ ID NO: 29562 - protein, 314 aa, Deinococcus radiodurans R1
MVSSLPVLLDGDPGLDDAVAWLLAFASPETQVLGVTAVHGNVPLQQGVRNTGVVLALAGERAAGVPYFAGADRPLLREGMTATQVHGATGLPAAHLPEPVRGPEAEHAVDFIIRTVRANPGQITLVASGPLTNVALAFRLAPDLPGLLREVVWMGGSTAQGNRTPAAEFNALADPHAAHIVLHSPVPVRMVGLNVTMQCIATPERLEQLRALGNRAGAVSAEMLEFYAGVYRERYGLSGGALHDPLAVAAALSPELLTWQAMNVEVELSEGLNVGRTVCDLYGVTDREKNVQVAVGVDDAAFFKLLLERLGTLP

SEQ ID NO: 29563 - protein, 421 aa, Glycine max
  misc_feature (148)..(148): Xaa can be any naturally occurring amino acid
  misc_feature (352)..(352): Xaa can be any naturally occurring amino acid
MKISDENSSKPINPTSFQGGIECVGNRKMGQNRRALSVINQDLVAEGRPYPCVVNKRALAEKHNVCEKKQADPGHRPITRRFAAQIASTQKNRAEGTKKSNLGNSNSNGFGEHIFVDEEHKSTTDDQPVPMSLEKTEPMHSESDQMEXEMEDIIEEETVLDIDTCDANNPLAVVDYIEDLYAHYRKLEGTSCVSSDYMAQQSDINERMRAILIDWLIEVHDKFDLLHETLFLTVNLIDRFLAKQTVARKKLQLVGLVAMLLACKYEEVSVPVVGDLILISDKAYTRKEVLEMEKLMVNTLQFNMSVPTAYVFMKRFLKAAQADRKLELLAFFLVELSLVEYEMLKFPPLLMXYGFKQWSKTCEWHSNYSEDQLLECSTLMAAFHQKAGNGKLTGVHRKYCSSKFSYTAKCEPARFLLENPL

SEQ ID NO: 29564 - protein, 207 aa, Oryza sativa Japonica Group
MELYDKNGDGVVSYGDFRAQHNESSGEVNSLGFPWWKEEHFNASDADGHGFLNKTEFNDFLNPSDSENPQIINLLCKQEIRQRDKDGDGKLNFEEYFHGLHDHIHGYDYENADISHIGNNTVAKERFSKLDKDSDGFISEHELEPVLDKLHLSERYYARQQAAHAISEADKDHDGRLTLDEMIENPYAFYGSVFLSDDEDYFHDEFR

SEQ ID NO: 29565 - protein, 2216 aa, Arabidopsis thaliana
MSAASSSSVLHLRTNQQLLSLRSLKNSTSVASQLAVTSGVSRRRSCTARCSVKKPVIPESPFLGTRVRRSGSETLQFWRSDGPGRSAKLRTVVKSSFSAVPEKPLGLYDPSYDKDSCGVGFVAELSGETTRKTVTDSLEMLIRMTHRGACGCESNTGDGAGILVGLPHDFYAEAATELGFVLPSAGNYAVGMFFLPTVESRREESKNVFTKVAESLGHSVLGWRLVPTDNSGLGNSALQTEPIIAQVFLTPTTKSKADFEQQMYILRRVSMVAIRAALNLQHGAMKDFYICSLSSRTIVYKGQLKPDQLKDYYYADLGSERFTSYMALVHSRFSTNTFPSWDRAQPMRVLGHNGEINTLRGNVNWMRAREGLLKCNELGLSKKELKKLLPIVDVSSSDSGAFDGVLELLVRAGRSLPEAVMMMIPEAWQNDKNIDPSRKEFYEYLSALMEPWDGPALISFTDGRYLGATLDRNGLRPGRFYITHSGRVIMASEVGVVDVPPEDVMRKGRLNPGMMLLVDFEKHIVVDDDALKQQYSLARPYGEWLKRQKIELKDIIESVPEAERIAPSISGVVPLTFFLETKASNDDDSMESMGIHGLLSPLKAFGYTVEALEMLLLPMAKDGSEALGSMGNDTPLAVMSNREKLCFEYFKQMFAQVTNPPIDPIREKIVTSMECMIGPEGDLTETTEEQCHRLSLKGPLLKIEEMEAIKKMNYRGWRTKVLDITYAKERGTKGLEETLDRICDEANEAIKEGYTLLVLSDRAFSATRVAVSSLMAVGAVHHHLVKTLARTQVGLVVESAEPREVHHFCTLVGFGADAICPYLAVEAVYRLQVDGKIPPKSNGEFHSKEELVKKYYKASNYGMMKVLAKMGISTLASYKGAQIFEALGLSSEVIQKCFAGTPSRVEGATFEMLARDGLQLHELAFPTRGYAPGSAEASALTNPGNYHWRKNGEIHLNDPLAIAKLQEAARTNSVAAYKEYSKRINELNKQSNLRGLMKFKDADVKIPLDEVEPASEIVKRFCTGAMSYGSISLEAHTTLAMAMNKLGGKSNTGEGGELPSRMEPLADGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTVTEMIGRADMLELDREVVKNNDKLENIDLSLLLRPAAEIRPGAAQYCVQKQDHGLDMALDQELIALSKSALEKSLPVYIETPICNVNRAVGTMLSHEVTKRYHLTGLPKDTIHIKFTGSAGQSLGAFLCPGIMLELEGDSNDYVGKGLSGGKVVVYPPKGSSFDPKENIVIGNVALYGATSGEAYFNGMAAERFSVRNSGAKAVVEGLGDHGCEYMTGGTVVVLGKTGRNFAAGMSGGIAYVLDVDGKFNTRCNLELVDLDKVEDEEDKMTLKMMIQQHQRHTNSQLAQEVLADFENLLPKFIKVFPRDYKRVLSAMKHEEVSKQAIERASEEADETEEKELEEKDAFAELKNMAAASSKEEMSGNGVAAEARPSKVDNAVKNGGFIAYEREGVKYRDPNVRLNDWNEVMEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDDDEDAKLQQDLNQMKHNTITN

SEQ ID NO: 29566 - protein, 348 aa, Picea sitchensis
MSKGANYGPDNASDFELPEELLGILPTDPYEQLELARRITSIAVGSRVSKLEAEASKFKIKITEKDQRIYELEEKINQLEKALNETDERLSHSLEEQAKLNHDKSVLAATVKKLNRDVAKLETFKKTLMQSLQEEDEAAQADVTQNTATRRVTSAKLSFSLSSRDDSNVPIGETNQVSSAVSETSNSTLDGDNQASRHGKSKGIPLTPHNNTPPELTPKLTPNGSPKRLSPPQSPRRHSASMSPTRHQFEGRLSSYSSLPASHQATAPTSPPHSRAQAHVRIDGKEFFRQARNRLSFEQFSAFLANIKELNSHRQTREETLHKADEIFGSDNKDLYVIFDSLLHRHLS

SEQ ID NO: 29567 - protein, 326 aa, Salmonella enterica subsp. arizonae serovar 62:z4,z23:--
MLSAILAGLFRPASKEHVVARAMDNAILETILQRVRPLIGQGKVADYIPALASVEGSKLGIAICTVDGQHYQAGDAHERFSIQSISKVLSLVVAMRHYPEEEIWQRVGKDPSGSPFNSLVQLEMEQGIPRNPFINAGALVVCDMLQGRLSAPRQRMLEVVRALCGVSDITYDATVARSEFEHSARNAAIAWLMKSFGNFHHDVPTVLQNYFHYCALKMSCMELARTFVFLANQGEAFHLDEPVVTPMQARQINALMATNGMYQNAGEFAWRVGLPAKSGVGGGIVAIVPHEMAIAVWSPELDPAGNSLAGIAALEQLTQTLGRSVY

SEQ ID NO: 29568 - protein, 503 aa, Brucella suis 1330
MVQEKQFDIFIIGGGINGCGIARDAVGRGFTVGLAEMNDLASGTSSRATKLIHGGLRYLEHYEFRLVCEALMEREVLWANAPHIIHPMRFVLPYHKGGLRPAWLLRLGLFLYDHLGGRKKLPATRTLNMRTDKAGEPLKPLFTKAFEYSDCWVDDARFVALTARDAADRGAKIATRTSVVAASRDGQGWTITLEDTGTGRRENVHARLLVNAAGPWADKVLQGVEGDRQLHNIRLVQGSHIVVRRKFSDPRAYFFQNNDGRIIFAIPYEDDFTLIGTTDQDYKGDPAKVAITDSETDYLCQAASEYFREPVRREDIVWTYSGVRPLYDDGASKAQEATRDYVLKEDAPDGLAPLINVFGGKLTTARKLAEHMLQKIEHRLGRKGAPWTHVAPLPGGDFEDVAFETELKKLEAAYPFLDARHARRLFRLYGTRAYKLLGQASSLGDLGRHFGSDLYEAEVRYLVENEWARSAEDILWRRTKLGLRLTAAEVAAVQGFVEPAIAA

SEQ ID NO: 29569 - protein, 339 aa, Mycoplasma mobile 163K
MKKIAINGFGRIGRVILRTILSDATSSKNIQVIAINDLTDANTLAHLFKYDSIYGNFNGSIKVDEKAESLIINGHKIRILSESDPLKLPWGDLGIDLVIESTGRFATKEQASQHLKSGAKKVLISAPAKGAGIPTVVHNVNHQILNASDTIISTASCTTNSLAPVAHAINKEFGIESGLMTTIHGYTADQKLHDAPHSDLRRARAAATNIVPTSSGAAIAIGLVIPELDGKLAGGALRVPVITGSVVDLTFTTTQPATVKGINEAIKKHANESMRYETNPIVSSDIIGATEGTIFDSLLTQEISSKNGKKLFKITTWYDNESSYVNQVVRTLNYFLKLN

SEQ ID NO: 29570 - protein, 505 aa, Brucella suis 1330
MNKVEFSRTVKPAFAKRYGNFIGGKWVEPRSGRYFENTSPVNGQVLCEVARSDAADVEAALDAAHAARELWGRTSVAERALILNRIADRIEENLPALAAAETWDNGKPIRETTNADLPLAVDHFRYFAGVIRAQEGGISEIDHDTVAYHFHEPLGVVGQIIPWNFPLLMATWKLAPALAAGNCVVLKPAEQTPASILVLMELIADILPPGVVNIVNGFGLEAGKPLASSPRIAKIAFTGETTTGRLIMQYASQNLIPVTLELGGKSPNIFFKDVAAEDDDFLDKAIEGFVMFALNQGEVCTCPSRALIQESIYDRFMKKALKRVEAIVQGDPLDPATMIGAQASSEQLEKILSYLDIGRQEGAEVLAGGERNMLPGDLAGGYYVKPTVFKGHNKMRIFQEEIFGPVVSVATFKDDAEALSIANDTLYGLGAGIWTRDGTRAYRFGRAIKAGRVWTNCYHAYPAHAAFGGYKQSGIGRENYLKMLDHYQNTKNMLVSYSPKKLGFF

SEQ ID NO: 29571 - protein, 344 aa, Brucella suis 1330
MAKTMKAAVVRAFGKPLTIDEVPIPQPGPGQIQVAIQASGVCHTDLHAAEGDWPVKPNPPFIPGHEGVGFVSAVGSGVKHVKEGDRVGIPWLYTACGHCRHCLGGWETLCEEQLNTGYSVNGGFAEYVVADPNFVGHLPKNIDFNEIAPVLCAGVTVYKGLKVTDTKPGDWVVISGIGGLGHMAVQYARAMGLNVAAVDIDDRKLDLARRLGATVTVNAKTVADPAAYIRKETDGGAQGVLVTAVSPKAFEQALGMVARGGTVSLNGLPPGDFPLSIFNMVLNGVTVRGSIVGTRLDLQESLDFAADGKVKATIQTGKLEDINAIFDDMRQGNIEGRIVMDLTQ

SEQ ID NO: 29572 - protein, 213 aa, Triticum aestivum
MMDVRGLRLGYFLVLCLVPFLRHAVAIRFVMDREECFSHNVDYEGDTVHVSFVVIKADTPWHYSEDGVDLVVKDPNGNQVHDSRAKVSDKFEFIVQKRGVHRFCFTNKSPYHETVDFDVHVGHFSYFDQHAKDEHFGPLFEQIRKLDDDLYNVLFEQHWLTAQTDRQAILNENMSTRAIHKALLESAALIAASAVQVYLLRRLFERKLGTSRV

SEQ ID NO: 29573 - protein, 491 aa, Cryptococcus neoformans var. neoformans JEC21
MSSELADVGLIGLAVMGQNLILNMNDKGFKVCAYNRTVAKVDHFLANEAKGTNVIGAHSVKELCSKLKRPRRIILLVKAGKAVDDFIAQLEPYLEKGDIIIDGGNSHYPDSIRRTHELEAKGLLFVGSGVSGGEEGARNGPSLMPGGSDAAWPHIKDIFQKTAAQAQGEPCCDWVGETGSGHYVKMVHNGIEYGDMQLIAEAYDILKRGLELDEDEIAAIFDKWNSGVLDSFLIEITRDILKFKDTDGVPMVRKILDKAGQKGTGKWTAIDALDNGMPVTLIGEAVFARCLSAIKDERVRASKVIPGPPKEAFKGDKQQFIDDLEQALYASKIISYAQGFMLMREAAKVNDWHLNNAGIAAMWRGGCIIKSVFLSDITAAYRENPALENLLLAPFFTKALEKAQAGWRRVIAQSTLWGIPVPAHTTALSFFDGYRTETLPANLIQGQRDFFGAHTFRVVPGMGNDHLKEDEDVHVRWTSTSGNVSSSTYNA

SEQ ID NO: 29574 - protein, 330 aa, Mycoplasma mobile 163K
MTYLVIGGAGYIGSHTVYELIENNNKVVILDNLTTGSNSSIHPEAKFYEGDFKDKKILNKIFDENKEIEIVINFAASIVVSESVYEPLKYYLNNTYGVMILLESMKENNKKFLIFSSTAAVYGQKSNLPIREDEDLNPINPYGSSKQMSEKIIQDYAHVNDFKFAILRYFNVAGAHQNNSIGLVPKKGHKVSHLIPSISSFVFNELDSLKIFGNNYDTKDGTCIRDYIHVQDLAHAHFLAAKYIFENKTNLIVNVGSEKGFSVLEVVKTFEKQLNKKLNYEINPKRDGDPAFLVASTTKIAKILNFKPKFSLEEIVKTELAWRKKILKDK

SEQ ID NO: 29575 - protein, 477 aa, Brucella suis 1330
MTFHQNLIAGEWVGGDDIANINPSDTNDVVGTYARATAEDTKAAIAAAKAAFPAWSRSGILERHAILRKTADEILARKEELGRLLSREEGKTLVEGIGETIRASQIFDFFAGECLRLAGEVLPSARPGIGVEVTREPVGVVGIITPWNFPIAIPAWKIAPALCYGNTIVFKPAELVPGCSWAIADILHRAGLPKGVLNLVMGKGSVVGQTILDSADVNAVTFTGSTGTGKRVAAASIEHNRRFQLEMGGKNPVVVLDDADLNVAVESVVNSAFFSTGQRCTASSRIIVTEGIHDKFVAAAIEKLKTVVVDNALKPGTHIGPVVDETQLQQDMDYIELGRKEGAKLAFGGERLNRETPGFYLQPALFTEATNQMRISREEIFGPVASVIRVKDYEEALATANDTSFGLSSGICTTSLKYATHFKRNSEAGMVMVNLPTAGVDFHVPFGGRKGSSFGPREQGRYAAEFYTTVKTAYTLA

SEQ ID NO: 29576 - protein, 382 aa, Pseudomonas aeruginosa UCBPP-PA14
MIQSKLPNVGTTIFTRMSQLAAECGAINLSQGFPDFDGPPELREAVGRHIAAGHNQYAPMTGLPALREQVAKKIEQFYGRRVSADSEVTITPGATEAIFSAIQALVHPGDEVVVLDPSYDSYEPSVQLAGGRCVHVPLALPDFSIDWQRMAEAIGPRTRLVIINTPHNPSGALISREELDRLAALIRDRDIYLISDEVYEHLVFDGVAHTSVLSHEELYPRSFVVSSFGKTYHVTGWKTGYVVAPPALSAELRKVHQYVNFCGVTPLQWALADYMAGHPEHLRQLPGFYQAKRDLFCDLLLDSRFRFTRAPGTYFQCVDYSAVRPDLDDVAMAEWLTREHGVAAIPVSVFYEKAPDAMRLVRFCYAKREETLRQAAEKLCAI

SEQ ID NO: 29577 - protein, 472 aa, Escherichia coli CFT073
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLNDEFGAVTIGNIERYINDKAFEMGWRPDMSGVKQTGKKVAIIGAGPAGLACADVLTRNGVKAIVFDRHPEIGGLLTFGIPAFKLEKEVMTRRREIFTGMGIEFKLNTEVGRDVQLDDLLSDYDAVFLGVGTYQSMHGGLENEDADGVYAALPFLIANTKQLMGFGETRDEPFVSMEGKRVVVLGGGDTAMDCVRTSVRQGAKHVTCAYRRDEENMPGSRREVKNAREEGVEFKFNVQPLGIEVNGNGKVSGVKMVRTEMGEPDAKGRRRAEIVAGSEHIVPADAVIMAFGFRPHNMEWLAKHSVELDSQGRIIAPEDNDNAFQTSNPKIFAGGDIVRGSDLVVTAIAEGRKAADGIMNWLEV

SEQ ID NO: 29578 - protein, 477 aa, Bacillus licheniformis ATCC 14580
MKGKRSNAWLYFFGALGGVLYGYDTGVISGAILFMKDELGLNAFTEGLVVSAILIGAIFGSGLSGRLTDRFGRRRAIMSAAVLYCIGGLGTALAPSTEYMVAFRIVLGLAVGCSTTIVPLYLSELAPKESRGALSSLNQLMITIGILLSYLINYAFSDAGAWRWMLGLALIPSIGLLIGIFFMPESPRWLLTKGKEEKARRVLSKMRGGERVDQEVKEIKEAEKQDQGGLKELLEPWVRPALIAGVGLAFLQQFIGTNTIIYYAPKTFTNVGFEDSAAILGTVGIGTVNVLMTLVAIRFIDRIGRKPLLLFGNAGMVISLIVLSFSNLFFGNTSGAAWTTVICLGVFIVVFAVSWGPIVWVMLPELFPLHVRGIGTGVSTLMLHAGNLIVTLSFPVLMEAMGISYLFLCYAAIGIAAFLFVFFKVTETKGKVWKRSSRICGTSTAESRQLTHSRLNDRQKDGQGPILFCVKRPADHG

SEQ ID NO: 29579 - protein, 124 aa, Psychrobacter arcticus 273-4
MIMLNWISIAAINMAIAVALGAFGAHGLKAMVSTQQLEWWQTATLYWFVHSLGLLLVGILIRLNYATQTAAWLLQIGVIIFAGSLYAMTLGAPRWFGAITPIGGVLMIAGWLWLALSSARLTNS

SEQ ID NO: 29580 - protein, 614 aa, Glycine max
FGSRFFFHFCNIYVRFGNTLLSLSFLLFLPLLGLLITTTVVTILFLAVKNLEISSFTMDWCQNQNGSFKSTDALCIAAEADEEELDFTKVDKPRPIERCKSCEVRSLSELSKVSENSSYSIDHLDKAASLQPKSGMNTPGSLVLDPQSHPIVSEGWEALMRSLVYFRGQRVGTIAAMDSSDEKINYDQVFVRDFVPSALAFLMKGEPEIVRNFILKTLRLQSWEKMIDKFHLAEGVMPASFKVLHDPVRNHETLIADFGESAIGRVAPIDSGFWWIILLRAYTKSTGDNSLAELPECQKGMRLILNLCLSEGFDTFPTLLCADGCCMIDRRMGVYGYPIEIQALFFMALRCALILLKEDAEGEEFRERITKRLHALSYHLRSYFWLDLKQLNNVYRFKTEEYSHTAVNKFNVIPDSLPDWIFDFMPLKGGYFIGNVSPARMDFRWFCLGNCIAILSSLATPEQSIAIMDLIESRWQELIGEMPLKVCYPALENHEWRIITGCDPKNTRWSYHNGGSWPVLLWLLAAASIKTGRPQIAKRALEIVETRLFKDNWPEYYDGKLGRYIGKQARKCQTWSIAGYLVAKMLLDDPSHLGMVALEEDKHQKPVLRRSNSL

SEQ ID NO: 29581 - protein, 244 aa, Triticum aestivum
  misc_feature (183)..(183): Xaa can be any naturally occurring amino acid
  misc_feature (211)..(211): Xaa can be any naturally occurring amino acid
  misc_feature (223)..(223): Xaa can be any naturally occurring amino acid
  misc_feature (236)..(236): Xaa can be any naturally occurring amino acid
MQLIAEAYDVLKSVGKLTNGELQQVFAEWNKGELLSFLVEITADIFSIKDDQGEGYLVDKVLDKTGMKGTGKWTVQQAAELSVAAPTIEASLDSRFLSGLKDERVAASKIFQGDYSSGETVDKAQLIEDVRKALYASKICSYAQGMNIIKAKSTEKGWGLNLGELGRIWKGGCIIRASFLDRXQEAYDRNGELANLLIDPEFAQEIMDRQXAWREGVCLAIKXGRQHPGMSASLAXFDSYGKDG

SEQ ID NO: 29582 - protein, 496 aa, Bacteroides fragilis NCTC 9343
MKANNLLSQFGDHRQRVQSAITAVCEGRGILLVDDENRENEGDLIFSAQSMTEADMAIMIRHCSGIVCLCITEEKARQLNLPLMVEQNTSKYGTAFTISIEAAEGVTTGVSAADRIQTIRTAIAPNATPESLHHPGHIFPLIARSGGIKERSGHTEGSIDLMKLAGLAPCAVLCELTNDDGTMARLPEIIKFGLEHKYPVVTINDLKEYQTAPDFLPKLVGSFSCPAAENPTTAIMEAAFRHHYMHYRYINCEVGPENLAAAIQGAKAMGWRGFNCSLPNKVEIIRYLDELGESAKIIGAVNTVVIGDDQRATGENTDGKGFVKAISEIITIQDKKIALLGAGGAARAIAVEMALAGVKEITILNRNRDKGQALADLLNSQTVATARFVLWDHPYRFSTDIDIVINATSVGLYSNVDQRLNIDTDTLLPHMVVADCIPNPVYTQLLRDAVRRGCCHVLPGMKMLVYQAVIAIKYWSGVDVDPDIMLEKLKEVVKPA

SEQ ID NO: 29583 - protein, 714 aa, Prochlorococcus marinus str. NATL1A
MPKIIEIPGRSGFYLRVAVPRGKLRDAFGTCDVVKKIGNTREEAEENISSAEIAIQQKFDEKLREEDAKQINKSLPKGIRLEAIKNSNSKEPPKNIEKDLKDAGFSNAAIEALMNFDEKESTNIEEIEQTVPSPCIANNSPRAKFEQFKADSNYLNEPLHSELLNESDHFTNDAVQLLKFHGSYQQDDREHRKRGGTGKDWQMMLRLRNPAGYVPGPLFVALDELSDRLGNQTLRATTRQCFQMHGIKKRNIKEVIGTIVKSMGSTLAACGDVNRNVMAPAAPYEQGSYPAARKLANDIADVLSPKKAEKTYIDLWVDGEMKYAIKPSSEVKKNRKLQLKPGVFSGDKKEPLYGATYLPRKFKCATTVPGDNSVDILTHDIGLVTFTNKKGVLEGCNVYVGGGMGRTHNLDTTFARIADPIGYVEGEHILELVQSILALQRDYGDRKTRRHSRLKYVLHDMGVDWFKKQLTSKYFTRKIENLKHEGDTILEDYLGWHQQSEKLWFVGLPLLSGRLTGRVKKELRNIVEKFALDVRLTPNQDLLLCNIGNYQKASVKRALINIGFMNPGAPDPLARNAMACPALPLCGLAMTEAERFLPELLERINNQLEILEINKSILIRVTGCPNGCARPYMAELALVGSGLNQYQLWLGGSTNLKRLATPYLQKMPIDDLEKTLEPLFLSWKDTGASSSLGDHVTKLGSESVMSLLTSSAAP

SEQ ID NO: 29584 - protein, 446 aa, Oryza sativa Japonica Group
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIAELAVGLATGQIKTGAPCRSERLAKYNQLLRIEEELGAAAVYAGAKFRAPVEPY

SEQ ID NO: 29585 - protein, 403 aa, Vibrio sp. Ex25
MFDVNSVREQFPALNQSVNDTPLVYLDSAATTQKPQCVIDVISHYYSAQNANVHRGSHSLTANATSQFEAARERVANFIGANSSKEIIWTRGATEALNLIAQTYARSTLQPGDEILISEMEHHANIVPWQIVAEQTGAKVIKVPMTSDCQFDISAFKALLSDRCKIVACAQITNVTGTRQPIEKITELAHSVGAVVVIDGAQGIVHEQLDLSVSDIDFYVFSGHKLYAPTGIGVLYGKLELLEAMPPWHGGGKMVERVSFEKTTFSALPGKFEAGTPNVAGAIALAKAIEWYQGFDYHEVEDHLHVLQDKAYRALNALDDIHILGYQPNASVLTFVMDGVHHQDMATLLDQQGIAVRAGHHCAHPLMDALNVKGTVRVSFGIYNTAEDVDRLIAAVEKAVDML

SEQ ID NO: 29586 - protein, 486 aa, Ralstonia metallidurans CH34
MHDEPAQATAPDAPAAHVGRWRDALAAASAGVSDIDSKRTCGRLTRAAGLVLEAVGLRLPVGSDCLIELPTGQHSHGGPRTAEAEVVGFGADRLYLMPQSDVAGLVPGARVYPLEPSPLPNGIIGAGAPREQGSKRLPVGDGLLGRVLDAAGRPLDGLGPITAASEVPLAGTQINPLTRAPIETVLDTGVRAINGMLTVGRGQRMGLFAGSGVGKSVLLGMMARYTNADVIVVGLIGERGREVKEFIENILGEEGRKRSVVVAAPADTSPLLRMQGAAYATRLAEYFRDKGQHVLLIMDSLTRYAMAQREIALAIGEPPATKGYPPSVFAKLPTLVERTGNGPEGGGSITAFYTVLTEGDDQQDPIADSARAILDGHIVLSRSLAEAGHYPAIDVEASISRAMTALIDAPQFASVRRFKQLMSRYQRNRDLISVGAYVPGSDPELDLAIRMYPRMEAFLQQDIHERAGYDASIAQLHDLFERTHHG

SEQ ID NO: 29587 - protein, 349 aa, Haemophilus ducreyi 35000HP
MKLTKLALSTLFALGLSTAYANKLPNITILATGGTIAGSGESAVSSAYQAGQLNIDTLIEAVPEMKKLANIKGEQVVKIGSQDMNDQVWLTLANTINQQCASTDGFVITHGTDTMEETAYFLDMTAKCEKPIVLVGAMRPATEKSADGPLNLYNAIVVAREAKSAKRGVLVAMNDQVLGARDVTKTSTTAVQTFHSPNFGALGYIHNSKVDYERNPESKHTTNTPFDVTKLTDLPKVGIIYAYANMPTEPLKALLDADYQGIVVAGVGNGNMNAENLALLETAAKKGVAVIRSSRVPTGYTTRDAEIDDSKYGFAASGTLNPQKARVLLQLALTKTKDIHTIQQYFEEF

SEQ ID NO: 29588 - protein, 315 aa, Glycine max
MGSAVLSQTIPAVKVSRLFIYPIKSCRGISVSYAPLTPAGLRWDREWVVVNSQGRACTQRVDPKLALVEVELPNDALVEDFEPTSDSYMVLKAPGMKPLNICLSKQHEVTDAVTVWEWTGSAWDEGAEASQWFSDFLGKPCQLVRFNSASEVRQVDPDYVRGQHRTYFSDGYPFLLLSQESLDALNELLKERIPINRFRPNILVEGCDPYSEDLWTEIKISRFSFLGVKLCSRCKVPTINQETGIAGSEPTETLMKTRSGKVIRPNAKNKNKVYFGQNLVWNWMDSSVKGSGKTIKVGDPVYILGNVSSAEEAAA

SEQ ID NO: 29589 - protein, 601 aa, Oryza sativa Japonica Group
MQAFVFIFAVLALLAGDVEGRQGCYPFSCGHLQNISHPFRRRGDPQRCGVPSYELDCRDSKATIRINTGTYYVTSINYTTSVFWVVDASLKDTNSSCPLPRSDQLPFVSGGIQGSHGGWDLALDPGPGATWVSFVNCSQAVRNNSVYVPVDCLSTSSSFVYVFGSWIMPPSVFPIIGNLETSCRYLAMIPLGGWDSPLPHNASFSDIVRSMRNGFAVHFPIIHRWSRIGHIKDCLMGSIRFVIAPLTLLTFLAFKYWKTRIKIDAVEKFLQMQLMLGPTRYAYTDIIAMTSHFRDKLGQGGYGSVFKGVILPGDVHVAIKMLSNYNCNGEEFISEVSTIGSIHHVNVVRLVGYCAEEMRSALVYEYMPHGSLDRFIFSPDKSLSWDKLNEIALGIARGINYLHQGCDMQILHFDIKPHNILLDSNFVPKVADFGLAKLYPRDNSFMPVSAARGTVGYIAPEMISRSFGIISSKSDVYSFGMLLLEMAGGRRNSKQNMSSSSQSYYPSWVYNQLVQQKMGEIANAFNMHELEKKLCVVGLHCIQMKSHDRPTMSEVIEMLEGDVGGLQLPSRPFFCDDEPLPLLVDSCRFSSELTEISEEDE

SEQ ID NO: 29590 - protein, 323 aa, Haemophilus ducreyi 35000HP
MHNKFYRGRFAVAPMLDWTTRHCRYFHRQFSQQALLYTEMITAPAILHAKYDLLEYDPAEQPVALQLGGSDPTQLANCAKLVQARGYTEINLNVGCPSDRVQNGMFGACLMANADLVADCIKAMQDVVDIPVTIKHRIGIDTLDSYAFLCDFIDKIQPYSQDFIVHARKAWLSGLSPKENREIPPLDYERVYQLKRDFPQLNISINGGIKTIDEIKQHLTKVDGVMVGREAYQNPALLGEIDQQLFDQNQPLITARIAVENMLPYIEQQLSKGVYLNHIVRHMLGAFQNCKGARQWRRHLSENACKQGAGIEVVEQALRFVTE

SEQ ID NO: 29591 - protein, 423 aa, Physcomitrella patens subsp. patens
MRNSASRLSFLAGRAVGATLRPMHCAALHNTASDTQPKKESDYLLGTLPETMKAAVLWEPRKAMTIEELKLPRPQVGEVLIRTKACGVCHSDLHVMNNDIPFPIPCVLGHEVSGEVVEHGKHTDSATIERLPVGSRVVGAFIMPCGGCFFCVKGQEDLCESFLKYNRGLGGLYDGTTRLYMSSSGDPVYMYSMGGLAEYCVVPANGLAVIPESLPYSESAIIGCAVFTAYGAMKNAADMRAGETVAVIGTGGVGSSCIQVSRAFGGRIVIGVDISDGKLEMAKQMGATHTINASKEDVPERIREITGGRGVDIAVEALGKPATFKQAIMSVRDGGRAVMIGLAPWGATADIEITRLVRRQIRVFGSYGGRARQDLPNIVGLAEMGFLKIESAVTQKAKLEQASNVYAELEQGRITGRAVIELR

SEQ ID NO: 29592 - protein, 83 aa, Oryza sativa
  misc_feature (21)..(21): Xaa can be any naturally occurring amino acid
  misc_feature (30)..(30): Xaa can be any naturally occurring amino acid
  misc_feature (38)..(38): Xaa can be any naturally occurring amino acid
  misc_feature (43)..(43): Xaa can be any naturally occurring amino acid
  misc_feature (50)..(50): Xaa can be any naturally occurring amino acid
STPSQASHGGARRRAVAAERXGFGRGFGRXGRGDRGGXRGGRXGPCQEEXKWVPVTKLGRLVKEGRFSKIEEIYLHSLPVKEH

SEQ ID NO: 29593 - protein, 140 aa, Hyacinthus orientalis
LKDLQKDPPTSCSAGPVAEDMFHWQATIMGPPALVLMLEDSFELQSTFLRDYPFKPPKVAFRTKVFHPNINSNGSICLDILKEQWSPALTISKVLLSICSLLTDPNPDDPLVPEIAHMYKTDRNKYETTSRSWTQKYAMG

SEQ ID NO: 29594 - protein, 303 aa, Cryptococcus neoformans var. neoformans B-3501A
MFKKRSRPTSVRDKSRIEEAEGSGNEEKVASGSGTPIVDEQEDDTGRTVEELLMLKKLKKSQSRQGIDLEKLNRGEEMKRKGKKKEDPAEKYGLQPGRGMGRGDGEKEKDEEMEDEAERAKRLVRVNNFTQQTNALDVDKHMMAYIEAELAKRRGQAADTTDKSAIEDNDPQAELYRIAEKYQFETRKKKADDEGNVTNSLGMLTSIPEVDLGMDNRLKNIEMTEKAKRDMLEQRKQEAAAAAAAAKEAEDPGYSAARFYRPNQKSASDIYVNSEKRRTTGVPRQESATDEQVYERFKKRMKR

SEQ ID NO: 29595 - protein, 415 aa, Solibacter usitatus Ellin6076
MENVLAILLAGGAGERLYPLTRDIAKPAVPFGGAYRIIDFTLSNCINSDVRRILILTQYKSLELVRHIRDGWNILSPEMGEYVEVLPPMKRVHSDWYQGTADAVFQNFQSIEAESPEVTLILSADHIYKMNYREMIDWHRRHGADITLATLQAPPEEAPRFGVLEIDADYRVTGFEEKPQHGNPKRSQFDPNMVSVSMGVYVFNTEVLLRLLHEDAQDPNSSHDFGKDIIPRHLESTRVVAYDFRDINAKQSRYWRDVGTLDAFYEANMDLVSVTPEFNLYDQRWPIRTKATQQPPAKFVFAQEGRRMGLAVDSIVSAGCIVSGGRVLHCVLSPGVRVNSYCEVEYSILMPNVEVGRYSRIRRAIVSTGAKIPESSSIGFDVETDRANGYQVTEGGVTVVGNFEEGRTKALPYLA

SEQ ID NO: 29596 - protein, 186 aa, Mycobacterium sp. MCS
MANIANVLTGVRFLLVPVFLAALFVGDGHETYWRVVAFVVFAVAVITDRFDGALARSYGMVTEFGTLADPIADKALIGAALIGLSMLGDLPWWVTGVILARELGVTVLRFAVLRHGVIPASRGGKVKTLVQAVAIGLFVLPLAAWPGPWLAVAWVIMVAAVVLTVLTGLDYVLSAIRDSRERPAGH

SEQ ID NO: 29597 - protein, 427 aa, Solibacter usitatus Ellin6076
MTTIVRIFGREILDSRGNPTVEADVYLADGSMGRAAVPSGASTGEHEAVELRDGDKGRYLGKGCLNAAKHINGEIATALHGKDATQQGEIDGAMIALDGTPNKGRLGANAILAVSMATARAAAAAQRTPLYRYLGGVGANTLPVPMMNIINGGAHADNSVDLQEFMVAPFGAKSFSEALRMGVEVFHTLKKVLSKKGYSTAVGDEGGFAPMLKSNEEAIESCLEAITQAGFKPGENVGICLDPASSEFFKGGKYVFKKSDKSERTSEQMVEFWANWVRQYPAILSIEDGMAEDDWAGWKLLTDTVGSKIQLVGDDLFVTNSTRLKQGIEGGVANSILVKVNQIGTLTETLEAMQMAANAGYTAVVSHRSGETEDPFIADLAVATNAGQIKTGSASRTDRICKYNQLLRIEERLGSSAVFPGRKAYSR

SEQ ID NO: 29598 - protein, 248 aa, Solibacter usitatus Ellin6076
MKKLVLIRHGESTWNKENRFTGWTDVDLSDEGRQQATEAAEVLKREGYVFDVAYTSVLKRAIRTLWTVLDGMDLMWIPVHRSWRLNERHYGALQGLNKAETAAKFGEDQVKIWRRSYDIPPPVLTADDPRFPGHDPRYQSLTKEELPLTECLKDTVARFLPLWHDTIAPAIRSGQRVIIAAHGNSLRALVKYLDGVSEADIVELNIPTGMPLVYELDDDLKPLNRYYLGDPEKVKAAMEAVAAQGKKK

SEQ ID NO: 29599 - protein, 252 aa, Hyacinthus orientalis
KLQIFNTATEGLSQETMSARYIVHQYLAATGCVKLRQSKKSMYATGSVKMVYSESEGAAGRMKRNGGGGDNGVFVLWQMSPGMWLVELVVAGYKVVAGCNGKIVWRHLPWLGMNAARGPQRPLRRIIQGLDPKSTASMFANAQCLGEKRVVGDDCFVLKVSADRAAVAERSDGNAEVIRHALYGYFSQRSGLLAYIEDSHLTRVQTPGSDASYWETTIGSTVGDYREVDGVLIAHQGRSVATVFSVRRGLGP

SEQ ID NO: 29600 - protein, 235 aa, Brassica napus
  misc_feature (224)..(224): Xaa can be any naturally occurring amino acid
MSEIEFVADNLGNNNNNSNALFGKYELGKLLGCGAFAKVYHARDRRTGQSVAVKILNKKKLLANPTLVNNVKREISIMRRLSHPYIVRLHEVMATKGKIFFTMEFVKGGELFNKISKHGRLSEDLARRYFQQLISAVGYCHAHGVYHRDLKPENLLVDENGNLKVTDFGLSALTDQIRPDGLLHTLCGTPAYVAPEILSKKGYEGAKVDVWSCGIILFVLAAGXLPFNDPNVMNM

SEQ ID NO: 29601 - protein, 171 aa, Mycoplasma mobile 163K
MNDLNELKKYIQDVKDFPIKGIVFKDISPLLANGEIFRIVVEKMAEKVREVDVIIGPDARGFIFGAAVASYLKKPFVMIRKEGKLPHNTIKIDYKLEYGMGSLEIQKDLIKPGQSVAILDDVLATGGTTKASVELVKKLGAKVTKAVFLMELEFLNGKEKINAEVISLLKY

SEQ ID NO: 29602 - protein, 314 aa, Haemophilus influenzae Rd KW20
MKKIAFIGECMIELNGKPFAEMWQSYGGDTLNSATYLSRVSSSKEIQVHYVSALGTDNLSKQMLKYWQADGIQTNWVLQDEQHQPGLYLIQLDAQGERTFLYWRNQSAARYMVQHPDFAKVIAELQQVDVIYLSGISLAILPKNDRTFLIEQLSSLAKKGTEIVFDSNYRPKLWDSLEEAQDCYLQLLPSVNIALVTFDDEQALWKDKTSRDTLERLHKIGIPKVIVKCGKNGAIFSDRYLSQYGQVIPEPILNVVDTTSAGDSFNAGFLNGYLRNKSLEICCQQGNRIAGIVIQHKGAIIDKVAISHLQSEFN

SEQ ID NO: 29603 - protein, 113 aa, Hyacinthus orientalis
GVTPPSTKPPCAPTPVKPKPKPKPCPPTPSPKKCPANTLKLGTCLDVLGGIIHAGDPAVDCCPLIAGLTSVQAAACLCTAIKLKAGGVNLYVPIAVELLVTCGKKPPPGYKCK

SEQ ID NO: 29604 - protein, 483 aa, Ancistrocladus korupensis
VPEVSTKNLGRIAQIIGPVLDVAFPPGKMPNIYNALVVKGRDTLGQPINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEASAKAMNLEMES

SEQ ID NO: 29605 - protein, 526 aa, Arabidopsis thaliana
MAAIARLPLTHSLPSIFNPSSFLSQSLSFPTYLHRSPFRSFSSVSPILCTSHRDSRSPGSDSNASIVGDLLDYLNESWTQFHATAEAKRQLLAAGFDLLSENEDWNLKPGGRYFFTRNMSCLVAFAVGEKYVPGNGFHAIAAHTDSPCLKLKPKSASSKSGYLMVNVQTYGGGLWHTWFDRDLSVAGRAIVRASDGSFVHRLVKVKRPLLRVPTLAIHLDRTVNSDGFKPNLETQLVPLLATKSDESSAESKDKNVSSKDAHHPLLMQILSDDLDCKVEDIVSLELNICDTQPSCLGGANNEFIFSGRLDNLASSFCALRALIDSCESSENLSTEHDIRMIALFDNEEVGSDSCQGAGAPTMFQAMRRIVSSLGNKQVTECTFDRAIRKSFLVSADMAHGVHPNFADKHEENHRPQLHKGLVIKHNANQRYATSGITSFLFKEVAKLHDLPIQEFVVRNDMGCGSTIGPILASGVGIRTVDCGIAQLSMHSVREICGTDDIDIAYRHFKAFYRSFSSVDKKLVVDD

SEQ ID NO: 29606 - protein, 292 aa, Chlamydia muridarum Nigg
MDDFNVYRSKIEKRLRDSLEDFGKTQSGLRNPIEYALLGGGKRVRPLLVCLFADSIQKRRDVLDTAIAVEYIHTSTLIADDLPCMDNDDMRRGKPSVHKAFDEASALLASYALIPAAYARIRKNAKALKEVVSVQREIEDAYEDVLDLIELRFGVEGVLGGQYEDVFFQSFTEESVINIINKKTSALFEIACVSGWLFGGGAREKTPLVIEFARNFGILFQIGDDLADLSQDNQEEKHMNYALLFGEQAAKDLLNRSFNSCIEILHLLKEKGVKPLEELCKKVFMGGNKHSL

SEQ ID NO: 29607 - protein, 342 aa, Haemophilus influenzae Rd KW20
MKERIKAICLEKPNNVVVKEVPYPEKSDNDVLIQVESMGICGSDIGAYRGTNPLVTYPRILGHEIVGRVIESGIGMSDGVRVGDRVIVDPYVCCGQCYPCSIGRTNCCESLKVIGVHIDGGMQEVIRHPAHLLTKVPDNLPIHQLPLAEPLTIALHALHRTTLKSGEHIVIIGAGAIGLMAALAAVQYGAIPILVDILEQRLEYAKSLGIEHIVNPHKEDDIKRIKEITSGRMAEVVMEASGANISIKNTLHYASFAGRIALTGWPKTETPLPTNLITFKELNIYGSRTSKGEFEEALDMLATNKINASHIITKCIKFEEIPSFISDLSDHPENYLKINAVF

SEQ ID NO: 29608 - protein, 485 aa, Androstachys johnsonii
SGPGVSALEKKNRGRIVQIIGPVLDVVFPRGKMPNIYNALVVKGRDTTGQQINVTCEVQQLLGNNRVRTVAMSATDGLMRGMEVIDTGAPLSVPVGGATLGRIFNVLGEPVDDLGPVDTRTTSPIHRSAPAFIELDTKLKIFETGIKVVDLLAPYRRGGKIGLFGGAGVGKTVLIMELINNIAKNHGGVSVFGGVGERTREGNDLYKEMKESGVINEENIAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRKLAAKGIYPAVDPLDSTSTMLQPNIVGDDHYEIAQKVKQTLQRYKELQDIIAILGLDELSEEDRLNVARARKIERFLSQPFFVAEVFTSSPGKYVGLAETIRGFQLILSGELDSLPEQAFYLVGNIDEATAKATNLEV

SEQ ID NO: 29609 - protein, 264 aa, Glycine max
MSVFDDSFVILGDDASESVPVSGSFDTTTDHSFSAYDGSGQVDDSIDDVFAAPSSDYEAYSNGDDVFGSNGGHDGPILPPPSEMESDEGSALREWRRQNAIQLEEKEKKEKELRNQIIEEANQFKEDFHRRRELTCENNKAANREKEKLYMETQEKFYAEASKNYWKAIAELVPKEVPTIEKRRGKKEQDPKKPTISVIQGPKPGKPTDLSRMRQILLKLKQNPPAHLKLAPQPPPEAAAATTTAATPPKNVPETKPTEAVTAA

SEQ ID NO: 29610 - protein, 355 aa, Aspergillus nidulans FGSC A4
MYRQSFAPPPAHSPPLHHPVPQHVSTVPMMRSPPPPTSQQPQSSAYGNPYQPDIAQGGSGTYAPGFGGFINDPTAQMGFHMGKTAMAAGQEYMEQNFNRYVSIPALKHYFNVSNSYVINKLGLVLFPWRHKPWSRQQARLTTASTGPDGQISHQQYSSMFLPPRDDINSPDMYIPVMALVTYILLSAMLAGFRGNFHPELLGATTTTAIAVIVFEIICLKLAMYILSINNDSQLVDLVAYSGYKFVGIIVTLVASEILTPGRGTGSWVGWVAFIYTFLANAFFLLRSLKYVLLPDSTSDSSMRTGSMHTVARSQRNRRTQFLFIYSYVIQFIFMWVLSREGPSATASALGNGISS

SEQ ID NO: 29611 - protein, 715 aa, Salmonella enterica subsp. enterica serovar Paratyphi B str.
MTTTSAFMLNVRLDNVAVVAIDVPGEKVNTLKAEFAAQVRAILKQIRENKALQGVVFISAKADNFIAGADINMIGHCQNAQEAETLARQGQQLMAEIQALPVPVIAAIHGACLGGGLEMALACHRRICTDDVKTVLGLPEVQLGLLPGSGGTQRLPRLVGVSTALDMILTGKQLRARQALKAGLVDDVVPQTILLEAAVELAKKERLAQRTLPVRERILAGPLGRALLFRLVRKKTAQKTQGNYPATERIIDVIETGLAQGSSSGYDAEARAFGELAMTPQSQALRAIFFASTEVKKDPGSDAPPGPLNSVGILGGGLMGGGIAWVTACKGGLPVRIKDINTQGINHALKYSWDLLETKVRRRHIKASERDKQLALISGSTDYRGFSHRDLVIEAVFEDLPLKQQMVAEVEQNCAAHTIFASNTSSLPIGDIAANAARPEQVIGLHFFSPVEKMPLVEVIPHASTSAQTIATTVKLAKKQGKTPIVVSDKAGFYVNRILAPYINEAIRMLTEGERVEHIDAALVKFGFPVGPIQLLDEVGIDTGTKIIPVLEAAYGERFSAPANVVASILNDDRKGRKNGRGFYLYGEKGRKSKKQVDPAIYKLIGVQGQSRLSAQQVAERCVMLMLNEAARCFDEKVIRSARDGDIGAVFGIGFPPFLGGPFRYMDALGPGEMVATLQRLAALYGPRYAPCEQLVRMAERREHFWTNGETDQGN

SEQ ID NO: 29612 - protein, 295 aa, Bacillus licheniformis ATCC 14580
MTMSKICVIGSSSMDLVVTSPKRPAAGETVLGESFKTVPGGKGANQAVAAARLGAEVHMIGCVGDDHYGKAILDNFQANGVLTDYVEPVTGQESGTAHIVLADGDNSIIVVKGANDHVTPEYVQKALPAIKQADIVLIQQEIPEETVDYVSGLCSSLGIPLLLNPAPARPLRPETVEHAAYITPNEHEASVLFQGMSREEALKRYPEKLFITEGKNGVRYHNGLEERVVPSFPVNAIDTTGAGDTFNAGFAVALSEGQSIESALRFANRAASLSVLKFGAQGGMPKRDEVERELS

SEQ ID NO: 29613 - protein, 178 aa, Prochlorococcus marinus str. MIT 9313
MTAPGPNINGEVPTVLVRDDEGRDLLCFLEQLIPLDDKDYALLTPVDTPVSLFRLSEGNDPELIETIASSEPILSVADVVLQEHDLTLVRSAVTLTVNGELDEPDPEELEDEETDDDSETYELLVSFMVQEQEYGLYIPLDPFFVVARMTDGQAKLVEGEEFDQVQPRIEVELEDREL

SEQ ID NO: 29614 - protein, 355 aa, Physcomitrella patens subsp. patens
CDLIKGSWVPDPRPPQYTNSSCRYIQGHQNCMKNGRPDTGFLHWKWQPEKCDLPRIDAQAFLNAMRNKSMTFAGDSIARNQFQSLLCLLSQVEVPDHTYNAPDDRDNVHVFRTYNFTIAIYWSPYLVHVEDKDITWPDNKTQSVAHIHVDKLDRAWTDRISGVDILQVSTGQWWFKRGLFLQGGQVLGGHICDGWKECEKEIGFADPYRTAIHHLLKDSLSIPGYTGTTILRTFAPDHFEGGAWDSGGRCKRTTPGGVPIGPLTNWMYEIQQEEFKNITGEASESEKQRIRLLDITNLAQIRADGHPDVYMKFQPFANEKKQLPQKDCLHWCLPGPIDTWNDLLVESLRDAVFGS

SEQ ID NO: 29615 - protein, 357 aa, Prochlorococcus marinus str. MIT 9313
MRQHRIVLLPGDGIGPEITAVAKLLLDALGHQHGFKLNFEQHPIGGVAIDASGSPLPASTLEACQASDAVLLAAIGSPRFDALPREQRPETGLLSLRAGLKLFANLRPVTILPALIDASSLKANVIKGVDLMVVRELTGGIYFGQPKGRIEADGDERAFNTMTYSRTEVDRIAKVAFELARDRSGKLCSVDKANVLDVSQLWRDRVDALAANYGDVELSHMYVDNAAMQLVRNPRQFDVLLTGNLFGDILSDEAAMLTGSIGMLPSASLGSEGPGLFEPVHGSAPDIAGQDLANPMAMVLCAAMMLRIGLKENDAARALEGSVERVLAAGFRTGDLMSEGCTQLGCAEMGEQLLQAL

SEQ ID NO: 29616 - protein, 300 aa, Prochlorococcus marinus str. MIT 9313
MSKRHPVVAVTGSSGAGTSTVKRAFEHIFSREKITPAVVEGDSYHRFERMAMKEAMADALAKGENFSHFGPEANLFDKLEELFRTYGQTGGGKKRYYLHSTEEAAEHNSRLGTKLDPGQFTPWEEIPTNTDVLFYEGLHGGVVGDGYDVAACADLLVGVVPITNLEWIQKIHRDNAERGYSAEAIVDTILRRMPDYINHICPQFSRTDINFQRVPTVDTSNPFICRNIPTPDESFVIIHFRKGAREKWGIDFGDLLNMINDSFMSSPTSIVVNGGKMGFAMELILTPIIHRLIEDKHKLS

SEQ ID NO: 29617 - protein, 250 aa, Prochlorococcus marinus str. NATL1A
MIQSISSAIFTEHRPVQIIPSVLPADWANMGQCVKDLELAGVDRIQFDVMDGNFVPNLTFGPEMISACRKYCSVPFETQLMVSQYNCETMLEGYVEASKGANGEPGVVIAHAEANVHLHRILGKIRQLGGSPSVALNPHTPMDMVKDVLDMVDHVLVMTVNPGFGGQAYIPTMLNKITQLRKTILDNGYNVDIEVDGGIKADWSLSQCCAAGANCFIAGSGMFAYPTLKEGCDALRKVANDAQNGIIVEK

SEQ ID NO: 29618 - protein, 599 aa, Bradyrhizobium japonicum USDA 110
MKPTDIAAPDYFHKVVDCQWACPAHTPVPEYIRLIAQGRYSDAYMINWKSNVFPGILGRTCDRPCEPACRRGRVEETPVAICRLKRVAADFKDDITQRLPRPSPKNGKRVALVGGGPASLTVARDLAPLGYHCTVFDADPEAGGMMRSQIPKFRLPNSVIDEETGYILNLGVEFKGGHRIESMKALLTEKYDAIFVGSGAPRGRELDIPGRKEAAANIHIGIDWLSSVSFGHTDKIGKRVIVLGGGNTAMDCCRTARRLGGEKVTVIVRSGFEEMKASPWEKEDAIHEDIPILNYMVPVAFKHVAGKLIGVTFQHVKAEYDAKGRRNLVPSGDPEQTIPCDDVLVAVGQENAFPWIERDCGIAFDKWNMPQVDPKTFVSTNPKVFFGGDAAFGPKNIIWAVAQGHDAALSIHRLLSGEDITERPLPEVHVSSQKMGIHEWSYDNDISVDKRFKVPHRDKVIALKDIRTEVELGYDVKLALGEAHRCLNCDVQTVFSTSLCIECDACVDICPMDCITFTENGEEPDLRQRLKAPSLHPDQDLYVSSDLKTGRVMVKDEDVCLHCGLCAERCPTGAWDMQKYLIEMTHAGSACPTKSRSAA

SEQ ID NO: 29619 - protein, 441 aa, Prochlorococcus marinus str. NATL1A
MHIAVVGLSHRTAPVEVREKLSIPEELVERSFNNLKKIDQILEVSILSTCNRLEIYSLVKDPQLGIEAIKSFLLEFSGLEDEILSPHLFNYVQEKAVSHVMRVSAGLDSLVLGEGQILSQVKKMVRLGQDHHSLGPILNRLLTQAVSTGKRVRSETNLGTGAVSISSAAVELAQLKLGQAHGRDQLMTLETEKVAVVGAGRMSRLLLQHLQSKGCCSLTLLNRTRKRAEDLSAAFPDIQIDCQLIDELDSCLSLSTLVFTSTAANEPIIDAEKLINIDRKPLLRLIDIGVPRNISSDAKSVSGIESHDVDDLQEVVSRNQEARQKLALEAEGLIEEECRVFLEWWDSLAAVPTINCLRSSLESIRKEELQKALSRMGPDFSARERKVVEALSKGIINKILHTPVTKLRAPQSRNDRRDSLDVIEKLFNLDVSSSLNKPKNN

SEQ ID NO: 29620 - protein, 431 aa, Prochlorococcus marinus str. NATL1A
MKRVLAIILGGGKGSRLYPLTKMRAKPAVPLAGKYRLIDIPISNCINSDISKMYVLTQFNSASLNRHIAQTYNLSGPFGQGFVEVLAAQQTPETPSWFEGTADAVRKYQWLFQEWDVDEYLILSGDQLYRMDYSLFVEQHRKTGADLTVAALPVDSAQAEAFGLMRTDEAGNIKEFREKPTGDSLKAMAVDTSRFGLEANEAKEKPYLASMGIYVFSRSTLFDLLNKFPSYTDFGKEIIPEALGRGDKLKSYVFNDYWEDIGTIGAFFESNLALTQQPTPPFSFYDEKFPIYTRPRYLPPSKIVDTQITDSIVSEGSILKSCSIHHCVLGVRSRIESDVVLNETLVMGSDFYESYEERIALRNGGGIPLGVGQGTTVKRAILDKNARIGDNVTIVNKDNVEEADRADQGFYIRNGIVVIVKNATIPDGTII

SEQ ID NO: 29621 - protein, 326 aa, Escherichia coli
LPNITILATGGTIAGGGDSATKSNYTVGKVGVENLVNAVPQLKDIANVKGEQVVNIGSQDMNDNVWLTLAKKINTDCDKTDGFVITHGTETMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKTGTAVVRSSRVPTGATTQDAEVDDAKYGFVASGTLNPQKARVLLQLALTQTKDPQQIQQIFNQY

SEQ ID NO: 29622 - protein, 607 aa, Magnaporthe grisea 70-15
MSMHPGYRGGAAPPQPNGPSRLNELLEGIRAEFEASARAAENYEHQINTQINEMHMVREKVYQMEQTHVQLKAKYEEELAHLRRQLEGRGGGMPQGGIGGPSQHAGPAQPPNIGVGNNVFGAIMSGQTGQPLAPPPPPPQEQQPPQHQMAQPPPGLSGPPPPPPPPSQQPPFQQYPQPPGPGNFPSQPPQSTASPGPGKRGAIGRPPAGGPATPQINNPMPYPGPGQSPQVPNHPTPDHPRGLAQHQPPQPPPGNALGDLDIERIPSHFKKSRDDWWAIFNQAVPRVLDVDLVHTLQHESVVCCVRFSADGKYVATGCNRSAQIFDVNTGEKVCVLQDDNADTTGDLYIRSVCFSPDGKYLATGAEDKQIRVWDITTRTIRIQFAGHEQDIYSLDFARDGRTIASGSGDRTVRLWDIENGTALTVFTIEDGVTTVAISPDTKYVAAGSLDKSVRVWDLTQGCPVERLEGPDGHKDSVYSVAFSPNGRDLVTGSLDKTIKLWELATPRGNMQNQGSKGGRCVKTFEGHRDFVLSVALTPDNQWVMSGSKDRGVQFWDPRTGSTQLMLQGHKNSVISVAPSPTGGFFATGSGDMRARIWSYTRMDNRMA

SEQ ID NO: 29623 - protein, 461 aa, Pyrobaculum aerophilum str. IM2
MSAPRGDHAILRARNLTKRVATLGPSTDVLRPDELIKFLDLVDGVRINLAHASPNEVKFRIEAVRSYEKAKNRPLAVIVDLKGPSIRVGSTSPINVQEGEVVKFKLSDKSDGTYIPVPNKAFFSAVEQNDVILMLDGRLRLKVTNTGSDWIEAVAESSGVITGGKAIVVEGKDYDISTPAEEDVEALKAISPIRDNIDYVAISLAKSCKDVDSVRSLLTELGFQSQVAVKIETKGAVNNLEELVQCSDYVVVARGDLGLHYGLDALPIVQRRIVHTSLKYGKPIAVATQLLDSMQSSPIPTRAEINDVFTTASMGVDSLWLTNETASGKYPLAAVSWLSRILMNVEYQIPQSPLLQNSRDRFAKGLVELAQDLGANILVFSMSGTLARRIAKFRPRGVVYVGTPNVRVARSLSIVWALEPLYIPAENYEEGLEKLISLKGTTPFVATYGIRGGVHSVKVKL

SEQ ID NO: 29624 - protein, 195 aa, Hyacinthus orientalis
PGLQFSLSSSPSFISLSPSHCPLQQPPVCCYLNRSSADSVRMSAGRVSNGGGSGRGVRRSVAVRSSLDTTAAPTVGQVTDVEDSLDTTAGPTVGQVTDVNQDTFWPLVKAAGTKIVVLDMYTQWCGPCKVIAPKFQELSEKYLDVVFMKLDCNNENKALAKELGIKVVPTFKILKDSTVVKEVTGAKFDDFGLCY

SEQ ID NO: 29625 - protein, 1335 aa, Zea mays
MGTEAEQPDMDSHRNDGVVVVPAPRPRKGLASWALDLLESLAVRLGHDKTKPLHWLSGNFAPVVEETPPAPNLSVRGHLPECLNGEFVRVGPNPKFAPVAGYHWFDGDGMIHAMRIKDGKATYVSRYVKTARLKQEEYFGGAKFMKIGDLKGFFGLFMVQMQQLRKKFKVLDFTYGFGTANTALIYHHGKLMALSEADKPWDALFRLCHAAIEDVVKVLEDGDLQTLGLLDYDKRLKHSFTAHPKVDPFTDEMFTFGYSHEPPYCTYRVINKEGAMLDPVPITIPESVMMHDFAITENYSIFMDLPLLFRPKEMVKNGEFIYKFDPTKKGRFGILPRYAKDDKLIRWFQLPNCFIFHNANAWEEGDEVVLITCRLENPDLDKVNGYQSDKLENFGNELYEMRFNMKTGAASQKQLSVSAVDFPRVNESYTGRKQRYVYCTILDSIAKVTGIIKFDLHAEPESGVKELEVGGNVQGIYDLGPGRFGSEAIFVPKHPGVSGEEDDGYLIFFVHDENTGKSEVNVIDAKTMSADPVAVVELPNRVPYGFHAFFVTEHLWTNWLDRRRGSEDTAPADSAHAATTGRPSLLACCPTPGAQVFFGLLVVVGDDHHQVPVVFKKNKTMEATLAFSQDSPPISIICAAKFVGLPLTMDPSLASGFAPTLRFASGESLHGVNPILLYIASGATIPCFSGKNDIEFGHVVEWLEYVPIFLSGSEFENACLFVDGFLASRTFLVGHGLTIADIVVWSNLAGIGQRWESLRKSKKYQNLVRWFNSIDSEYSDTLNEVLAAYVGKRGIGKSPAPSLKEKVHVSKDPSAPEVDLPGAKVGKVCVRFAPEPSGYLHIGHAKAGLLNKYFAERYQGRLIVRFDDTNPSKESNEFVENVLKDIETLGIKYDAVTYTSDYFPKLMEMAGSLIKQGKAYIDDTPKEQMRKERMDGIESRCRNSTVEENLSLWNEMVNGTERGMQCCVRGKLDMQDPNKSLRDPVYYRCNIDPHHRVGSKYKVYPTYDFACPFVDALEGVTHALRSSEYHDRNAQYYRILQDMGLRRVEIYEFSRLNMVYTLLSKRKLLWFVQNKKVEDWTDPRFPTVQGIVRRGLKIEALIQFILQQGASKNLNLMEWDKLWTINKKIIDPLCARHTAVLKDQCVIFTLTNGPEKPFVRILPRHKKFVGAGKKATTFANRIWLDYADAAAISKGEEVTLMDWGNAIVKEIKVESGVITELVGELHLEGSVKTTKLKITWLADIEELVPLSLVEFDYLISKKKLEEDDDFLENLNPCTRRENPALGDANMMNLKRGEIIQLERKGYYRCDAPFIRSSKPVVLFAIPDGRQQALLN

SEQ ID NO: 29626 - protein, 380 aa, Zea mays
MGVYLSTPKTDKLSENGENDRLKFGLSSMQGWRATMEDAHSALLDLDSETAFFGVFDGHGGRVVAKFCAKYLHGQVLKSEAYSTGDLGAAVHRAFFRMDEMMQGQRGWRELSALGDKINKFSGMIEGLIWSPRGSDSNNQQDDWASEEGPHSDFAGPTCGSTACVALIRNTQLVVANAGDSRCVISRGGKAYNLSRDHKPELAAERERIMKAGGFIHMGRVNGSLNLSRAIGDVELKQNKFLPPEKQIVTANPDINVVELCDDDDFVVVACDGIWDCMSSQQLVDFIHERINTESSLSAVCERVLDRCLAPSTIAGDGCDNMTMIIVQIKKPVDRNKKAEAAGQSASNADEAKSRVAEELSMAGTHKGATICFHKAGEKK

SEQ ID NO: 29627 - protein, 470 aa, Mycoplasma mobile 163K
MKNKGKIIQILGPIVDVKFNENQLPKLLNALTIEFEKTKITLEVAQHIGNDVVRTIAMSSTEGLVRNLEVIDTEAPISVPVGKNVLSHMFNVIGENIDNQSIDPNTEKWSIHRKAPSYEEQTATSEILETGIKVIDLLVPYVKGGKIGLFGGAGVGKTVLVQELINNIAVHHGGLSVFAGVGERTREGNDLYYEMKASGVLDKTALVFGQMNEPPGARMRVALSGLTMAEYFRDELNQDVLLFIDNIFRFTQAGSEVSALLGRMPSAVGYQPTLATEMGQLQERITSTRKGSITSIQAVYVPADDLTDPAPATTFIHLDAQTVLDRNIASLGIYPAIDPLASASRMLSADIVGEEHYKIAREVQRILQKFKELQDIIAILGMDELSDEDKNIVYRARKIRNFLSQPFHVAEKFSGIKGTFVKLSDTLRSFRDILDGKYDDLDESAFLYVGTIEEAKQKHLKNYKGDHVEK

SEQ ID NO: 29628 - protein, 203 aa, Aspergillus nidulans FGSC A4
MADPRIEELPDEEVPKTNVEDAADSSESEAGEEPTIPGGAAVTIHSRNEKKARKAIGKLGLKHVPGITRVTLRRPKNILFVINQPDVYRSPSSNTWIIFGEAKIEDLNSQAQASAAQQLAAAEAAGEHAGHDHDHDKGKGKAPETEAKKEEEEDDGEEVDETGLEPKDIDLVMAQANVSRKKAVKALRENDNDIVNSIMALSI

SEQ ID NO: 29629 - protein, 421 aa, Brucella suis 1330
MTTENLLESALVRLDEAASHINIDADVIEKLKFARETMKVRLMIRMDDGSRKSFIAWRCRYDDTRGPTKGGIRYHPDSTVEEVETLAFWMTFKCAVMNLPYGGGKGAIQVDPRQLSKAELERLSRAYIQAFSGIIGPDRDIPAPDVYTNSMIMGWMADEYSQIVGQSSPAVITGKPIALGGSLGRNDATARGGFYLVRHLSHDLGLASVLRVAIQGFGNAGQFMAKLMAGDGHKIVAVSDSAGAVYCADGLDVDLLLAAKADGKSVISTAGHKGHEAISADELVAADCDVLVPSAMENMIHASNAASIRAKLIVELANGPVTGDADKILAEKGVMVLPDILANAGGVTVSYFEWVQNRQGYYWTLEEIHERLKTIMEREGRAIWNHARERGVTLRTAAYVHALERLAQAIEAHGTQNDFAA

SEQ ID NO: 29630 - protein, 365 aa, Leucaena leucocephala
MGSTGETQIIPTHVNDEEANLFAMQLASASVLPMILKSALELDLLEIIAKAGPNAQLSPSNIAAQLPTKNPDAAVMLDRMMRLLACYNVLSCSVRTLPDGKIERLYGLAPVAKYLVKNEDGVSIAPLNLMNQDKVLMESWYYLKDAVLEGGIPFNKAHGMTSFEYHGKDLRFNKVFNKGMADHSTITMKKILETYTGFEGLTSLVDVGGGTGAVISMIVSKYPSINGINFDLPHVIEDAPSYPGVEHVGGDMFVSVPKADAVFMKWICHDWSDEHCVKFLKNCYDALPENGKVIVAECILPASPDSSLATKGVVHIDVIMLAHNPGGKERTEKEFEALAKAAGFQGFRVCCSAFNTYIMEFLKKP

SEQ ID NO: 29631 - protein, 258 aa, Pseudomonas aeruginosa UCBPP-PA14
MFERVREDIQSVFHRDPAARNALEVLTCYPGLHAVWLHRLAHGLWTSGWKWLARLVSNFGRWMTGIEIHPGARIGRRFFIDHGMGIVIGETAEIGDDVTLYQGVTLGGTTWNKGKRHPTLGNNVVVGAGAKVLGPFTVGEGAKVGSNAVVTKEVPPGATVVGIPGRIIMREDTEQQAKRQAMAEKLGFDAYGVSQDMPDPVARAIGQLLDHLQAVDGRLEGMCQALTALGSDYCAKDLPVLREEDFAGVKDEDGNPAA

SEQ ID NO: 29632 - protein, 433 aa, Oryza sativa Japonica Group
MERYKVIREIGDGTCGNVFRAYNTETNEIVAVKKMKRKFFQWEECISLREVKALQKLNHPNIVKLKEVTMENHELFFIFENMECNLYDVIRERQAAFSEEEIRNFMVQILQGLAYMHNNGYFHRDLKPENLLVTDGTVKIADFGLAREVSSSPPYTDYVSTRWYRAPEVLLQSSAYTPAIDMWAVGAILAELFTLSPLFPGGSETDQLYKICAVLGTPDHTVWPEGMNLPRSSSFNFFQIPPRNLWELIPNATLEAIDLIQQLCSWDPRRRPTAEQSLQHPFFNVGNWVPRPLHASHTKTIETRPNPRLELNLWDFGTEPEDNYLDLTLSLKPSFPGTDFSNNVPEHTKEEILLYPGFENPPVQSGFWPLVASDRPMGDVPAMSSWPQAYVVDGQATLPAVGFSGSPFGLSPLQPNLFENRSFATPIRQVNFF

SEQ ID NO: 29633 - protein, 859 aa, Legionella pneumophila str. Lens
MSGILIMQQVVIKFGGTSVSTRATWNNIAAITQKHLNTGVQPVIVCSALTQISNKLEKAIEAALLDEHHSLFNDIQSSHLNLAEQLEVNHQLIANDLHQLQQWLTGISLLKQAPAKTHAQILSLGELMMTRMGHAFLERHEIKVKWYDARELLTSTPTLGGETMNYLSARCESEYDPGLVEKFLSSGAQAIITQGFFAANPHGETVLLGRGGSDTSAALLAGKLQAASCEIWTDVPGIYTANPHQLPHARLLKQLNYDEAQEIASMGAKVLHPNCIPPVRKANIPMVVKYTHLPEHSGTLITKDIDESAPLIKSIQVKHSILLISIDTLNMWQQVGFLADVFAAFKKHGFSVDLLSSSEFNVTLSLDVNAKIHDRPAINALLDDLNQFGRAKLIEPCSAVSLVGHHIRTVLPHLGPALEVFEAKQVYLMSLASNDLNLTFVVDESHADKLCQRLHHLLIESNPQIFYYSKSWHEEFGKPNVRPTPWWEIERDRLLTTSAIHSPCYVYHSPTQAIRARQLSALESIDSLFYAVKANPFPSILKTLEKEGIGFECVSIQELELVLKLFPNIKKERILFTPNFAPKSEYEFALQTGCYVTIDSLYPLENWPELFKNREVIVRIDPGTGAGHHKHVSTGGNESKFGITQNDISKILSLTKSNHIKVIGLHAHSGSGILSTDLWQQTAVMLASLTDQFPEVRSINLGGGLGIVEKPGQHPIDFAALDAQLMAVKSQYPGLAIWLEPGRFFVAESGVILAKVTQCKEKGKVKFIGIETGMNSLIRPSLYGAYHEIVNLTRLHEEKAGFAHIVGPICESGDTLGYDRLLPVTKEGDVILIANTGAYGHCMSSHYNLRPPAQEIVLE

SEQ ID NO: 29634 - protein, 485 aa, Balanops vieillardii
SGPGVSALEKKNLGRITQIIGPVLDVAFPPGKMPNIYNALVVKGRDAVGQQINVTCEVQQLLGNNRVRAVAMSATDGLMRGMEVIDTGTPLSVPVGGATLGRIFNVLGEPVDDLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATTLEM

SEQ ID NO: 29635 - protein, 209 aa, Streptococcus thermophilus LMG 18311
MTYMGWWKESIDIVKKNDPAARTSLEVLLTYPGLKALAAHRISHFLWRHNCRLLARMHSQFWRFWTQIEIHPGAQIAEGVFIDHGSGLVIGETAVVEKGAMLYHGVTLGGTGKDVGKRHPTVREGALVSAHAQIIGPIEIGKNAKVGAGAVVVADVPEDVTVVGVPAKVVRVHGKKDEEVIHDIEEGREYYSEKLEDLLKAASFHSSRL

SEQ ID NO: 29636 - protein, 133 aa, Physcomitrella patens subsp. patens
QGYLDDQFSQLQMLQDESSPDFVEEVVTLFFDDTEKLLENLTESLYTDPVDFKVVDGHVHQFKGSSSSIGAQRVKNVCVAFRHCCDAEDKKGCVDHLAKVKEEFNDVRSKLRKMLELEKRIMAAGGVLPFVEC

SEQ ID NO: 29637 - protein, 517 aa, Nostoc punctiforme PCC 73102
MDVTELVKVSIILLLLATGVALLSRRLRIPYVTGLVLAGLPITELLSRPIGLNPTLVLNLFLPILIFEAGINTDVSRLRSTFKPIALLAGPGAVLSSGIIAALLKFGLGLSWIPALFVGVILANTDTVSMIAVFKEIPVPSRLSTIVEGETLFNDAAALVSFNLILQVYSTGSLTFVEGIQQLLFISLGGCLVGLVLGYLSIPVFARLDDALSSLLLTVAVALGTFQVGQFLGVSGAVAVVVAGLIFGNLGLSQNTSASSRITLLSFWEYASFTVNTFIFLLIGVEIDLVTLWRTLPAIIFAVLAYQVGRVLTVYPLLAGIRLIDRPIPLRWQHLLFLGNIKGSLSMALALSLPETLPGRDVLIALVFGSVLVSLVGQGLSLPWVVKRLQLSKFSEVQQQVEELQAQLMTGKAAQDELDSLLKSGVLPKAVYEEMRSAYQVRIAGAEKTLRELYNRRPDDVNGKSNSSGKLDAIRRRLLLAEKGALNEAMRKRILSEEIVRGRIQNLDEQLLKLDDD

SEQ ID NO: 29638 - protein, 515 aa, Nostoc punctiforme PCC 73102
MVVESAIAEEVITNNLKQFLLVLSVSLGVATLPQVFSWFRNIPYTLLLVIVGLGLAFVDVRLVTLSPELILFIFLPPLLFEAAWNLKWSELKRDLVPICLYAVFGVVIAIAGVAIALNQFIGISLTTALLIAASLSATDPVSVTALFRQLGVGSRLTTLMEGESLFNDGMAVVAFSFVVALSLGTVELEFQPILLQLFTVVGIGVGVGAFIGFGISYLTQRFDLPLVEQSLTLVSAYGTYLIIEDLGGSGVIGVVTTGLILGNFGSRIGMNPRTRIIVSEFWEFLAFFVNSIVFLLIGDQIRFASLGENLQIIIVTVIAMILMRAVALLILSKLSTSITRSDISLPEQTILWWGGLRGSVSIALALSVSTILPEREKIIATVFGVVLFTLLVQGLSIKPLLEKLNLLGDAPLREEYLELVARHIALERVLQHLQADKRPGIDPEFRRYQETLIKSELADLRTKIDNLQDEYPNLQSFTTEQFRGELLAIEADTYAEFVKSGRLNKELASMLEDVL

SEQ ID NO: 29639 - protein, 396 aa, Prochlorococcus marinus str. MIT 9313
MIFAYCLLSRRLSRTAVSGPLVFVALGLVLGPANLGWLNISLDSALLRRLAEITLGLVLFTDAAALDWTVLRNSARLPMRLLLLGLPLSILMGFVVARLILPELSLIEAALLAVVLAPTDAALGEAVTTNLEVPEAIREDLNVESGLNDGICVPMLLCFLGISTGHLDQINGPKDALQSFAQLLFSEIGLGLVIGAFVGLLGSWLRDQAEQRKWIAEDWRPLITVALALSAYTLAQTLHGSGFISCFIAGLFYGICSRKELKDGEMVASLAMGDMLALLTWVLFGSAMVPDAWSHITVASVVYGALSLTLVRVLPVALVTSGLGLDHWTKLFVGWFGPRGLASIVFVVMVVDAALPSAQAILTTTTVTIVLSVIAHGITANRFSMFYGRWERSHAG

SEQ ID NO: 29640 - protein, 315 aa, Acinetobacter sp. ADP1
MTHSPHQIIIDTDPGQDDAVAILLALASPEVKVLAITTVAGNVPLALTSANARKVCELAGRPDISVFAGCDRPLKRPLITAENVHGKTGLDGIELPEPQMPLQAQHSVDFIIETLRNAPEKTITICSLGPMTNTAQALLKAPDIAARVKRIVLMGGGFFEGGNITPSAEFNMFVDPDAAKIVFAAGIPLTVIPLDVTHQVLTSKEWVDGLRRMDNQVGPAVAAWTDFFERYDMEKYGSEGAPLHDPCVIGYMIKPELFSGRFINVEIEADSPLTVGAMVADWWNVTGRTANAEYLRDIDRDGFFDLLSERLATYQ

SEQ ID NO: 29641 - protein, 310 aa, Triticum aestivum
MAAVWMALAVMLVAAAQVAVAAPVTAPAFLWAPKNYGLSPNEAKEVVHYQTISPKSLADSVLEEGGWSNLVCSKDGPQKNVDVAVLFLGSKLQSSDISKDKQVDPALADILKLSFSSSEFSMAFPYVAMSDDEALENSLLSGFTENCEDGSGGNHITYTDTCTASSESVKKHLNMDSVQDLVKSRMGNNQPTELIVFCSGGFKDNAKSEGQLLLDLVSVLDKSGAKYTVLYASQPYGLLENPSDLPLARYLAEKTNTTKPVLEKCDGECQLKSTLLEGVFVGVVLLIILISGLCCMMGIDTPSRFEAPQD

SEQ ID NO: 29642 - protein, 199 aa, Vibrio vulnificus CMCP6
MNTKPSTYSNGCLGRDILHILSSPCVQESVKEIGAMCGLIERINKGGVMLTWQDIITFTHQGNPQPDTVVRKSDAQWREQLGEAQYYVMRQHGTERPFSNQMCELFEPGLYRCAGCQNLLFDSGSKFDSRTGWPSFAQPMKSNAISYHLDETLARPRIEVRCNQCESHLGHVFPDGPAPSGLRYCVNAVSIEKVNQEAS

SEQ ID NO: 29643 - protein, 312 aa, Acinetobacter sp. ADP1
MSSTPPLLTVIGSINVDHILGLEHFPHPGQTLNGQSYQVAFGGKGANQAVAAGRSGANTSFIACVGSDAVGEQIRHQLIKDNIDTQAVRAVEGFTTGVALIFVNQHAENFIGIHAGANAALDIAYIDQHAELIQRSSAILLQLETPLATILHAAKLAKAAGVKVILNPAPACELPEELLRLVDIITPNETEALSLTNVIVHDDHDAAEAANVLHQKGIKTVVITMGSRGVWLSEYGQGKMIEGFKVSAIDTIAAGDTFNGAFVTALLEGKTAQDAARFANAAAAIAVTRSGAQPSVPWRQEIDLFLSAQTAL

SEQ ID NO: 29644 - protein, 195 aa, Arabidopsis thaliana
  misc_feature (87)..(87): Xaa can be any naturally occurring amino acid
MGRTKKPQKFAVMKMMISHKALKHYKEEVLNPNKKDLTELPRNVPSVPSGLFFSHNSSLVPPYRVLVDTNFINFSIQNKIDLEKGMXCLYAKCTPCITDCVMAELEKLGQKYRVALRIAKDPRFERLPCVHKGTYADDCLVDRVTQHKCFIVATCDRDLKRRIRKIPGVPIMYVTQRKYSIEKLPEATIGGAPRY

SEQ ID NO: 29645 - protein, 351 aa, Magnaporthe grisea 70-15
MTSPGKEQTLAAQGRALGTADSWHGKITAEGPFTPEVGRYRLYIGLFCPYAHRANLIRHLKGLKDIIPLTTVKPYPKGNDKGYPGWQFPATADEYPGSDLDPLFGAKYLHELYFKDDPDYKGVYSVPLLWDTKTNAAVNNESLELLRDLQTSFNSLLPEGSAERELTVYPDDLRPQIDEVSAWLLPHLCNGVYRAGFNSTQEGYDASVPFVFAALNKLERLIRSNGGPYILGSRLTELDITAYATVVRFDTIYVQHFKCNLGTVRHDYPQVNNWLKNLYWNVPGFRETTDFRHIKENYTKSHASINPLAITPMGPWPEVEEGYESDLSKVRVGGVKMPKVLELEEALVGKL

SEQ ID NO: 29646 - protein, 310 aa, Malus x domestica
MSTVTLSSGYEMPVIGLGLWRLEKDELKEVILNAIKIGYRHFDCAAHYKSEADVGEALAEAFKTGLVKREELFITTKIWNSDHGHVVEACKNSLEKLQIDYLDLYLVHYPMPTKHNAIGKTASLLGEDKVLDIDVTISLQQTWEGMEKTVSLGLVRSIGLSNYELFLTRDCLAYSKIKPAVSQFETHPYFQRDSLVKFCMKHGVLPTAHTPLGGAAANKDMFGSVSPLDDPVLNDVAKKYGKSVAQICLRWGIQRKTAVIPKSSKIQRLKENLEVLEFQLSDEDMQLIYSIDRKYRTSLPSKTWGLDVYA

SEQ ID NO: 29647 - protein, 63 aa, Edwardsiella ictaluri
VANAIANSDAFSIAGGGDTLAAIDLFGIADKISYISTGGGAFLEFVEGKKLPAVVMLEERAKQ

SEQ ID NO: 29648 - protein, 355 aa, Prochlorococcus marinus str. NATL1A
MALSYYAEELKKTASAIAQPGKGILAVDESTKTVGKRLASIGVENTEDNRKAYRGMLFTTEGLGNFISGAILFEETLFQNHPDGEPMVKKLEKLGIIPGIKVDKGLRPLAGGHDVETFCSGLDGLVERAADYYEQGARFAKWRAVLQITDDGCPSKLSIRENAWGLARYARSVQESGLVPIIEPEILMDGSHSIEKTAAVQEEVIKEVYLACQVNGVLLEGTLLKPSMTVQGADSSTKADPQQVAEMTIRTMERCVPASVPGITFLSGGLSEEAASVYLNLMNKIDRKAKWNVSFSYGRALQHSCLKAWKGSNTSDGQKALIARAQANSEASKGLYVAGSQPSSDEQLFVAGYKY

SEQ ID NO: 29649 - protein, 84 aa, Zea mays
  misc_feature (39)..(39): Xaa can be any naturally occurring amino acid
MALGALYNEIRSVKVRDVPSYLKPFLTWHNCKKSAHQRXHRYIEKFIDTSSANPLYQVCMGGVIFSYWVNLPWERAHLAHLEEM

SEQ ID NO: 29650 - protein, 305 aa, Pyrobaculum aerophilum str. IM2
MIVASIGNLNFDIYLKVSELPGPDENVEALDLYTGGGGSAANFAVAIAKMGLSARFIGAVGEDPLGEISLRELRAEGVDVSFVKRVRGVRSGVVVVLVHPDGVKRMVSYRGANLGLTPADLTVDKFAGVKHIHLATGRTELILKAKEIAREIGASISVDGGTALARKGLEIVRAAVEGVDVVFMNHVEAQLVANAGDHKSAVEKLARELKVGELVVTLGPIGAVAFKNGRLLHVDAFKVNAVDTTGAGDCFAAAYITMYLRGRDLYERLLFANAAAAIKVTRPSARASPRYDEVVAFLESLGYKI

SEQ ID NO: 29651 - protein, 235 aa, Hyacinthus orientalis
GGLNSQHIFAYINTTIYPLTSIPLILYCMLPAICLLTGKFIVPPISNVASIWFISLFLSIFATGILEMRWSGVGIDEWWRNEQFWVIGGVSAHLFAVFQGLLKVLAGIDTNFTVTSKASDEDGDFTELYMFKWTTLLIPPTTLLVVNLVGVVAGISYAVNSGYQSWGPLFGKLFFAFWVIVHLYPFLKVPMGRQNRTPTIVVVWSILLASIFSLLWVRIDPFTTRVTGPQCCNVE

SEQ ID NO: 29652 - protein, 278 aa, Brassica napus
  misc_feature (2)..(2): Xaa can be any naturally occurring amino acid
  misc_feature (8)..(8): Xaa can be any naturally occurring amino acid
  misc_feature (40)..(41): Xaa can be any naturally occurring amino acid
  misc_feature (43)..(43): Xaa can be any naturally occurring amino acid
  misc_feature (73)..(73): Xaa can be any naturally occurring amino acid
MXRREDDXEKVKDKSEPLLLPENGSDVSEEEGASWMVCLXXFXAVCGSYEFGTCVGYSAPTQFGIMEELNLSXSQFSVFGSILNVGAVLGAITSGKISDFIGRNGAMRLSSVISAIGWMIIYFSKGDIPLDFGRFLTGYGCGTLSYVVPVFIAEISPRKLRGALATLNQLFLVIGLASMFLIGAVVNWRALALTGVVPCVILFFGTWFIPESPRWLEMVGRHRDFEIALQKLRGPNANIAREADEIKEYLATIAHLPKTTLLDLIDKKNIRFVLVGVG

SEQ ID NO: 29653 - protein, 486 aa, Barbeya oleoides
GPGVPALEKKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRPAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMES

SEQ ID NO: 29654 - protein, 642 aa, Aspergillus nidulans FGSC A4
MECLAPYIPPALLSLVERAQEQVQNQTHTLSIAVLSLSAVLLGYLFVAGSRESPVSFTVPNPPEINPHWEGSKWEDLPQGSEERNVIEGQIRGQWNENLIMSYCPADGRVLGSGIKPATADDVDRAIQAASRAQEQWATTTFAERRRVLKTLLKYVLEHQDEIVIACCLDSGKTKVDATFGETLVTAEKLKWTIDHGERALSPESRPTNFLMMYKKNQVIYEPLGVVSACVSWNYPFHNFISPVISAIFAGNGIVVKPSEQTAWSSVYFLNIIRGALENCGHPRDLVQSVVCLPKVADHLTSHPGIAQITFIGSRPVAHKVCESAAKALTPVTVELGGKDPSVILDDSRTISEVTSVASVLMRGVFQSAGQNCIGVERVIALPGVYDKLLDTVTSRIKALRLGSVLLDTKPNNPNNKSGAPDVGAMISPASFSRLEFLIQRAVSQGARLVAGGKQFEHPTYPLGHYFTPTLLADVTPSMEIAQTELFAPVFLMMRASSVSDAITIANSTQYALGASVFGYNTRDVNACVSGIKAGMVSVNDFGSYYTVQLPFGGVKGSGYGRFAGEEGLRGVSNIKAICVDRFPRLMATRIPPRVDYPIMKGEAEKENGDGAFEMCKGVVETGYQITLAGRVRGILRLIGNM

SEQ ID NO: 29655 - protein, 931 aa, Moritella sp. PE36
MMSLIEQIKNGKLWRYLGGVHPKENKTQSTSLAITTASIPKHLIIPVKQHIGQGGQIIVASGDRVLKGQPLTASDSFMAVPIHAPTSGTIEHIAQYPSTHPSATPEIAIKLVCDQEDQAMPAQPALDYKQLSTSELQQHISQAGVAGMGGAGFPTAVKLNDRQPIEFLLINAAECEPYITSDDVLMRERADDIIQGIEILRHMIKPALCVIGIEDNKPDAAQALETAINKINLSNDIIVRKVPTKYPNGGEKQLIQMLTGKEISKGQIPAQSGIVMQNVGTVYAVKQAIIDRQPLLSRIVTLTGKAFPQPRNVQALIGTPISALLSEFHCDETKAAAIIYGGPMMGFTLPHTQFSLTKTGNCILTPVKDEIPQVREADACIRCGECSEVCPVDLLPQQLHWYSQAKDVKKLNDYNLMDCIECGACSYVCPSQIPLVHQYRIAKVEVRANDAELAAAAIAKERFEKRNERLALEKAQREQRQKEAAEKRRATAKATTGEDPVKAAMDRIKKAKAAEQTPANGQASKGSAVADAIARAKAKKAAAASTDTAVPDTLLPNNAAVIAERKARKAAAKTKREAEGSEQVQTTTSPAIEAKKAAVAEAIARAKAKKAATQSGENATDTPAPAVDAKNAAVAAAIARAKAKKAAAQSGETATDTPTPAVDVKKAAVAAAIARAKAKKIAAKLSQSEATESTTEPPAPAVDAKKAAIAAAIARAKAKKAAALSSQTEAAVTGESTIDTPAPTVDAKKAAVAAAIARAKAKKAAAQSSQTETAEETTEPPAPAVDAKKAAIAAAIARAKAKKAAAQSQSEATESTTESPAPVVDAKKAAIAAAVARAKAKKAAAQPPQSEATESTTESPAPVVDAKKAAIAAAVARAKAKKAATKETPSTQNDTIEIADSAAPAVDNKKAAIAAVIAKAKAKKLAQLGDK

SEQ ID NO: 29656 - protein, 481 aa, Bauera rubioides
PGVSALEKKTLGRIAQIIGPVLDVAFPPGKMPNIYNALVVKGRDTIGQQINVTCEVQQLLGNNRVRAVAMSATDGLMRGMEVIDTGAPLSVPVGGATLGRIFNVLGEPIDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNL

SEQ ID NO: 29657 - protein, 481 aa, Xanthomonas axonopodis pv. citri str. 306
MFPGEPMSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 29658 - protein, 559 aa, Bacteroides fragilis YCH46
MKVLDFKPRLFSTLKNYSKETFMSDLMAGIIVGIVALPLAIAFGIASGVSPEKGIITAIIAGFIISLLGGSKVQIGGPTGAFIVIIYGIIQQYGEAGLIVATLMAGILLILLGVFKLGAIIKFIPYPIIVGFTSGIAVTIFTTQIADIFGLNFGGEKVPGDFIGKWMIYFRHFDTVNWWNAVVSILSIIIIAITPRFSKKIPGSLIAIIVVTIGVYVLKTYAGINSIDTIGDRFTIKSELPEAAIPTLNWEAIKDLFPVAITIAVLGAIESLLSATVADGVTGDKHDSNTELIAQGTANLITPLFGGIPATGAIARTMTNINNGGKTPVAGIIHAIVLLLILLFLMPLAQYIPMACLAGVLVIVSYNMSEWRTFKALLKNPKSDVTVLLITFFLTIIFDLTIAIEVGLVIACILFMRRVMETTEISVIKDEIDPNDELDIAVCEEHLIIPAGVEVYEINGPYFFGIATKFEETMAQLGDRPKVRIIRMRKVPFIDSTGIHNLTSLCKMSQKEKITIVLSGVNEKVHKTLEKSGFYELLGKQNICPNINVALDRAKEIIN

SEQ ID NO: 29659 - protein, 468 aa, Thiobacillus denitrificans ATCC 25259
MNTHVHAARWQAYLQDCTELLAIAEPMRLSGRITRVAGLVMEAVGLKLPVGSACTVPLPNGSHLEAEVVGFEGERLFLMPQSDVEGIVPGARVFPVEVIPTLPGLGQVNHPRRRPSDRTRHLPVGEVLLGRVLDSNGRPLDGLGSVHTSATAPLNNRAANPLSRAPISEILDVGVRAINSMLTIGRGQRMGLFAGSGVGKSVLLGMMARYTSADVIVVGLIGERGREVKEFIEQILGEEGLARAVVVAAPADTPPLMRLQGAAYATAIAEHFRDEGKNVLLIMDSLTRYAMAQREIALAIGEPPATKGYPPSVFAKLPALVERAGNGKPGGGSITAFYTVLTEGDDQQDPIADSARAILDGHIVLSRDLAESGHYPAIDIEQSISRAMHGITSAAHQQMARRLKKLYSRYARSRDLINVGAYAPGTDPLLDEAIRLQEGIEAFLQQNIPERAGVEESLAALSTLFPST

SEQ ID NO: 29660 - protein, 434 aa, Xanthomonas axonopodis pv. citri str. 306
MFISTRGGAPAASLSQAIAAGLAPDGGLYVPQTLPPARTLVAGAGLADTATALLQPFFEGDALAAELPAICAEAFDFPAPLVALGTPGDYALELFHGPTAAFKDFGARFLAACLTRLRRAEDRPLTILVATSGDTGAAVAAAFHRQPGLRVVVLYPDGRVSPRQAHQLGCFGDNIQALRVAGSFDDCQAMVKQALNDAALQTQVPLSSANSISLGRLLPQMSYYAHAALQHHAASGSVLNLVIPTGNLGNALAAIIARALGVPLGRIALASNANHVLPDYFAGDAYAPQPSVSTLANAMDVGAPSNFERLRWLYNGDDAALREEFRALSVDDAAIRNTVQQRFARYGEVHCPHTATAVHVLEQLRAEGAEGGTGDWAVAATAHPAKFEGVVEPLIGRSVEVPPALAALLQRPAHAEALAPDYAALRQRLLADAT

SEQ ID NO: 29661 - protein, 203 aa, Zea mays
KSQAMPTAIGDLFKPVAAGVTSYGGKLHVPQSFYSWPFAVDVGGEVFDPETNSWEQMPAGMGEGWPARQAGTRLSAVVEGDLYALERTTSSSGGCEIKMYDAQEDAWKVAVSQVRAGAFDESDSPCLLVAFFGKLHLVVKDMGSRISVVQMDFLMKPVDSPALSAATTCRTPDVSSEQTHVWKAIASKNIAAAELVSCQVLSI

SEQ ID NO: 29662 - protein, 447 aa, Bacteroides fragilis YCH46
MKYQVIIIGGGPAGYTAAEAAGKAGLSVLLFEKQNLGGVCLNEGCIPTKTLLYSAKTYDGAKHASKYAVTVPEVFFDLPKIIARKSKVVRKLVLGVKSKLTSNNVTIISGEATILDKNTVRCGEETYECDNLILCTGSETFIPPIPGIDSVNYWTHREALDNKELPASLAIVGGGVIGMEFASFFNSLGVKVTVIEMMDEILGGMDKELSALLRADYAKRGIQFLLSTKVVSLAQTEEGAVVSYENAEGAGSVIAEKLLMSVGRRPVTKGFGLENLNLQRTERGSIVVNGQMESSLPGVYVCGDLTGFSLLAHTAVREAEVAVHAILGKEDRMSYAAIPGVVYTNPEIAGVGQTEESLTAKGIAYRAVKLPMAYSGRFVAENEGVNGVCKVLLGEDDTILGAHVLGNPASEIITLAGMAVEMKLKAAEWKKIVFPHPTVAEIFREAL

SEQ ID NO: 29663 - protein, 191 aa, Arabidopsis thaliana
MFAAENGLKGDPRLEAISAAIRVVPNFPKKGIMFQDITTLLLDHKAFKHTIDIFVDRYKDMQISVVAGVEARGFLFGPSIALAIGAKFIPLRKPGKLPGKVISESYELEYGHDRLEMHVGAVEPRERVIIIDDLVATGGTLSAAMSLLESQGAEVVECACVIGLPEVKGQHKLKGKPLYVLVEPSGLDEFC

SEQ ID NO: 29664 - protein, 235 aa, Glycine max
  misc_feature (80)..(80): Xaa can be any naturally occurring amino acid
  misc_feature (135)..(135): Xaa can be any naturally occurring amino acid
MERYDLQRQRRDMKKKGRNVVWSIAMDKCLIEALAAQARSGNKIDKCFNENAYMAACVAAHPDAKGFHGKQIEIYDELKXVCGNYQAPSHWAKMKSGTQLMDMKNCDNESASFVSPNSEDMSGTDGTESYTATPXTRPDARWFSRASCTSDALQEALMTVASSIRRLADAMEQSKCSFDASELLHAVMEIDGLEEGKQMYAFEYLNADPVKARAFLTYNARMRKTYLFRQFWWWR

SEQ ID NO: 29665 - protein, 161 aa, Oryza sativa
  misc_feature (78)..(78): Xaa can be any naturally occurring amino acid
  misc_feature (147)..(147): Xaa can be any naturally occurring amino acid
HLALLCLQRNRKQWRLLLSSSHLSFPRSLNGVTPGAECKDRATPEQVSDYTLKLLHRRIPPAVPGIMFLSGGQSEVEXATQNLNAMSQGPNPWHVSFSYARALQNTCLKTWGGQPENVKAAQDALLLRAKANSLAQLGKYTSDGEAXAEAKEGMFVKNYVY

SEQ ID NO: 29666 - protein, 503 aa, Bradyrhizobium japonicum USDA 110
MTKDPQAKRKPENCAFVIFGVTGDLTHRLVMPSLYNLAAEHLLPEKFCVVGVARKGQSDDELRSSLLKGLRQFATRPVDDDIAQKLLQCLTFVEADPKDSPSFDRLREHLDSLECAQDTGGNRLFYLATPPAAFAPTARELGRTGMMEENGAWRRLVIEKPFGTDLASARALNAELLKIMDEHQIYRIDHYLGKETVQNILVLRFANGMFEPIWNRNHIDHIQITVEEKLGVGHRGGFYDATGALRDMVPNHLFQLMSLVAMEPPARFDAHSVRSEKADVLTSIQQPSREEALKNSVRAQYLAGRIGDEEITDYRKTEDVKPGSTTETFVALKLMIDNWRWAGVPFYLRTGKALGHKRTEVAIKFKQAPLSMFSGTDVDRLSQNFLTIGIAPTETIELQFNAKIPGPSITIDGVEMKFRYGDYFRVDPSTGYETLIYDCMIGDNILFQRADGIEAGWQAVQPFLDAWKSEGTNGIETYEAGSDGPACADELLRRDGRSWRKFS

SEQ ID NO: 29667 - protein, 300 aa, Prochlorococcus marinus str. NATL1A
MSKLHPVVAVTGSSGAGTSTVKRAFEHIFAREKIVPAVVEGDSYHRFERMPMKKAMSEALSRGENFSHFGPEANLFDKLEDLFSQYGKTGGGQKRYYLHSPEEAEEHNTRLGTKLDPGQFTPWEDIPTGTDLLFYEGLHGGVVGKDYDVASFADLLVGVVPITNLEWIQKIHRDNAERGYSAETIVDTILRRMPDYINHICPQFSRTDINFQRVPTIDTSNPFICRNIPTPDESFVIIHFRKGSREKWGIDFQYLLGMIHDSFMSSPTSIVVNGGKMGFAMELILTPIIHKMIEEKKASG

SEQ ID NO: 29668 - protein, 359 aa, Prochlorococcus marinus str. NATL1A
MKSYKITLLPGDGIGPEITNVTHKILDLVSRKFGFEIKFKEMPFGGSAIDSDGIPFPDRTLQECKNSDAVLLAAIGDPKYDELPREKRPETGLLNLRSSLDLFANIRPVKIIPSLTKASSLKEDFVKKVDLVVVRELTSGIYFGEPKGRIKTDKGERAFNTMTYTSEEVKRIAEIAFKLAKQRNQKVCSVDKANVLDVSQLWREETILVSNKYKDIELTHQYVDNAAMQLVRNPSQFDVILTGNLFGDILSDIAAMLTGSIGMLPSASLTTDGPGVFEPVHGSAPDIAGKDIANPIAMLLSAAMMLKIALNEKEAATFLENAINEILNDGYRTSDLMSNQTTKQVGCSQMGELLAEKLK

SEQ ID NO: 29669 - protein, 204 aa, Oryza sativa
  misc_feature (118)..(118): Xaa can be any naturally occurring amino acid
  misc_feature (153)..(153): Xaa can be any naturally occurring amino acid
MASHLDFRYLDEGLGGERGKRKRREAEEAAAADSMDLDADADAPRPSKLRAVPSLSDPSKPASFGQPTYDGVIAGRVSGRRWKEARTRRASALAASRKPTPLEQRARDKSLKRAYQAXRVAELKEEIRQSKAAKRKQREEREKRKKENVLRSXGTKLQRVTNPKTIQKIAKSKKRKQLKVVPDEFLGGKKSDANRRMQVPGLDN

SEQ ID NO: 29670 - protein, 315 aa, Silicibacter pomeroyi DSS-3
MSNAELVCVGEPLFELSNVGPGKWNAGVGGDVSNVAVAAARQGTRSTMLTQLGDDDFAAEIRNSWAAEGVNDAYVRTLVGAETGMYFITHDAGEHKFEYRRSGSAASQVRPEDLSEGVFDNAAIVHLSGISQAISASARATTDKAIAIAKKKGVKVSYDPNLRLKLWPLEEARKVILDTVRKVDIFLPGLDDARILTGIEEPVDIVRFFADLGAPIIALTMGDRGVLAANDGDMRFISSPKVDAVDATGAGDCFDGAFLSQLINEYSVFDAAAYAATAAAISIQGHGAAKSIPNREAVLALQEQCRGEIWTAPEI

SEQ ID NO: 29671 - protein, 178 aa, Prochlorococcus marinus str. NATL1A
MSTTNKNDEVPTLLVKDSQGSDLLCFLEQVVPLEGNEYALLTPVDTPVSLFQLIDDQDPKLIETIEKNEPILEVADVVLQEHDLRLIRSAITLTVSGELDEPEPEEIEEEDIDDESETYELLVNFRVESNEYGLYIPLDPFFIVGKLEDGEVKLVEGEEFDKIQSGIEAELEGRGLSE

SEQ ID NO: 29672 - protein, 270 aa, Triticum aestivum
GRLRSHHFSLPEEERPLKLPGKSPDKIVKVPVDVFKGITDEDAAKVVDGLAPKTADRQSSIEQIKKLYELFCKTDCTMLEINPLAETADKKLVAADAKLNFDDNAAFRQKEIFALRDTTQEDPREVAAAKADLNYIGLDGEIGCMVNGAGLAMATMDIIKLHGGTPANFLDVGGSASEGQVVEAFKILTSDDRVKAILVNIFGGIMKCDVIASGIVNAAKQVDLKVPVVVRLEGTNVDQGKRILKESGMTLITAEDLDDAAEKAVKASVK

SEQ ID NO: 29673 - protein, 193 aa, Oryza sativa
GSPGCRHRGISGGHINPAVTFGLFLARKVWLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGAAVIYNKDKAWDDQWIFWVGPLIGAAIAAAYHQYVLKCRYAYKMAASVQH

SEQ ID NO: 29674 - protein, 223 aa, Idiomarina loihiensis L2TR
MSGNADALKKAAAEAAMQYIEDGTVVGVGTGSTVNFFIDALAERKHDIEGAVSSSEASTERLKSHGIEVFELNSVVEVPIYVDGADEITEHGQMVKGGGGALTREKIIAAVARKFVCVADESKMVGRLGQFPVPVEVIPMARSYVAREIVKLGGDPVWRQGFTTDNGNWILDVHNFDIMEPMKLEAELNNIVGVVTNGLFAQRGADIALIAREDGVQTLKVSG

SEQ ID NO: 29675 - protein, 223 aa, Oryza sativa Japonica Group
MDAGDAWGRSSSSSSSAAAAARRLQARYDLYMGFDDADAAGVEEVEARGGGEAYNCPFCGEDFDFVAFCCHVDDEHAVEAKSGVCPICATRVGVDLIGHLTMQHGIRKISSGSHSLLSLLRKDLRDGSLQSFLGGSSYVSNPPAAAPDPFLSSLICSLPVAEPSKDLHSDSSDNNFLLNKFPDDKTAERAEPSLSEKDQKERAQRSKFVRGLVLSTIFEDDNL

SEQ ID NO: 29676 - protein, 146 aa, Mycoplasma mobile 163K
MKKNIDKNELKKRLTDLQWKVTQENGTERPYNNEFDNHFEEGIYIDIVDGTPLFISKDKYNSGCGWPAFTKPIDPFVIEEKMDFTSGMTRVEIRSKNADSHLGHVFNDGPRDKGGLRFCINSASLKFIKKEDLEKEGYSTYLKLFK

SEQ ID NO: 29677 - protein, 529 aa, Mycosphaerella pini
MKWYSKDNITGIATAASDAGSSYGNHGDDLAQGGLQDGGAHPSKRQIGVISASFLIFNRMIGTGIFATPSGILSLTGSVGLSLVMWVAGMLIAAAGMAVYLEFGTAIPKNGGEKNYLEYVFRRPRFAATGFYTGYVLLLGWAGSNSVVFGEYILNAANVEVGRWNQRGVGLACITAAFLIHGLALKWGLRLQNLLGIIKLIVILIIVVSGWAALGGALKIEKPHNFDNAFEGTTGSAYGVVTALYNVIWSYIGYSNANYALSETRNPVKTLRLAAPLALGSVAVLYMLVNIAYFAAVPKEEILSSGRILAASFFRNVFGGSAERALSVFVALSAFGNVLSVIFSQGRLVQELGREGILPFSRFWASNRPFNAPLAGLFEHWLVSVIIMLAPPPGDAYNFILNVISYPLAIVNSFVASGLLYLYWNKAEWNWSPPFKATWPVALFFFLSNVYLVVAPFVPPTDGNAIYETLPYYLHCVVGWGIIAGGGVYWLMWAIILPKIGKYELVREEHVDELDGWSRYQFVRRPLAN

SEQ ID NO: 29678 - protein, 107 aa, Haemophilus influenzae Rd KW20
MSEVLHINDADFESVVVNSDIPILLDFWAPWCGPCKMIAPVLDELAPEFAGKVKIVKMNVDDNQATPAQFGVRSIPTLLLIKNGQVVATQVGALPKTQLANFINQHI

SEQ ID NO: 29679 - protein, 226 aa, Brassica napus
MDSSNSWINCPSVFSSSSSASRRCQQSRSDLYIGGGYEDLEGEDDLKSEFICPFCAEVFDIVGLCCHIDEEHPVEAKNGVCPVCTKRVGLDIVGHITTQHANFFKVQRRRRLRKGGGYSSAYLTLKKELREANLQSLLGGSSSFASSTNIDSDPLLSSFMFNPPSAANKSATPVTEGASATTKLSQKESLKRDIREGPLSGEDREKAKKSEFVRGLFLSTMLGDDY

SEQ ID NO: 29680 - protein, 320 aa, Escherichia coli CFT073
MSKVFTIGEILVEIMASKIGQPFDQPGIWNGPYPSGAPAIFIDQVTRLGVPCGIISCVGNDGFGDINIHRLAADGVDIRGISVLPLEATGSAFVTYHNSGDRDFIFNIKNAACGKLSAQHVDENILKDCTHFHIMGSSLFSFHMVDAVKKAVTIVKANGGVISFDPNIRKEMLDIPEMRDALHFVLELTDIYMPSEGEVLLLSPHSTPERAIAGFLEEGVKEVIVKRGNQGASYYSANEQFHVESYPVEEVDPTGAGDCFGGAWIACRQLGFDAHRALQYANACGALAVTRRGPMEGTSRLMEIETFIQRHDMSIREAAQ

SEQ ID NO: 29681 - protein, 242 aa, Triticum aestivum
MYGISSTHASESAWKFVYYLSAELFSLSVTYNESWFTNTRYFWVGPGEQLWPDQKMKLKLKAVYMYAAGFYVYSIFDLLFWETRRKDFGVMMSHHVATVVLIVVSYICRLSRPGSVILPLHDASDIFLEIGKMAKYSSCEWLAVVAFLLFVASWILLRLIVFPFWILRSTSYEIAMIVDNENRKIYRTSYYYLFNTLLFSLLVFHIYWWVLIYRMLVKQIQSRGHVGEDVRSDSEGENNHED

SEQ ID NO: 29682 - protein, 217 aa, Hordeum vulgare subsp. vulgare
MDVGALSSDYSSGTPSPVGADGGNSEGFSTYMTVSSAPPKRRAGRTKFKETRHPVYKGVRRRNPGRWVCEVREPHSKQRIWLGTFETAEMAARAHDVAALALRGRAACLNFADSPRRLRVPAVGASPDEIRRAAVEAAEAFLPAPDQSNAPAEEVAAAPTMQFAGDPYYGMDDGMDFGMQGYLDMAQGMLIAPPPLVGPSATAGDGDDDGEVSLWSY

SEQ ID NO: 29683 - protein, 140 aa, Picea sitchensis
MAGRGKAVGGSGGSKKKSTSRSSKAGLQFPVGRIARFLKAGKYAERVGAGAPVYLAAVLEYLAAEVLELAGNAARDNKKTRIVPRHIQLAVRNDEELSKLLGTVTIANGGVMPNIHNILLPKKAAASGGSSKSGKGEEES

SEQ ID NO: 29684 - protein, 376 aa, Mycobacterium bovis AF2122/97
MSKAVLVLEDGRVFTGRPFGATGQALGEAVFSTGMSGYQETLTDPSYHRQIVVATAPQIGNTGWNGEDSESRGERIWVAGYAVRDPSPRASNWRATGTLEDELIRQRIVGIAGIDTRGVVRHLRSRGSMKAGVFSDGALAEPADLIARVRAQQSMLGADLAGEVSTAEPYVVEPDGPPGVSRFTVAALDLGIKTNTPRNFARRGIRCHVLPASTTFEQIAELNPHGVFLSNGPGDPATADHVVALTREVLGAGIPLFGICFGNQILGRALGLSTYKMVFGHRGINIPVVDHATGRVAVTAQNHGFALQGEAGQSFATPFGPAVVSHTCANDGVVEGVKLVDGRAFSVQYHPEAAAGPHDAEYLFDQFVELMAGEGR

SEQ ID NO: 29685 - protein, 336 aa, Escherichia coli CFT073
MSALPGPIAKGFRNERGFVTTTICAMGELLAEFLSRNPHQKFTQPGEFIGPFPSGAPAIFAAQVAKLSHRAIFFGCVGNDDFARLIIERLRHEGVITDGIHVMNNAVTGTAFVSYQNPQQRDFVFNIPNSACGLFTAEHIDKDLLKQCNHLHIVGSSLFSFRMIDVMRKAITTIKSAGGTVSFDPNIRKEMLSIPEMAQALDYLIEYTDIFIPSESELPFFARHKNLSEEQIVSDLLHGGVKHVAIKRAQRGASYYKLKNGTLHAQHVAGHDIEIIDPTGAGDCFGATFITLFLSGFPAHKALQYANASGALAVMRQGPMEGISSLADIEDFLQQH

SEQ ID NO: 29686 - protein, 472 aa, Prochlorococcus marinus str. MIT 9313
MSKAHFGLIGLGVMGENLVLNAERNGFSSVVYNRTYAKTEEFLKGLGSDKAIQGAKDLQDFVDKLERPRRILMMIKAGSAIDAVIEQISPYLQEGDLLIDGGNSEFRDTERRVAELESKSFGYIGMGVSGGAKGALEGPSMMPGGTKTSYEAIESLVCKMAAQVEDGPCVTYIGPGGSGHFVKTVHNGIEYGIEQILAEAYDLMKRVGGMTGTQMADVLAQWNATEELSSYLVEITEVCLRTKDPDDGSDLVEKIMDQAGQKGTGLWTVVSALELGASVPTIYASLNGRVMSSMKPQRITAEQILHGSAIKPFDLGSSADGMAPLMDAVVLSCMASYAQGMELLRIASAEYNYNLHLPSIAQIWKGGCIIRSRLLKRIQDAFNADPQLSNLLIDPWFAEQVNRRLPGLAKVVAGAAEAGIPVPCFSSTLDYINSYRTARLPQNLVQAMRDCFGSHTYQRVDKEGTFHTEWLD

SEQ ID NO: 29687 - protein, 315 aa, uncultured bacterium
MLHPSAKALLDMMVEKQVPPTHTLTPEQARHFYRERRFATQPAAPEVAESRDLSAEGPNGPIPLRMVRPKGSTPEQVLPVLVYYHGGGWVIGDLDTHDTLCRELANAAGCAVIAVDYRMGPEFRFPAAPEDCIAATRWIRANAASLKIDADRLAVGGDSAGGNLAAVVALAARDAGDLPIRFQLLIYPATDAHCGSASYHANGQGYLLTKDTMAYFYGHYIDDEGHKDDWRASPLRAASHANLPPALVITAGFDPLRDEGLHYAQKLSEAGNRATHISFERQIHGFITMGKVIDESNAAVALCASMLRDALAPSA

SEQ ID NO: 29688 - protein, 431 aa, Prochlorococcus marinus str. MIT 9313
MKRVLAIILGGGAGTRLYPLTKMRAKPAVPLAGKYRLIDIPISNCINSSINKMYVLTQFNSASLNRHLGQSYNLSAAFGQGFVEVLAAQQTPESPSWFEGTADAVRKYQWLFQEWDVDEYLILSGDQLYRMDYSLFVEHHRRSGADLTVAALPVDAEQAEGFGLMRTDSDGNIQEFREKPKGESLKAMAVDTSRFGLSAESARNKPYLASMGIYVFSRATLFDLLHKNPSHKDFGKEVIPEALARGDRLQSYVFDEYWEDIGTIGAFYEANLALTQQPNPPFSFYDEKFPIYTRPRYLPPTKLVDAQITESIIGEGSILKSCSIHHCVLGVRSRVESDVVLQDSLVMGSDFYESSEERTLLRQGGGIPLGVGQGTTVKGAILDKNTRIGNNVTIVNKDHVEEADRADEGFYIRNGIVVVVKNATISDGTVI

SEQ ID NO: 29689 - protein, 547 aa, Haemophilus ducreyi 35000HP
MRNINPTDTMAWQALVQHKAEHLSIPQLFAENEDRFATYNLSFEDQILVDYSKNAINQKTLTLLRQLAKECDVDGARQAMFSGEKINRTENRAVLHIALRNRANKAIFVDGKDVMPAVNAVLAKMKAFSEKVIKGDWKGYTGKAITDVINIGIGGSDLGPYMVTEALRPYKNHLNMHFVSNVDGTHIAEVLRKVNPETTLVLVASKTFTTQETMTNAFSAREWLLADAKDQSAVAKHFVALSTNSETVAKFGIDTENMFEFWDWVGGRYSLWSAIGLSIVLSIGFANFEQLLEGAYAMDKHFYHTADEQNIPLTLALVSIWNNNFLGAQTEAILPYDQYLHRFAAYFQQGNMESNGKYIGRDGKAVNYQTGPIIWGEPGTNGQHAFYQLIHQGTTLIPCDFIAPAQTHNPLSDHHNKLLSNFFAQTEALAFGKSKAQVELEFTQQGKSLDEVKDIVPFKVFTGNKPTNSILLKKVTPYSLGALIAMYEHKIFVQGVLFNIYSFDQWGVELGKQLANRILPELEDDQPVVSHDSSTNGLINQFKAWRE

SEQ ID NO: 29690 - protein, 108 aa, Streptococcus gordonii
DPGFLGLDIGPKSIAKFDEALTGAKTVVWNGPMGVFENPDFQAGTIGVMDAIVKQPGVKSIIGGGDSAAAAINLGRRDKFSWISTGGGASMELLEGKVLPGLAALTEK

SEQ ID NO: 29691 - protein, 517 aa, Bacillus cereus G9241
MSLLTVEKLGHTFGDRTLFKDVSMRLLAGEHVGLVGANGVGKSTFMNIITGQLIHDEGRVEWTPGTNYGYLDQHTILTPGRTIRDVLADAFLPLFEKEKALNEVTEKMGTATPEELEELLEQMAEIQDALEAGGFYLLDIKIEEAARGLGIDAIGLDRDVAALSGGQRTKVLLAKLLLEQPEVLLLDEPTNYLDVEHIHWLTNYLKEYPHAFLLISHDTEFMNKCVDVIFHLEFTKMTRYTATYEKFLELAEINKNQHINAYEKQREFIKKQEDFIAKNKARYSTTGRAKSRQKQLDRMERIDRPETAIKPEFSFKESRASSRFVFEGENVEIGYTHPLLPKLTMTIERGEKIAIVGCNGVGKSTLLKTILGKIKPLSGKTSLGDFLNPSYFEQEVKADNITPIDDVWNTFPSLDQHQIRAMLAKCGLKNEHISRPLNQLSGGEQAKVRLCKLMGEESNWLLFDEPTNHLDVTAKEELKKAMKAYKGTILLVCHEPDFYEDWVTKTWDVEKWAQENS

SEQ ID NO: 29692 - protein, 177 aa, Chlamydomonas reinhardtii
MAMPPAAPSSWSTGFCDCCAPPGGFGICLYAWCCGCCMYGTTVEMMPPVVCCGGSCVGACCAYLGMTFIGCPCILQMMSRGWLRAKYGIPGDGCTDCCLTCWCSPCAMCQEYRECKIRGLGPGGVELNKQQPAVAPQQQMVAVPAPYPYPPGQQYPPQQGYPPQQAYPPQQAYLPQQ

SEQ ID NO: 29693 - protein, 304 aa, Brassica rapa
MGFFESVKSINWEHESFPTYQDFVCLPLFAVFFPSIRFLLDRFVFEKVGRLLIYGKQSPKKNDKKTKIRKFKESAWKCIYYLSAEVLALSVTYNEPWFTDTLYFWIGPGDQIWPNQQMKIKLKFLYMYTAGFYTYSIFALIFWETRRSDFGVSMGHHITTVILIVLSYICRFSRAGSVVLALHDASDVFLEVGKMSKYSGFEGIAAFSFVLFALSWVLLRLIYYPFWILWSTSYQIIMTVDKEKHPIEGPIYYYMFNTLLFCLLVLHIFWWVLIYRMLVKQVQDRGKLSEDVRSDSESDDEHED

SEQ ID NO: 29694 - protein, 413 aa, Glycine max
MAAAATTSSSSHLLLLSRQQAASLRCRLSFLGQPRRPGRVTAQAPAAKDVRCMAAVDTAASAAAAETSPKSSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVIFVLTVGTGVYVFTLDPMYGEFVLTQEKVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 29695 - protein, 139 aa, Glycine max
METPNVTIPKVGPKPSRKVKLPTPKELISHYESKGMDSQDASLKVIEDLQKALFRVISSGKGKHDKLLTESSRKIDAINNRLTVLDMKLDSKPAYVETFAIGLASGAALKGIGAVVPHIIAPLTQIWNSVSSAIKSSPQ

SEQ ID NO: 29696 - protein, 488 aa, Zea mays
MRLVGRRRTGVLLLLAVASAALFCSLFAVVKDDANSTSIVNNYEVPNAIQKSVYPSRTRPLMMSGNQESTSVVNKIDFPNRLHLSFANFTHPCEGFSVPPPLVDKKRTGPRPCPVCYVSVDQAFALMPLQASPSPVLKDLNYVSEDGVTANLSNQGSGFGGHPSLDQRNDSFNINESMTVHCGFVRGKKPGQGTGFDIKDDDLLEMEQCHDLVVASAIFDEETEAYVKNSSSLYNNNKVGLWRLIPKLLLHRLFPNVRFSVWIDAKLELVVDPYLLLERFLWRKNTTFAISRHYKRFDVFEEAEANKAAGKYDNASIDYQIEFYRNEGLTHYSSAKLPITSDVPEGCVIIREHIPITNLFTCVWFNEVDRFTSRDQISFSTVRDKIRARVGWMPEMFMDCERRNFVVQVYHRELLEQMIASGRMPPLAAAVTHANVRVGSRKAPPTKKPSVKRKREKKSSSRRRLPKPIAQGLDANVTQVFFSVAESG

SEQ ID NO: 29697 - protein, 717 aa, Moritella sp. PE36
MATNDRDSSSHNKKIIIFVIIAVFSLWYGFDLNQYASLEQIKILQQTSGDYIADNRALAMLIFFVSYVVITGFSLPGAVLLTLLGGGLFGFGYGLLLISFASSMGATLAFLVSRYLLRDYVQNKFAARLAAINKGMEKEGNFYLFSLRLIPVFPFFVINILMGLTKISTRSFYLVSQVGMLAGTAVYVWAGTQLSEINSLSGIASPSLLSALVLLGVFPWIAKRGLALFSQRKRYARWTKPKSFDRNMIIIGAGAGGLVSAYIAAAVKSKVTLVEKHQMGGDCLNTGCVPSKALIRSAHAVAEISRAYEFGIDAEINNINFARVMGRIKNVIKTIEPHDSIARYSAMGVECLTAEAKIIDPWHVRIGDQVLTTKNIIVATGARPIVPPIPGLTDVPYLTSETLWQLAEQPSRLLVLGGGPIGCEIAQSFARLGSAVTQVEMATQILGREDEDAVAVVQAELQADGVSILLGNKVARFVNEDGQYSAVLSNGDSVVFDQVFLALGRQANTRGFGLEDLDVAITDRGLIEINEYQQTSIPNIYAVGDVSGPYQLTHVAAHQAWFAAVNALFGSVKKFATDYRVIPAVTYTYPELARVGISENEAQQAKLDYQVTKYNIDDLDRAITDGETKGFVKVITAANSDKILGVTIVASHAGELLAEYTLAMKYKLGLNKVLGTIHPYPTMSEANKYVAGNWKRNNSPEKLLTWVEKFHRYMRKA

SEQ ID NO: 29698 - protein, 815 aa, Haemophilus influenzae Rd KW20
MRVLKFGGTSLANPERFSQAAKLIEQAHLEEQAAGVLSAPAKITNHLVALSEKAALNQSTDTHFNEAIEIFYNIINGLHTENNQFDLNGTKALIDAEFVQIKGLLEEIRQAGKVEDAVKATIDCRGEKLSIAMMKAWFEARGYSVHIVDPVKQLLAKGGYLESSVEIEESTKRVDAANIAKDKVVLMAGFTAGNEKGELVLLGRNGSDYSAACLAACLGASVCEIWTDVDGVYTCDPRLVPDARLLPTLSYREAMELSYFGAKVIHPRTIGPLLPQNIPCVIKNTGNPSAPGSIIDGNVKSESLQVKGITNLDNLAMFNVSGPGMQGMVGMASRVFSAMSGAGISVILITQSSSEYSISFCVPVKSAEVAKTVLETEFANELNEHQLEPIEVIKDLSIISVVGDGMKQAKGIAARFFSALAQANISIVAIAQGSSERSISAVVPQNKAIEAVKATHQALFNNKKVVDMFLVGVGGVGGELIEQVKRQKEYLAKKNVEIRVCAIANSNRMLLDENGLNLEDWKNDLENATQPSDFDVLLSFIKLHHVVNPVFVDCTSAESVAGLYARALKEGFHVVTPNKKANTRELVYYNELRQNAQASQHKFLYETNVGAGLPVIENLQNLLAAGDELEYFEGILSGSLSFIFGKLEEGLSLSEVTALAREKGFTEPDPRDDLSGQDVARKLLILAREAGIELELSDVEVEGVLPKGFSDGKSADEFMAMLPQLDEEFKTRVATAKAEGKVLRYVGKISEGKCKVSIVAVDLNNPLYKVKDGENALAFYTRYYQPIPLLLRGYGAGNAVTAAGIFADILRTLQH

SEQ ID NO: 29699 - protein, 575 aa, Mycosphaerella pini
MSFATPSYEVDAEKKGGIYENKDDIHQIITTQDGEIAENADNLHRRLDNRQIQLIAIGGSIGTAVFVSIGSGLSRGGPGSLFLAYFIYSCFMALVNNCTAEMMTLFPVSGGFIRLAGHFVDEAFGFMAGWNFFLYEALLIPFEITALTTVIGFWSDNVPAYAVPVGCIVLYAAINILAVKWFGEAEFWLSGGKVLLIFMVFMFTFVTMVGGNPQHDAYGFRYWNNPGSFAEYRSLGALGRFEGFLACLWSASFTVVGPEYVSMVAAEAKRPRIYIKAAFKTAYWRFGLFFIGSALCVGIVVAYNDPILVGIVTGTGTGGGTASASPYVIAMRNLRINGLPDLINALLCTSIFSAGNAYVYCSTRSLYSMALDGRAPGVFKYCTKGGVPIFAFVVVMIFPCLSFLQLSNGSAKVLGWLINLVTAGGVINYIVMTTTYIFFYMAVKAQGVDRKTFPYCGWFQPYSAYLALAWMIMIVTCYGYSSFRPFSVENFFIYYALLILAPLTFTFWKLIKRTKFQKPSEVDLVWERPTIDAYEATFIDPPTGFWREILALVGIGRKKHQDRRRSSVTEQPYRP

SEQ ID NO: 29700 - protein, 237 aa, Haemophilus influenzae Rd KW20
MNIQHNLNLIQQKIETACKEENRNQNTVKLLAVSKTKPISAILSAYQAGQTAFGENYVQEGVEKIQYFESQGINLEWHFIGPLQSNKTRLVAEHFDWMQTLDRAKIADRLNEQRPTNKAPLNVLIQINISDEESKSGIQPEEMLTLAKHIENLPHLCLRGLMAIPAPTDNIAEQENAFRKMLELFEQLKQVLPNQQIDTLSMGMTDDMPSAIKCGSTMVRIGTAIFGARNYSTSQNK

SEQ ID NO: 29701 - protein, 457 aa, Desulfitobacterium hafniense Y51
MHRRIKMSISQRIEKLPVKRFHYILLISAGLGWMFDSMDTGIISFVLPVLMKTWGLTPEQVGNIGSVGLLGMALGAILSGSVADRIGRKKVFAFTLVVYSLATGLCGLAWSYASLLFFRFLVGFGLGGQLPVAVTLVSEFTPAKHRGKFLVLLESFWAIGWLLASVISYLIIPNYGWHIAFFIGAIPALYVFYLWKYIPESPRFLEEQGRIQEAEAVYRLIAGEAGPDVKAGRTAEEAKREHRQPQKGTAKTKVLKRVTVAELFSRKFLRRTVFLWLLWFGIVYSYYGIFTWLPSILALKGFSLTKSFSYVIIMTLAQIPGYFSAAFLVDRIGRKPTLAAFVLGTAISAYFFGLGNSVAMILVFGSLMSFFNLGAWGILYTYTPELYPTRARGTGAGWAAGFGRIGGILAPMVVGRMLGAEMPTETVFLMFAGVLILVVFNVLILGEETKGRPMDEL

SEQ ID NO: 29702 - protein, 442 aa, Chlamydophila pneumoniae J138
MTLQPYQASSRKYRPQIFREILGQSSVVAVLKNALVFNRAAHAYLFSGIRGTGKTTLARILAKALNCVHLSEDGEPCNQCFSCKEIASGSSLDVLEIDGASHRGIEDIRQINETVLFTPVKAKFKIYIIDEVHMLTKEAFNALLKTLEEPPQHVKFFFATTEIHRIPGTILSRCQKMHLQRIPEKTILEKLSLMAQDDHIEASQEALAPIARAAQGSLRDAESLYDYVISLFPKSLSPDTVAQALGFASQDSLRTLDNAILQRDYATALGIVTDFLNSGVAPVTFLHDLTLFYRNLLLTNSTTSKFSSQYKTEQLLEIIDFLGESAKHLQNTIFEQTFLETVIIHIIRIYQRPVLSELISSIKSRQFEGLRNIKEPTLTQQVSAPQPQPTYKEQSFLEKKNQPAAEGKIISVEVKSSASIKSAAVDTLLQFAVVEFSGILRQ

SEQ ID NO: 29703 - protein, 429 aa, Nostoc punctiforme PCC 73102
MSKFLDTAIEAIAAREILDSRGRPTIEAEVHLANGVVGLAQVPSGASTGSFEAHELRDGDKSRYGGKGVLKAVKNVKEALAPKLLGLDALNQELLDRTMIAIDGSPNKSSLGANAILGVSLAAAKAGAESLDIPLYRYLGGPLANLLPVPLMNVINGGAHASNNVDFQEFMIVPIGATSFREALRWGAEVFATLSQVLDEKGLLTGVGDEGGFAPNLESNQVALELLVAAIKKAGYKPGEEVALALDVAASEFYKNGQYVYDGKPHAPAEFIDYLGQLVDQYPIVSIEDGLHEEDWQSWQLLTQKLGSQVQLVGDDLFVTNATRLQRGIEEKAANAILIKLNQIGSLTETLETIDLATRNSIRSVISHRSGETEDTTIADLAVATRAGQIKTGSLCRSERVAKYNRLLRIEDELGDRAVYAGAVGLGPK

SEQ ID NO: 29704 - protein, 282 aa, Pseudomonas putida
MTDTERLLQSRSFVELGARQRARAMLDPGSFRELLGPFDRLMSPWLPRQGIVPQADDGVVIAKGRLNGRNAVVAAIEGGFQGGSMGEVGGAKIAGALELAIEDNRNGIPTCAVLLLETGGVRLQEANLGLAAIAEIQAAIVELRAWQPVIGVIAGSVGCFGGMSIAAGLCSHLLVTREARLGLNGPQVIEQEAGIGEYDAKDRPFIWSLSGGEQRHASGLVDGYVADDIDALRERLLQLLDAPSRDRASQHAWFLDRLARLGDDCPQLDAAAVRALYQGEAQ

SEQ ID NO: 29705 - protein, 436 aa, Prochlorococcus marinus str. MIT 9313
MHIAVVGLSHRTAPVEIREKLSIPEQTMETSLQTLRGNDQILEVSILSTCNRLEIYTLVRHPERGISAISDFLGQHSGLATEDLSPHLFNFHHDEAVAHLMRVAAGLDSLVLGEGQILSQVKKMVRLGQEHKSMGPILNRLLTQAVSTGKRVRSETNLGTGAVSISSAAVELAQLKLGQAQGEDQLMTLESELVAVVGAGRMSRLLLQHLQAKGCSGVMLLNRTRQRAEDLSADFPELPVECRPLDDLNHCLSTCSLVFTSTAADDPIVDASLLKQLKRRSFLRLIDIGVPRNIASDVVDVPGVESHDVDDLHEVVSRNQEARQQMAKEAEVVLQEETRLFLEWWDSLEAVPTINRLRATLEAIRAEELQKALSRMGPDFSARERKVVEALSKGIINKILHTPVTQLRAPQARPERQQALRVVASLFELDPPLENG

SEQ ID NO: 29706 - protein, 557 aa, Nostoc punctiforme PCC 73102
MSQPNPTQAFKFDSIDAALADLKAGRVIVVVDDENRENEGDLICAAQFATPDTINFMAVEARGLICLAMTGDRLDELDLPLMVSNITDTNQTAFTVSIDAGPELGVTTGISAEDRARTIQVTLNPATKPTDLRRPGHIFPIRAKAGGVLKRAGHTEAAVDLSRLAGLYPAGVICEIQNPDGSMARLQQLFEYAKRHNLKIISIADLISYRLQHDRLVYREVITKLPSQFGQFEIYAYRHTLDNTEHVAIVKGDPDNFKDEPVMVRMHSECLTGDALGSLRCDCRMQLEAALKMIEAAGQGVVVYLRQEGRGIGLINKLKAYSLQDMGLDTVEANERLGFPADLRDYGMGAQMLMDLGIKKIRLITNNPRKIAGVKGYGLEVVDRLPLLIEATDYNSYYLATKAKKLGHMLLQTYLVTVAIHWQDDPEAVTERYERLEKLRHLAKSNDLLLQEEARPLAIAIFDEPSLTVHLGFDQAKVAGCDWYQQSGHPYIQAIFQILDNLATLPYIQKLEFLISSGCDPLSNLQVQLDRQTFADGTLPSSISDRLEKQQIYSFSK

SEQ ID NO: 29707 - protein, 517 aa, Lolium rigidum
MDKAYIAILSSAFLFLVHYVLGKVSDGRRGKKGAVQLPPSPPAVPFLGHLHLVEKPIHATMCRLAARLGPVFSLRLGSRRAVVVSSSECARECFTEHDVTFANRPKFPSQLLVSFNGTALVTSSYGPHWRNLRRVATVQLLSAHRVTCMSGVIAAEVRAMARRLFHAAEASPDGAARVQLKRRLFELSLSVLMETIAQTKATRSEADADTDMSLEAQEFKEVVDKLIPHLGAANMWDYLPVMRWFDVFGVRSKILHAVSRRDAFLRRLINAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVSETLRLYPAAPLLLPHESSADCKVGGYNVPADTMLIVNAYAIHRDPAAWEDPLEFKPERFEDGKAEGLFMIPFGMGRRRCPGETLALRTIGMVLATLVQCFDWEPVDGVKVDMTEGGGFTIPKAVPLEAVCRPRVVMRDVLQNL

SEQ ID NO: 29708 - protein, 227 aa, Prochlorococcus marinus str. MIT 9313
MSTKPLVIAPSILSADFSRLGEDVQAVDQAGADWIHVDVMDGRFVPNITIGPLIVEALRPVTSKPLDVHLMIVEPERYVGDFAKAGADHIYVQVEACPHLHRNLAQIKDLGKKAGAVLNPSTPLDTLEYCLELCDLVLIMSVNPGFGGQSFIDNQVQKIRELRRICDEQGLDPWIEVDGGIKADNAWKVIEAGANAIVSGSGVFNQPDYAEAIRGIRNSKRPEGVVV

SEQ ID NO: 29709 - protein, 412 aa, Vibrio vulnificus CMCP6
MPFSTLSLSSELIHALPKDFKKPTDIQALAIPELLAGQDLLALANTGSGKTLAYGLPLLEKLGVNPEQKALILVPIRELATQVSEAINQVGQALGLNAVCLCGGVDKEQQLQALATNPHILVATTGRLVDLANNGLDLSNIHYLVLDEADRLLNMGFWPDVQNIAGQISNQRQTAMFSATFSDELKGKAKLLMQAPKQVAAHQENSTNQDIAETLYLVNKGSKTKALIELIQKNAWTQALVFIGAKENADGLAKKLNKAGISTNALHGDKSQAEREAALAQFKSGQTQVLIATDLLARGIHIEQLPVVINFELPMHAETYVHRVGRTARAGEQGVALSLVCHGEMDALSAIRHLTQRELPVQDLEGFPVTDKPSTGESKRAPRDKKANRRTQNKKSVKQFQSKAKRPAPKSK

SEQ ID NO: 29710 - protein, 517 aa, Lolium rigidum
MDKAYIAILSCAFLFLVHYVLGKVSDGRRGKKGAVQLPPSPPAVPFLGHLHLVDKPIHATMCRLAARLGPVFSLRLGSRRAVVVSSSECARECFTEHDVTFANRPKFPSQLLVSFNGTALVTSSYGPHWRNLRRVATVQLLSAHRVACMSGVIAAEVRAMARRLFHATEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVSETLRLYPAAPLLLPHESSADCKVGGYNVPADTMLIVNAYAIHRDPAAWEDPLEFRPERFEDGKAEGLFMIPFGMGRRRCPGETLALRTIGMVLATLVQCFDWEPVDGVKVDMTEGGGFTIPKAVPLEAVCRPRAVMRDVLQNL

SEQ ID NO: 29711 - protein, 517 aa, Lolium rigidum
MDKAYIAILSCAFLFLVHYVLGKVSDGRRGKKGAVQLPPSPPAVPFLGHLHLVDKPIHATMCRLAARLGPVFSLRLGSRRAVVVSSSECARECFTEHDVTFANRPKFPSQLLVSFNGTALVTSSYGPHWRNLRRVATVQLLSAHRVACMSGVIAAEVRAMARRLFHAAEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVNETLRLYPAAPLLLPHESSADCKVGGYNVPADTMLIVNAYAIHRDPAAWEHPLVFRPERFEDGKAEGLFMIPFGMGRRRCPGETLALRTIGMVLATLVQCFDWEPVDGVNVDMTEGGGFTIPKAVPLEAVCRPRAVMRDVLQSI

SEQ ID NO: 29712 - protein, 553 aa, Brassica rapa
MRGVKLLAACLYLAAAATVVVHAEDPYFHHVWNVTYGTASPLGVPQQVILINGQFPGPNINSTSNNNVIINVFNNLDEPFLLTWNGIQHRKNCWQDGTPGTMCPIMPGTNYTYHFQPKDQIGSYFYYPTTGMHRAAGGYGGLRVNSRLLIPVPYADPEDDYTVLIGDWYTKSHTQLKKFLDGGRTIGRPDGIVINGKSGKGDGSDAPLFTLKPERLTGLGSVTWVSDIYHFRIQNHKMKLVEWKDRTFFKRLRLSRRSRWPVLWHIVTANQEPKDYYMVASSRFLKTVITTTGLLRYEGGKGPASSQLPAGPVGWAWSLNQFRSFRWNLTASAARPNPQGSYHYGKINITRTIKLVNTQGKVDGKLRFALNGVSHTEPETPLKLAEYFGISDKVFKYDTITDDPTPEQIKNIKIEPNVLNITHRTFVEVVFENHEKSVQSWHLDGYSFFSVAVEPGTWTPEKRKNYNLLDAVSRHTVQVYPKCWAAILLTFDNCGMWNVRSENTERRYLGQQLYASVLSPEKSLRDEYNMPETSLQCGLVKNTPKPVNPYAGA

SEQ ID NO: 29713 - protein, 321 aa, Bacillus cereus G9241
MAVNEKVELATFAGGCFWCMVSPFEEMEGIIKVVSGYTGGHKENPTYKEVCSETTGHYEAVQITFDANKMPYEELLNIYWRQIDPTDVGGQFHDRGQSYETVIFYHNEEQHKKAEASKEELAKSGRFSKPIATKILPAATFYPAEEYHQGYHKKNEFRYELYRKGSGRDAFIKQHWPKDNAHLKEKLNEMQFYVTQENGTEPPFRNEYWNHKEEGLYVDIVSGEPLFTSIDKFDSGCGWPSFTKPVMSASVKEKMDVSHNMTRTEVRSKEGDSHLGHVFPDGPGPNGLRYCINSAALRFIPKEELEKEGYGDFLILFGNKK

SEQ ID NO: 29714 - protein, 360 aa, Chlamydomonas reinhardtii
MNLNTSQRVRTDASTSSPATRVPPHWRRSQSVPVTPSIASKPSYGSKSTIICNAQQYGRGQPPNQPQQPMALARRPIYQPVQPQQPVFLNLSQVSDKQVITRNTGKNLGTMGEAWVDPQRLEVVSFEVESKRGVGSSVTGNVPLAMLKQIGDVVLVQDELPPDQVPLDARYGFVKLLGLEVRTRMGRVLGKIRDITFNPDTGAISRIEYDDFGLRFLPVNFFDTFSVPAELVESAVLGYVLVASEGEAYQRQEKQGILSGILRGLGTRPQSMGLLLTDGGRNEVAGYLPQNYTYEKWESDIRRWEAETGMRYEDGASGGAMRVEEWLAREGVAQPQPVQAEPAAMANGWEGQGGRGGAQY

SEQ ID NO: 29715 - protein, 451 aa, Silicibacter pomeroyi DSS-3
MKTANFIKENNARQFWQPMTHPADAQANPPKIITGAAGVRIRDIDGHETIDAVGGLWNVNLGYSNDAVKQAITGQLDSLPYYSTFRGTTNDAAIELAYDLCDFFAEEGIQRVFYTSGGSDSVETALRLARQYHKLRGQPQRTKFLSLKKGYHGTHFGGASVNGNNKFRTDYEPLLPGCFHIPAPYTYRNPFNETDPARLAQLCAQALEDEIAFQGAETIAAFIMEPILGAGGVIPPHESFMPMVREICDRNGILLIADEVITAFGRTGAWSGSRLWGVQPDMMCTAKAITNGYFPFGAVLIGTRMTEVFEGDTSGKGAISHGYTYSGHPVGAAAAVVCLKETVKANVAENAATRGEELFNGLQALAAKHEMIGDVRGGHGLMAALEVVADRASKAPAGAAMMNTVYETAYGAGVMLRVSGPNIILSPPLVLSAQDVADILSALDAGFAALG

SEQ ID NO: 29716 - protein, 492 aa, Silicibacter pomeroyi DSS-3
MDQAAIDALRTRVIPPRGHVIGGRVEGGGETLDVISPIDGSVLTQIARGGAREVAQATAAARHAFTSRIWAGQPPAARKKVLTRLAELIEGEALDLAVQGVRDNGTEISMAFKAESGSAAGTFRYYAEALDKVYGEIAPTAGDILGLVHKEPVGVVGAILPWNFPLMIGAWKIAPALAMGNSIVVKPAESASLSILRLAELALEAGLPEGVFNVVTGKGSEVGEAMGLSMEIDILVFTGSGAVGRRLLEYSARSNLKRCYLELGGKSPNVVFADVADLDHAAKVSAAGIFRNSGQVCVAGSRLIVERSIHDEFVDALCRHASALRVGDPLDLGSTVGAVHSVAQLEQNLRFVETALAEGADCALGGKRILEETGGYYMQPTVMTGVTRDATLNQQEVFGPVLAVSAFDTEGEAVDLANSTVYGLASGLWTSDLGRAHRMVRAIRAGVVHVNTYGGADGTVPLGGVGQSGNGHDKSLHALDKYVDLKTAWMQL

SEQ ID NO: 29717 - protein, 251 aa, Brassica rapa
MESRVRKRMTRRRKSENSKNQLGSVSTTSPAEVLALSVTYNEPWFTDTLYFWIGPGDQIWPNQQMKIKLKFLYMYTAGFYTYSIFALIFWETRRSDFGVSMGHHITTVILIVLSYICRFSRAGSVVLALHDASDVFLEVGKMSKYSGFEGIAAFSFVLFALSWVLLRLIYYPFWILWSTSYQIIMTVDKEKHPIEGPIYYYMFNTLLFCLLVLHIFWWVLIYRMLVKQVQDRGKLSEDVRSDSESDDEHED

SEQ ID NO: 29718 - protein, 500 aa, Candida glabrata CBS 138
MSEPVKFEKNTVVVVFGASGDLAKKKTFPALFGLFREGYLHESTKIIGYARSSLTVEELTERIKPHLKTPRGKEDEAKIPQFFKLLTYVSGPYDQDDGFIRLREQIETFEGAKCSTVPHRLFYFALPPSVFLPVATNIKRLVYAENGVTRLIVEKPFGRDLETARKLQADLSPLFKEEEIYRIDHYLGKELVKNLLVMRFGNQFLNSAWNRDNIQSIQISFKEPFGTEGRGGYFDNIGIIRDVMQNHLLQVLTLLTMERPVSFDPEAIRDEKVKVLKAMAPFDPKDILIGQYGKSEDGSKPAYLDDETVKPGSKCVTFAAIAFQIENERWEGVPIVMRAGKALNEGKVEIRLQYKAVASGVFKNIPHNELVIRIQPNEAVYMKFNAKTPGLSNATQVTDLDLTYSSRYKDFWIPEAYEALIRDALLGDHSNFVRDDELDVSWSLFTPLLNYLEGPDAPQPEIYPYGSRGPSGLRDYLKKHNYMIEEKHPYTWPVTTPDED

SEQ ID NO: 29719 - protein, 432 aa, Silicibacter pomeroyi DSS-3
MTPDTQALLDRRARLLGPNVSLFYDEPVHVVRGQGVWLWDNDGNRYLDCYNNVPHVGHCHPRVVEAIATQAATLNTHTRYLHEGILDYVEALTATFDAPLDTAILTCTGSEANDIALRMAQAVTGNTGVIATDHTYHGNTMAVSQLSRTNPPPGGYWDNMAFVPAPDSYRPLGGVPGPAHALAFAAAVQGQIEALAARGHKLACLILCPYFANEGFPTLEPGWLAPAIEAVRRAGGIVIADEVQPGFGRLGSHFWGHQKAGIQPDVVTLGKPMANGHPVGGVVTSPEIMAAFRERFRYFNTFGGNPVSAAAALATLKVVQDEGLMENARAVGDYAREGLRDLAGRHECIGDVRGSGLFFGAELVLDRTDKTPATAFAKRVANAMRQRGVLLNFLGIHYNTLKIRPPMPFSRDNADQLIETLDAVLSETPFVP

SEQ ID NO: 29720 - protein, 417 aa, Brassica rapa
  misc_feature (171)..(171): Xaa can be any naturally occurring amino acid
MPRSLEPLDLGIQIPYHFRCPISLELMRDPVTVCTGQTYDRTSIESWVSTGNNTTCPVTRAPLSDFTLIPNHTLRRLIQEWCVANRSNGVERIPTPKQPADPTSVRALLSQASATSGAHVSARSRAAALRRLRGFARDSEKNRVLIAAHNAKEILIRILFSDDIDSSELVXESLALLVMFPMTEHDKCVSIISDPGRVEFLTRLLFDSSVETRVNAAALIEMAVTGSKETVSSSESIFEGVLDLLRNPASSYPRRALKIGIKALFALCLSKNTRHVAVSAGAPEILIDRLAAGLDRCDTERALATVEILCRSPEGCAAFGEHALTVPVLVKTILRVSDRATEYAAGALLALCTAEERWRDEAAAAGVVVQLLLMVQSECTERAKRKAQKLLKLLRDSWPDYSFANSDDFACSEVVPF

SEQ ID NO: 29721 - protein, 182 aa, Musa acuminata
FGVVYRGELKDTNEIVAVKQLDRNGFQGNREFLVEVLMLSLLHHPNLVKLLGYCADGDQRILVYEYMPLGSLEDHLLDVSADAKPLEWHTRMKIAAGAAKGLQCLHETANPPVIYRDFKASNILIDEDYNAKLSDFGLAKIGPVGDKNHVSTRVMGTYGYCAPEYALTGQLTKMSDVYSFGI

SEQ ID NO: 29722 - protein, 339 aa, Ralstonia eutropha JMP134
MSQTLLLTGATGYIASHTWVALLNAGYKVIGLDNLCNSSRVVVDRLATITGQTPHFVEGDVRDRALLDRLFAEHDITGAIHFAALKAVGESVSQPLEYYSNNLDGMLTLCAAMRDAGVKQLVFSSSATVYGNPHAVPILEDFPLSATNPYGQTKLMGEQILRDLEKSDPEWRIAYLRYFNPVGAHKSGLIGEDPRGIPNNLMPYVAQVAGGRREKLMVFGGDYPTPDGTGVRDYIHVCDLADGHLAALVCLRDRGQSMTVNLGTGSGYSVLEVVAAYQRASGRPVPYEIVARRPGDIASCYADPALAHQLLGWRARHGLDRMCEDSWRWQSTNPNGFDA

SEQ ID NO: 29723 - protein, 613 aa, Gibberella zeae PH-1
MEDQEPLLLAVWRRCSEMAAEHNISQSTLSAAGTVAAIIAATLILRITNAIAAASISAATSRPRKYTVPSPKVPEPHTTVDITSVKVSGSSAVQCYAPATGQFLGNVNPSTPAAIDRAVSAAATAQKTWAETTFGQRRAVLSSLLQHVLDNAEEIVKIACLDSGKTMVDAQLGEILVTAEKLKWTLSHGEQALRPSRRPTNFLMMYKRNTVHYEPLGVVAALVSWNYPFHNFIGPVISALFSGNGILVKVSEQTAWSSQYFTNIARGALIAHGHDPQLVQTIVCWPQAAGHLTSHPSISHITFIGSQSVAHHVAASAAKSLTPVVAELGGKDPFIVLDSASGDLKRIAEVILRGTFQAAGQNCIGIERVIAPSAIHDKLVEMLAPRVNALRLGPDADVGAMISDASFDRLEELIAEAVSQGARLLAGGKRYDHPEYPSGHYFQPTFLADVTPEMRIAQNECFAPVLTLLRAKSSSPEDILSIANAPNFGLGASVHGSERDPNVQPIVKGLRAGMVAVNDFAVYYAVQLPFGGVGGSGYGRFAGEEGLRGLCNAKAVCEDRFGWLGVRTSIPPPVQYPIKSQSDSWKFTQGVVELGYGAPIRKLKGLGKILQNM

SEQ ID NO: 29724 - protein, 173 aa, Hyacinthus orientalis
MDAAATSLPTNPNPKVFFDMSIGGAPAGRIVMELFADVTPNTAENFRALCTGEKEPGRSGKPLHYRGPPSTGVIPGFMCQGGDFTAGNGTGGESIYGSKFEDQNFERKHTGPGILSMANAGPNTNGSQFFICTDETDWLDGKHVVFGQVVDGMEVVEAIQKVGSRGGTPKNPL

SEQ ID NO: 29725 - protein, 361 aa, Aspergillus nidulans FGSC A4
MVQQMPPQGGSRKISFNVSDQYEIQDVIGEGAYGVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKALFPKSNDLALDLLEKLLAFNPTKRITVEEALRHPYLEPYHDPDDEPTAPPIPEGFFDFDKNKDALSKEQLKSKYLAPIDSISYATIN

SEQ ID NO: 29726 - protein, 180 aa, Kluyveromyces lactis NRRL Y-1140
MKYIPPLSFAPVVGTDVDLYRSGYPMPLNYSFIKHQLHLKTVIYVGDKDILPEYKAFLEEESIKFHHIPMKSTKDPEIQKEMETVLKLVLDVNNYPILVHSNKGKHRVGVVVGIIRKLLLGWSMTGIYQEYDLFTGGQKGDIDLEYITMFNTSINVPLDRLPDFVNFKNHPNETHEKLAV

SEQ ID NO: 29727 - protein, 321 aa, Triticum aestivum
  misc_feature (198)..(198): Xaa can be any naturally occurring amino acid
  misc_feature (246)..(246): Xaa can be any naturally occurring amino acid
  misc_feature (266)..(266): Xaa can be any naturally occurring amino acid
  misc_feature (273)..(273): Xaa can be any naturally occurring amino acid
MYVPQSSRGGGGSAGEQPRVYQVWRGSNEFLLQGRFIFGPDVRSLFLTIFLILAPVLVFCIFVARHLMNDFPDHWGISVMVVAVVFTVYDLTLLLLTSGRDPGIVPRNTHPPEPESLDGNTDTGHGQTPQQLRLPRTKDVYVNGVVVKVKYCDTCMLYRPPRCSHCSICNNCVERFDHHCPWVGQCIGLRNYRFFYMXVFSTTLLCLYVFGFCWVYIIKIRDAEDSSIWRAMLKTPASMVLIIYCXICVWVVGGPSVFHFYLMSTXQTTYQNXRYRYDRRATHICRCVNTFWKSLDAVPLPEIFRLRSIKQGYEIRPHQGS

SEQ ID NO: 29728 - protein, 143 aa, Zea mays
DDIKNPLREHFSSCEEIKNVSVPIDRDTGNSKGIAYLEFSEGKEKALELNGSDMGGGFYLVVDEPRPRGDSSGGGGFGRGNGRFGSGGGRGRDGGRGRFGSGGGRGRDGGRGRFGSGGGRGSDRGRGRPSFTPQGKKTTFGDE

SEQ ID NO: 29729 - protein, 331 aa, Idiomarina loihiensis L2TR
MTIKVGINGLGRIGRLALRVAWENPDLEIVQVNDPGADAATFAHLLNFDSVHGRWGYEAEAQDNAIQIGDERIAFTQHKTIAENDWSGCDVVLEASGKMKTVKVLNDYLSQGVKRVVVSAPVKEPGALNIVLGVNDHLYDPEKHQILTAASCTTNCLAPVVKVLQDKIGIKHASITTIHDLTNTQTILDAPHKDLRRARACGMSLIPTSTGSATAIVEIFPELKDKIDGHAVRVPLANASLTDCVFEVKKSTSVEEINGWMKEAAEGELKGILGYEERPLVSIDYKTDPRSSIVDALSTKVINGTHVKIYAWYDNEWGYANRAVELVEKVG

SEQ ID NO: 29730 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGYCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 29731 - protein, 588 aa, Actinobacillus pleuropneumoniae
MSDKKIKGLEWQEKPLSDNERLKTDSNFLRGTILEDLKDGLTGGFKGDNFQLIRFHGMYEQDDRDIRAERLEEKLEPLKFMLLRCRLPGGIIKPYQWIEIDKFAREHTRYQSIRLTNRQTFQYHGVPKGKLQPMHRLLHSIGLDSIATAADMNRNVLCTSNPIESELHQQAYEFAKKISEHLLPRSRGYLDVWVDGKKIESSDDLLKIEDEPILGKTFLPRKFKTAVAIPPLNDVDVYANDLNFIAIQDDNGQLCGFNVLVGGGLSFEHGNTKTYPNVAYSLGFVPLEHTLAAAEGVVKTQRDFGNRSDRKNARVRYTIQNMTLDGFRAEVERCMNIKFEPTRPYEFTERGDRIGWVKGIDNNWHLTLFIESGRITDKPEKPLMTGVLELAKVHKGDFRITANQNLIVANVAEQDKAQIEAIARQYGLIQEISKLRENAMSCVSLPTCPLAMAEAERVLPDFISELDKVLSKHNVADESIITRITGCPNGCGRAMLAEIGLVGKAIGRYNLHIGGDRAGLRIPRLYKENITLQEIVNEIDQLVARWATERQTNEAFGDFVIRSNIIAPVVNAHIDFWDATKIIPTTII

SEQ ID NO: 29732 - protein, 496 aa, Idiomarina loihiensis L2TR
MLKSIQQNWFSNIRGDLLSGIVVALALIPEAIAFSIIAGVDPKVGLYASFCIAVVIAFTGGRPGMISAATAAMALLMASLVKEHGLEYLLAATLLTGLLQIAAGYLKLDELMRFVSRSVVTGFVNALAILIFMAQLPELTNVTWHVYAMTAAGLTIIYGFPYIPFIGRILPSPLICIVTLTVVAVFLEMDIRTVGDMGKLPDTLPIFLWPDVPLNFETLAIIFPYSAALAVVGILESLMTATIVDDLTDTPSDKNRECKGQGVANIGAGLLGGMAGCAMIGQSIINVKSGGRTRLSTLTAGIFLLIMVLVLDKLLVQIPMAALVAVMIMVSIGTFSWSSIKNLKKHPLSTNIVMVATVAVVVATHNLAYGVLVGVLLAAMFFANKIGHYLYIKSEIDSDGIKRTYRVIGQVFFSSSEKFLGAFDFKEGVEQVVIDLSQAHFWDITAVDALDRAVVKFRREGAEVEVIGLNEASATIVDRFGVHDKPDAVDKLMGGH

SEQ ID NO: 29733 - protein, 82 aa, Glycine max
  misc_feature (28)..(30): Xaa can be any naturally occurring amino acid
  misc_feature (70)..(71): Xaa can be any naturally occurring amino acid
ACLQTLKNALSPYKLGGAAGGSDFDPKXXXDNEIMRFCQSFMSEMYRYLGPDKDLPSEEMGVGTREMGYXXGQYRRLAGHFQ

SEQ ID NO: 29734 - protein, 478 aa, Aspergillus nidulans FGSC A4
MSATEVTSENVAQILQNDTRVKLAGVDADGMLRGKLVSKKKFLSVVDEGFGFCSVIFGWDMHDRTYFRELGISNKENGYRDLLAKPDLSSFRRIPWENNVPFFLVSFYDPDTKEPLFACPRSLLRMALRKPEAQGYRAMAGAEYEFYQFATPNRNASSTASFLKENPVEALPSITDGMFGYSLTRPIHNQDYYYGIFDACEQFNCEIEGWHTESGPGVYEAALQFGEAKGMADKAGLFKYVVKSIGTKHGITPTFMAKPREGLPGNSGHMHISLVNSDDTNAFHRSTPDPSPPYPDVAYLSDLGRCFLAGILTGLPDIMPMFAPTVNSYKRLVENFWAPVTVSWGLEHRAASIRLITPPTASPKATRLEVRVPGADANPHFVLAAIVALGWWGVEKKLEIPVPPLSKGEDMGGESDKGVRLAKNLGAAIATFTRKDSVAREVFGDAFVDHFGGTREHELRLWEEAVTDWEVRRYIETV

SEQ ID NO: 29735 - protein, 507 aa, Lolium rigidum
MNLEVAFLHEYASPRALVVAVVLVLVAVHLARSTSRAERLRRKLPCPRFTLPVIGHLHLIGSLPHVGLRDLARKHGPDVMLLRLGAVPTLIVSSPSAARAVLRTHDHVFASRPDTVVGDILFVGSTNVGHSPYGEYWRQVRKIITTHVLTAKKIRANLPYREQEARLALASVREAAAAGTAVDLTHLFSHFAHDMVSQAVAGRIHREDRWGKLFHDLFVGNGQLLGGFNLDDCFPSLARLGIGSANIAKQRKRWDDLLDEVIDRHTSTPMEKGDEPDFIDVMLSVQDEYKLTRNNIKSILMDMFQAGTDTTFIWLDYAMAELARAPQVMAKLQAEVRRCSTTNQLLTQEDLSSMSYLKAVMKETMRLHPPGPLLLPHASIADCEVEGYVVPAGTRVIINVWAIGRHASSWERAEEFVPERFLEGSVDANSDFYGNDFRLLPFGSGRRMCPGINFATLTFEIILANLIYHFDWELPEGSPGVDMTEAFGMDVHRKENLLLVPRVAKIV

SEQ ID NO: 29736 - protein, 510 aa, Lolium rigidum
MDELFLLSVLLAAAAVALLQVLKVALNPVSDRAPPGPWKLPVIGSMHHLVNVLPHRALKDLADVHGPLMMLQMGQTPLVVASSKETARLVLKTHDTNFATRPKLLAGEIVGYEWSDIVFSPSGDYWRKLRQLCVAEILSPKRVLSFCHIREEEVGIRVEQIRAAGPSTPVNLSVMFHSITNSIVARATFGKKRKNAAEFMAAIKSGVGLASGFNIPDLFPTLTTVLATITGMKRSLHGIHTSHTTVDTILEEIINERNIARAEKIKAGATENVDENLTDVLIGLQGKGGFGFHLDNSKIKAIILDMFAGGTGTSASAMEWGMSELMRNPAVMEKLQGQIREAFKGKTVVTEANLQASGLRYLKLVIKEALRLHPPAPLLVPRESIDVCELEGYTIPAKSRVVINAWAIGRDPRYWDDAEEFQPERFEDGTVDFTGSNYEFLPFGAGRRMCPGFNYGLASMELALVTLLYHFDWSLPEGVAEVDMEEAPGLGVRRRTPLMLLATPFVPVVA

SEQ ID NO: 29737 - protein, 282 aa, Escherichia coli CFT073
MAYITLSSLRVNPEFQDFSLCCYDYLVKCFTLSSQRRRIIGIPIFCTSTFLIFFSVCCFFTLFAAFAHKTVLFCILKDLHKANNVPKVISKSFIVEVSMSDVLRPYRDLFPQIGQRVMIDDSSVVIGDVRLADDVGIWPLVVIRGDVHYVQIGARTNIQDGSMLHVTHKSSYNPAGNPLTIGEDVTVGHKVMLHGCTIGNRVLVGMGSILLDGAIVEDDVMIGAGSLVPQNKRLESGYLYLGSPVKQIRPLSDEEKAGLRYSANNYVKWKDEYMDQGNHTQP

SEQ ID NO: 29738 - protein, 325 aa, Vibrio vulnificus CMCP6
MKHIAIIGECMIELNGKPFGSMHQTFGGDTLNAAVYLSRGCEANSKPDEVKVSYVTALGNDPISTGMLTRWQDEGVSTDLVLRDETRTPGLYLIQLDDQGERTFLYWRNQSAARYLLQHPNFGMVKQALTQVDAVFLSGISLAILPEEDRISLLNLLVELKAQGVEIAFDSNFRPALWPQDNNLTVKNVYQAMYQLTDVALVTFDDEQLIWGDETPEQTIERLTSLGVGKCIVKLGADGCLVQDSTNQGAGAALAPQAVPTQPVAQVVDTTSAGDSFNGGFLSAYLAGADLATSCQRGNALAGAVIQHRGAIIPKAFTQPALGVV

SEQ ID NO: 29739 - protein, 507 aa, Lolium rigidum
MDELFLLSVLLAAAAVALLQVLKVALNPVSDRAPPGPWKLPVIGSMHHLVNVLPHRALKDLADVHGPLMMLQMGQTPLVVASSKETARLVLKTHDTNFATRPKLLAGEIVGYEWSDIVFSPSGDYWRKLRQLCVAEILSPKRVLSFCHIREEEVGIRVEQIRAAGLSTPVNLSVMFHSITNSIVARATFGKKRKNAAEFMAAIKSGVGLASGFNIPDLFPTLTTVLATITGMKRSLHGIHTTVDTILEEIINERNIARAEKIKAGATENVDENLTDVLIGLQGKGGFGFHLDNSKIKAIILDMFAGGTGTSASAMEWGMSELMRNPAVMEKLQGQIREAFKGKTVVTEANLQASELRYLKLVIKEALRLHPPAPLLVPRESIDMCELEGYTIPAKSRVVINAWAIGRDPRYWDDAEEFQPERFEDGTVDFTGSNYEFLPFGAGRRMCPGFNYGLASMELALVTLLYHFDWSLPEGVAEVDMEEAPGLGVRRRTPLMLLATPFVPVVA

SEQ ID NO: 29740 - protein, 598 aa, Prochlorococcus marinus str. MIT 9313
MTEGQTTSGQAADLKFAACLASGAEQSKFEQFKADSCYLLDPLAAELENSSDHFSNDAVQLLKFHGSYQQDNRDNRQKGAGKDWQMMLRLRSPGGRIPPALFLALDDLSNRLGNGSLRATTRQAFQIHGVRKEDLREVISTIIRSMGSTLAACGDITRNVMAPAAPYEKGGYPAARQLANEIADVLSPTAAEGSYLDLWVNGNATYRIRPSRRVKKVRTRQHQGNVFSGDAKEPLYGTTYLPRKFKCAVTVPGDNSVDLLTNDIGLVVFTAANGEIKGCNVYVGGGMGRTHNNEQTFARTADPLGYVAAEHVLDLVQSILALQRDYGDRKTRRHARMKYLLNDHGISWFKQELKSKYFLHPIKALRPEPKSKLEDYLGWHQQSVGQWFVGLPLLSGRLEGDLKKGLRQLVETFQLEIRLTPNQDLLLCNIGTSQRSSVRKGLAALGIRAPEAPAMLARHAMACPALPLCGLAVTEAERTLPALLERIDAQLRRLEITKSILIRMTGCPNGCARPYMAELALVGSGVDQYQLWLGGTPNLQRLAKPYLQRMPLDQLESTLEPLLLSWKQAGGRRSLGDHVNKLGDQAVLGLLSGNGQAP

SEQ ID NO: 29741 - protein, 348 aa, Prochlorococcus marinus str. NATL1A
MRVLLTGGAGFIGSHIALLLLERGYDVLILDSFANSSSNVIERIENFLDNKALKYKLRVINGDIRDKQILESIFSKCVKENKPIEVVIHLAGVKSVCESLTNPLYYWDVNVSGTLNLLLTMKDYQCYSLVFSSSATIYGLSDYVPILEEQKISPITPYGQTKVAVENLFYDLYKSNVNLWKICSLRYFNPVGAHPSGLIGEDPRGIPNNLFPFITQVAIGRQKILNIYGDDWETKDGSGIRDYVHIIDLAEGHLASIDYLNTSESCLEFINLGSGKGYSVFQIIRQFELSTGCSIPFSIESRRDGDVAVSYADISKAKRLLSWTPKRSLEQICLDGWNWQIKNPNGYG

SEQ ID NO: 29742 - protein, 121 aa, Arabidopsis thaliana
  misc_feature (40)..(40): Xaa can be any naturally occurring amino acid
MAEESRVPSSVSVTVAHDLLLAGHRYLDVRTPEEFSQGHXPCGAINVPYMNRGASGMSKNPDFLEQVSSHFGQSDNIIVGCQSGGRSIKATTDLLHAGFTGVKDIVGGYSAWAKNGLPTKA

SEQ ID NO: 29743 - protein, 482 aa, Bradyrhizobium sp. BTAi1
MGKVTGFLEIERHDRKYAPVAERLKNFNEFVVPLSEKELRDQAARCMNCGIPYCHGTGSAAPGTTGCPVNNQIPDWNDLVYNGNWEEAARNLHSTNNFPEFTGRICPAPCEASCTLNIDDNPVTIKTIECAIVDKAWENGWLKPEPAAVKTGKKVAIVGAGPAGLAAAQQLARAGHDVHVFEKNAKAGGLLRYGIPDFKMEKGIIDRRIAQMEGEGVTFHYGVNVGGKDGLDAKTLLKDYDAVALTGGAEAPRDLPIPGRDLAGIHYAMDFLPQQNRRVGNEPVNTTEILAGGKHVVVIGGGDTGSDCIGTSLRQGALSVTQLEIMPAPPERENKALTWPNWPLKMRTSSSQAEGAVREFAVLTQKFEGENGVVKKLHCVRVDAQFKPIPGTEFVLAADLVLLAMGFVHPVHEGLLKSLGVDLDPRGNVKANLTDYQTSLPKVFSAGDMRRGQSLVVWAIREGRLCAQAVDKFLMGKTDLPR

SEQ ID NO: 29744 - protein, 270 aa, Haemophilus ducreyi 35000HP
MNPMLNIAIRAARKAGNIIAKGYEQAIIETEVVQKGINDYVTDIDKAAEAAIIDVIRKSYPDHGIICEEAGILAGKNENVQWVIDPLDGTTNFVKRLPHFSVSIAIRENGRTTVGVVYDPIRNELFTAVRGEGAKLNEFRLRVNAERRDLTGAILATGFPFKSSQHRVAHLNMLEALVNNGVADFRRTGSAALDLAYVAANRVDGFFEIGLKPWDCAAGDLIAREAGAIVSNFVGGTDYLKSGNIIAGQSRVVKEILNYIQPTLTADLKN

SEQ ID NO: 29745 - protein, 617 aa, Haemophilus ducreyi 35000HP
MQNKYPLLSQIDSPEDLRLLGKEDLSALANELRTYLLDSVSQTSGHLASGLGVVELTVALHYVYQTPFDQLIWDVGHQAYPHKILTGRRDQMHTIRQKNGIHPFPWREESPYDVLSVGHSSTSISAGLGIAVAAQKENAGRKTVCVIGDGAITAGMAFEAMNHAGALHTDMLVILNDNEMSISENVGALNNHLARIFSGSLYTSMRDGSKKVLDKVPTIKNFMKKSEEHMKGVIFSPDSTLFEELGFNYIGPIDGHNIEELVKTLTNMRELKGPQFLHVRTKKGKGYEPAENDPISYHGVPRFDPASGKLPQSKIVPTYSDIFGNWLCEMAENDEKIIGITPAMREGSGMVEFSKRFPTQYFDVAIAEQHAVTFAAGLAIAGYKPVVAIYSTFLQRAYDQLIHDIAIQNLPVIFAIDRAGVVGADGQTHQGAFDLSFMRCIPNMTIMCPADENEMHQMLYTAYKMQTPTAIRYPRGNARGIALQPMAELAVGKARIIHQGKKVAILNFGALLSEAQEVAISHNYTLVDMRFVKPLDKTLISELADSHSLLVTLEENAIQGGAGSAVNEYLQQIGKIKPLVLIGLPDMFIPQSTQQESYADFGLDAKGIDQKIKLALS

SEQ ID NO: 29746 - protein, 448 aa, Silicibacter pomeroyi DSS-3
MTRTPQTHEAAPGGAGSISLTNAVAMGTGVMIGAGIFALTGQIAGLAGPLFPLSFVLGAVVTMFSAYSYIVMSNTWPSSGGIAMILTKAYGPGAVAAAASVLMALSMVINESLVARTFATYALRPFGIQDGPLVPAIGVALIVMAYLVNVSGNRAVGLWSLVMSAVKIGGIALFGIAALWASGIENWSPAARLSQNGITGFAASVALSILAFKGFTTITNSGGEITDPRRNVGRTILLSIAVCVVVYLLVALAVGSALTPVQIQQARDYALAEAAQPVLGQTGFYLTVALAMVATASGLIASVFAVSRMLTMLTEMKMIPHSHFGMPGGIRSHMLIYTVVIAGALTVLFDLGRIASLGAFFYLVMDMVVHWGVWKNLRHRIGARGWVILTALTLDAAVLAAFTLFKWRADPTIVIVALVTMLAALLAERLYLGGFVSDGGEGKHTGHR

SEQ ID NO: 29747 - protein, 407 aa, Candida glabrata CBS 138
MGEKRSIAIDSYQEDPSVVVSNFFKGVRVPKDTEFQLYKKRKQDQFVLHGENERLEYDGETDELTTKTNQYVVGLYDKQSGKINLYRAPVVTSKIVSKFSKNLKGPEIKSKGDTRYGAMRNALGEAFGTKKAKKAIADLERNRVDSDKLTDVAIDIVDSVKTASKDLPTRAELQENVSASNRPTPVANLDATDVEQIYPVENIIPKKELQFIRVGPILKEKDQEKKLELFPYTSSKYVAKKLETLTQASQMEKLQLLYYLSLLLGVYENRRVSNKDKLLERLNSPPELLIDGILDRFTIARGGHFGKSKNRSYFIDPQNEDKLLCFILTIVMHLDNFLVEISPLAQELGIKPSRIVNLFRILGAIVKGATVSQAEAFGIPKSAAATYKIASLKVPFKLPELTRRGRR

SEQ ID NO: 29748 - protein, 479 aa, Haemophilus ducreyi 35000HP
MSRKLRRTKIVCTMGPATDRSNNLERIIAAGANMVRMNFSHGVPEDHIERANKVREIAARLGKHVAILGDLQGPKIRVSTFKEGKIFLNIGDKFTLDADLPRGEGDQQVVGLDYKNLPNDVVPGDILLLDDGNVQLKVISVEGAKVHTEVTLGGPLSNNKGINKLGGGLSAPALTEKDKEDIKLAARIGVDYLAVSFPQSSQDLHYARQLAEEAGLDAKIVAKVERAETVATEEAMDDIILGADVVMVARGDLGVEIGDAALVGVQKRLIRRARKLNRVVITATQMMESMIKKPMPTRAEVMDVANAVLDGTDAVMLSGETASGDYPVETVKSMAEVCLGAETMPSINISRHRMQGKFAAIDEAVAMSAMYTANHLESVSAIIALTHSGETAKLMSRISSGLPIYALSRNQQALNRTALYRGVTPVYYNEESRTIEGAKKGIALLKEKGYLMTGDLVLLTQGSESKDGGTNTCRILKVE

SEQ ID NO: 29749 - protein, 314 aa, Pyrobaculum aerophilum str. IM2
MGPVEINKYTLLHGLNGGVYELEERLYSLLNERAKFNVPPLINGVLAPIIASEVSKRHKPVVAYLGPEKSFTWEAAAALFPQGDLMPCKSISEVFDKVESRAADYGVVPFINSLEGPVGETIDMLATHNLNIVTMGEMRITLCIAKKGAPRVIYTHPHAAAQARRAVAALGAHVVYTNSTSEAVKEFEKCERDCAVLASPKALEAVERTCGVEDGESYTRFAVISRAGRESGERAVLIFAVPNVAGALYKALGPIANRGINMTLIYSRPTRLSPWDYYFVVEVEAGEGLDDAVEEMKRYTTMLKVAGRYNVIRI

SEQ ID NO: 29750 - protein, 250 aa, Mycoplasma mobile 163K
MIKIKNQQEILKIRKSCKILAEIKEIIYNLVRPGISLKELDQVAFEEILKRKVKPAFLGYHGFPNSTCLSVNEELIHGIPSNYILKEGDLLKVDMGIIYDSYYSDSAFTISVGTQTNTENNYLINAAKEAFYEGIKAIKPGSRIGDIEDAIGRYLAKNNLYTPDEFSGHGIGKNLHEDPIVANKGKKNKGPLLKDGMVICIEPMIMQDNNDLYIKDDGWTVVCKSGKKSSHYEHTVLIENGKAIILTEGI

SEQ ID NO: 29751 - protein, 472 aa, Lactococcus lactis
MAQANFGVVGMAVMGKNLALNVESRGYTVAIYNRTTSKTEEVFKEHQDKNLVFTKTLEEFVGSLEKPRRIMLMVQAGAATDATIKSLLPLLDIGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRILGLSNAEIQAIFEEWNEGELDSYLIEITKEVLKRKDDEGEGYIVDKILDKAGNKGTGKWTSESALDLGVPLPLITESVFARYISTYKDERVKASKVLSGPALDFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGTPIPTFTSAISYYDSYRSENLPANLIQAQRDYFGAHTYERTDKAGIFHYDWYTED

SEQ ID NO: 29752 - protein, 510 aa, Desulfitobacterium hafniense Y51
MAQELVLVLDFGGQYNQLIARRVREAHVYSEMISYKTPVEEIKARNPKGIIFSGGPASVNQEGAPKVDEAIYELGIPIFGICYGMQLMTVQLGGKVMHPEVREYGKAMLHVDQAKGLWKGLGGERQCWMSHGDSVTELPEGFVIAAHTDHTPVAAMTDETRHFYGVQFHPEVKHTPDGQAMLKHFLFDICGCHGEWTMESFIDAQVKAIREKVGERQVLCALSGGVDSSVAAVLVHKAIGDQLTCVFVDHGFMRKNEPEQVKKIFTEQFHLKLIFVDARERFMAKIGGVSDPETKRIGIGNEFIRLFEDEARKLGQIDFLVQGTLYPDIVESGTDTAETIKSHHNVGGLPEDMQFELIEPLDMLFKDEVREVGAELGIPDEIVWRQPFPGPGLAIRIIGEVTEEKLDILREADAVIVEEIRNAGLYKEVWQSFAVLPTIKSVGVMGDGRTYAYPIVVRAVTSEDAMTADWARLPYDLMEKISTRIVNEVKGVNRVVYDITSKPPGTIEWE

SEQ ID NO: 29753 - protein, 473 aa, Lactococcus lactis
HMAQANFGVVGMAVMGKNLALNVESRGYTVAIYNRTTSKTEEVFKEHQDKNLVFTKTLEEFVGSLEKPRRIMLMVQAGAATDATIKSLLPLLDIGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRILGLSNAEIQAIFEEWNEGELDSYLIEITKEVLKRKDDEGEGYIVDKILDKAGNKGTGKWTSESALDLGVPLPLITESVFARYISTYKDERVKASKVLSGPALDFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGTPIPTFTSAISYYDSYRSENLPANLIQAQRDYFGAHTYERTDKAGIFHYDWYTED

SEQ ID NO: 29754 - protein, 673 aa, Coccidioides immitis RS
MASNSPPESSSQSTFDTCAKGDFQESPRKRRRLSIGFSVNHEPSASVFGPSPPGNPTQESRDYHAVSDVSVAGNTQLDLPERSIAPFLTKHIRDQHAVMNQFEPLAAPSSSRNPNSRYCYRHRPDLKCRRQADEITMDQMQRELHTLSQNDQRSIAHFWALFSAAPSKHRNLMLRGILAQCCFPQLSFLSASVRDLIRIDFLTALPPEISFKILCCLDTASLCKAAQVSRRWRDLADDDVVWHRMCEQHIDRKCKKCGWGLPILDRKRLRDSRRQIQLRATGKDSDRKSATPEAMDADEDYFKTQYRPWKDVYRDRFKVGINWKHGRCTTKIFRGHSNGVMCLQFEDNILATGSYDTTIKIWDTDTGEELRTLHGHQSGIRCLQFDDTKLISGSLDRTIKVWNWRTGECISTYTGHHGGVICLHFDATTLASGSMDNTVKIWNFHDKSTRILRGHADWINSVKIDSLSRTVFTASDDLTVRLWDLDTGNCIHTYAGHVGQVQQVVLLPREFEFEEHDGDDTRSITSTGTSTELEHEHHHHDHNDPEETSLSAPFSLPMSPAFDALFAKDRPAPPRYMVTAALDSTLRLWEVPTGRCLRTFFGHIEGVWALGADTLRIVSGAQDHMTKVWCPRTGRCERTFTGHTGPVTCIGLSDSRLATGSEDSEVRMYSFRC

SEQ ID NO: 29755 - protein, 361 aa, Vitis vinifera
MKALILVGGFGTRLRPLTLSVPKPLVDFANKPMILHQIEALKAVGVSEVVLAINYQPEVMLNFLKEFEAKLGITITCSQETEPLGTAGPLALARDKLIDDSGEPFFVLNSDVISEYPFKEMIEFHKAHGGEASIMVTKVDEPSKYGVVVMEESIGRVDRFVEKPKLFVGNKINAGIYLLNPSVLDRIELRPTSIEKEVFPKIAAEKKLYAMVLPGFWMDIGQPRDYITGLRLYLDSLRKKSSSKLASGAHIVGNVLVDESAKIGEGCLIGPDVAIGPGCVVEAGVRLSRCTVMRGVRIKKHACISSSIIGWHSTVGQWARVENMTILGEDVHVCDEIYSNGGVVLPHKEIKSSILKPEIVM

SEQ ID NO: 29756 - protein, 474 aa, Lactococcus lactis
HHMAQANFGVVGMAVMGKNLALNVESRGYTVAIYNRTTSKTEEVFKEHQDKNLVFTKTLEEFVGSLEKPRRIMLMVQAGAATDATIKSLLPLLDIGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRILGLSNAEIQAIFEEWNEGELDSYLIEITKEVLKRKDDEGEGYIVDKILDKAGNKGTGKWTSESALDLGVPLPLITESVFARYISTYKDERVKASKVLSGPALDFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGTPIPTFTSAISYYDSYRSENLPANLIQAQRDYFGAHTYERTDKAGIFHYDWYTED

SEQ ID NO: 29757 - protein, 295 aa, Idiomarina loihiensis L2TR
MTINSLTAATREQVDSFLKQALAQLTLNPRLNQAMQHGVLMGGKRIRPYLLVTVADICGANKNDALQAAAAVELIHAYSLIHDDLPAMDDDDLRRGQPTCHIAYDEATAILAGDALQTLAFEVLTENRMEQLPSERQLQLVQVLAKASGARGMCAGQAIDLQATAKIVTEDALEQMHLSKTGALITAAATMGVLCGNDNAQQWREKFEQFAHYLGLAFQVQDDILDVTGNTEALGKPQGSDTASEKSTYVRLLGIEGAQQRLQNLHHKALQSLSDIPYNTDRLEQFSDLLLKRDH

SEQ ID NO: 29758 - protein, 618 aa, Idiomarina loihiensis L2TR
MTQQYPLLDKINSPADLRRLPRTQLPELCAEIRQFLLTSVSQSSGHLASGLGTVELTVALHYVYHTPEDKLVWDVGHQAYPHKILTGRKQRLHSIRQKDGLHPFPWREESEYDVLSVGHSSTSISAALGMAVAAQRQSLRQKVVSIIGDGAMTAGMAFEAMNHAGDIKPDMLVVLNDNDMSISENVGALNHHFARLLSGRFYTSLREGSKKLLSPLPHIRHFASRAEEHMKGMMAPGTIFEELGFNYIGPIDGHDVDTLVDTLSNMRSLGGPQLLHIVTQKGKGYRPAERDPIGYHGVPKFDPKESSLPEKAPGIPSYSEIFGQWLCDTASNDKSLMAITPAMREGSGMVTFSQQYPQQYFDVAIAEQHSVTYAAGLAISGLKPVVAIYSTFLQRGYDQLIHDVALQNLDVLFAIDRAGIVGADGPTHQGAFDLSYLRCIPNMVVMAPSNEQECLDMLTTGYQYKGPAAVRYPRGAGVGLELRKGKVIDIGKAQTLTEGQNIAFLNFGTLLPEVEAAAAKFNATVVDMRFIKPLDTACLDQLMTTHSVLVTVEENVIAGGAGGAVSEYVAQHKASPQVLTIGLPDEFIKHGSQGEVRAELGLDAAGIERQVNDFIKKS

SEQ ID NO: 29759 - protein, 261 aa, Haemophilus influenzae Rd KW20
MGITVMARIDNYEQRFGGIGRLYTPDSLARLRQAHICVIGIGGVGSWVVEALARSGIGELTLIDMDDICVTNINRQLPAMSGTIGKLKTEVMSERVKLINPECTVNIIDDFISPENQSDYLNRGYDYVIDAIDNVKTKASLIAYCKRNKINVITIGGAGGQTDPTQIQIADLSKTIQDPLLAKVRSVLRKDYNFSQNPKRKFSIDAVFSTQPLIFPQMTEGCSTSATMNCANGFGAATMITATFGFFAVSRVIDKLLKKKS

SEQ ID NO: 29760 - protein, 203 aa, Orpinomyces sp. PC-2
MNFSIKSVIFLAIVALATLVSASTNPKVTNKVYFDIKQGDKDLGRIVLGLYGEVVPKTVENFRALATGEKGYGYKNSKFHRVIKDFMIQGGDFTRGDGTGGKSIYGERFADENFKLRHTGPGILSMANAGRDTNGSQFFITTVTTSWLDGRHVVFGKVIEGMDVVTAIETTKTLPGDRPATPVIIADCGELPVSNNNDAKAEL

SEQ ID NO: 29761 - protein, 490 aa, Oryza sativa
MAGRKENPVLTACQAPSGRITRAQAAANRGRFGFAPSVSLPARTERKQTAKGKTKRGALDEITSASTATSAPQPKRRTVLKDVTNIGCANSSKNCTTTSKLQQKSKPTQRVKQIPSKKQCAMKVPKLPPPAVAGTSFVIDSKSSEETQKVELLAKAEEPTNLFENEGLLSLQNIERDRDSNCHEAFFEARNAMDKHELADSKPGDSSGLGFIDIDNDNGNPQMCASYASEIYTNLMASELIRRPRSNYMEVLQRDITKGMRGILIDWLVEVSEEYKLVPDTLYLTINLIDRFLSQHYIERQKLQLLGITSMLIASKYEEICAPRAEEFCFITDNTYTKAEVLKMEGLVLNDMGFHLSVPTTKTFLRRFLRAAQASRNVPSITLGYLANYLAELTLIDYSFLKFLPSVVAASAVFLARWTLDQSDIPWNHTLEHYTSYKSSDIQICVCALRELQHNTSNCPLNAIREKYRQQKFECVANLTSPELGQSLFS

SEQ ID NO: 29762 - protein, 269 aa, Zea mays
MGLCSSSTAARAASDPGAAAAGDAAAAKKGRGIVACGKRTDFGYDKDFEVRYSLGKLLGHGQFGYTFAAVDRASTERVAVKRIDKNKMVLPVAVEDVKREVKILKALQGHENVVHFYNAFEDDNYVYIVMELCEGGELLDRILAKKDSRYSEKDAAVVVRQMLKVAAECHLHGLVHRDMKPENFLFKSKKEDSPLKATDFGLSDFIKPGRQFRDIVGSAYYVAPEVLKRRSGPESDVWSIGVITYILLCGRRPFWDKTEDGIFKEHMIG

SEQ ID NO: 29763 - protein, 298 aa, Dechloromonas aromatica RCB
MWEYSDKVREHFFNPRNSGPLEEANGIGDVGSIQCGDALRLMLKVEPETEIILDAHFQTFGCGSAIASSSALTEMVKGMTLDQALEVSNQNIADYLDGLPPEKMHCSVMGREALQAAIANYRGEEWSDDHEEGALICKCFAIDAVMIEDVVKANNLNTVEEVTFYTKAGGGCAACHEGIEEILAQVKAERAGPGEVSPPPACPATPEAPKPPTKKLSIVEKIAKIQEVLESVRPMLLRDHGDVELADVQGKKIYVHLKGACSGCMMEAATLGGIQQKMIETLGELVQVLPSSHMPVEA

SEQ ID NO: 29764 - protein, 444 aa, Roseovarius nubinhibens ISM
MSPSPLTPGVTAARLAPDEYAENFTDLHAPLDPHEAVVAADRCYFCHDAPCMTACPTSIDIPLFIRQIATGTPEAAAETILDQNILGGMCARVCPTETLCEEVCVREVAEGKPVEIGRLQRYATDTVMARNIHPFTRAEATGRRVAVVGAGPAGLACAHRLALHGHEVTLYDARPKPGGLNEYGIAAYKSTDNFAAREVDWLLQIGGITLETGQRLGDGLSLDSLRAGFDAVFLGIGLGGVNALGLEGEDRDGLRDAVDFIAELRQSSDLTGLPIGRDVVVIGGGMTAVDAAVQAKLLGALNVTLVYRRGRDRMNASRYEQDLAASKGVRIVTNAQPVAIHGNGAVREIEFAYTDDALTPTGDTLRLPADQVFKAIGQTLTGDGLPVLEGRKIAVTGPGRTSVKGVWAGGDCASGGDDLTVTAVAEGRDAAEDIHAALTGAKEA

SEQ ID NO: 29765 - protein, 175 aa, Oryza sativa Japonica Group
MAPSVMASSATSVAPFQGLKSTAGLPVNRRSSSSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 29766 - protein, 506 aa, Lolium rigidum
MNDDLVYVCSALAVSILAIAVVQLLKARQRLPPGPLNLPVIGSAHRLVNALPHRAMRDLAGVHGPLMYLRVGQVPLVVVTSKEVAREVLKTHDAIFATRPKLMAGDIVAYGSTDLLFCSTPGDYFRKLRRLCVQEILSNDRIRSYQDIREDEVRSLVEDIRAAGPSAPVDLSRKIYKLTNGIVSRAAFGMKSSKAEDFVAAIKHSFVYSTGFSIADLFPGFTGILSFLTGQRRTLEGVRDTIDGILEEIINEREQILKSGRSTASEKNLVEVLLGLQGNEDFGFPITRSTVKAVILDIFAGGTETSGTSMEWAMSELMANPKVMGKLQGEIRAAFGDKEFISEADLRASGGVMKYLGLVIKETFRLHPPAPILVPRESTEACEINGYVIPAKTRVVINSWAIMRDPRYWEDAEEFRPERFEGGRMDFLGGNFEYTPFGSGRRMCPGYNYGMASMELTLVQLLHSFDWSLPDGVDQLDMTEIVSLSLTRKTHLMLRAAPHRAPLPSS

SEQ ID NO: 29767 - protein, 470 aa, Aspergillus oryzae
MRATEVLYYMLRPSQLRSIVQWKVWHNPVHERNVNNETETQKACFKFLDLTSRSFSAVIKELHPELLLPVCVFYLVLRGLDTIEDDTSIPLKTKEPMLREFKDYLEQDGWTFDGNRPEEKDRELLVQFHNVITEFKNMKPAYREIVKDITDKMGNGMADYCRKAEFEDASVKTIEEYDLYCYYVAGLVGEGLTRLFVEAEFGNPALLSRPRLHKSMGLFLQKTNIIRDVREDHDDDRHFWPKEIWSKYVTEFEDLFKPENRETALNCGSEMVLNALEHAEECLFYLAGLREQSVFNFCAIPQAMAIATLELCFRNPDMFDRNIKITKGEACQLMMESTQNLHVLCDTFRRYARRIHKKNTPKDPNFLKISIVCGKIEKFIDTIFPQQTAAQAKLKVQGEKSEAEKEKARQEAETRQDLYFMLALMGVIVLIVSIIMLTAAWLLGARFDLAFQELKSGNFRPPAKQIPGEL

SEQ ID NO: 29768 - protein, 384 aa, Thlaspi japonicum
MASSPTKILCDAGESDLCRDDAAAFLLKFVAIASILLAGVAGVAIPLIGKNRRFLQTEGNLFVAAKAFAAGVILATGFVHMLAGGTEALTNPCLPDYPWSKFPFPGFFAMVAALITLIVDFMGTQYYESKQQRNEVAGGGEAADVVEPGREETSSVVPVVVERGNDDSKVFGEEDGGGMHIVGIRAHAAHHRHSHSNGHGTCDGHAHGQSHGHVHVHGSHDVENGARHVVVSQILELGIVSHSIIIGLSLGVSQSPCTIRPLIAALSFHQFFEGFALGGCISQAQFKNKSAIIMACFFALTTPIGIGIGTAVASSFNSHSPGALVTEGILDSLSAGILVYMALVDLIAADFLSKRMSCNLRLQVVSYVMLFLGAGLMSALAIWA

SEQ ID NO: 29769 - protein, 513 aa, Lolium rigidum
MVMEMEPSSATLFFLSVVTLVILVSLVSRKPSSKLRRPPGPRDLPFVGSLHHLLTSQPHVALRNLAKTHGPVMRLRLGQVEAVVVSSSAAAQEVLRDNDLSFASRPNLLATEIMCYGNLDVAFAPYGAYWRALKKLCVLELLSSRKVRQFKPVRDSETMSLIKEICAAGKGGKPVKLRSLLVKCTSSVTGKATFGERCDIDLREQFMAAMEVAQIHSSGFCVGDLFPSLGFLDVATGMRYQLWRARQQLDNVVDKIISDCEARREEKKSTPTGDEDLLSLMLRIRDEGGSDFPIETINIKAIIVDLFTAGTETTSSTAEFVMSELMRNPKVMKKAQEEVWRMMENKSPQDHENHMDELPYLRMVIKETMRLHPVVPLLLPRLCRESCHVGGFEITKGTRVIINAWALATSPENWNEPEEFRPERFEDSVVVNDKGTQFKLMPFGGGRRMCPGDGFALATLELMVARLLYYFEWSLPDGMRPDELDMDVKVGTTSRRRNELRVVASPCRIPIEI

SEQ ID NO: 29770 - protein, 371 aa, Acidobacteria bacterium Ellin345
MKKSKANFYPVILAGGRGTRFWPLSRKRMAKQLLPLNSDKSMIQETVERLSALAEKKNFWVVTNDDLLVPIAKQLRALPIKQLIAEPVGRNTAPAIGLAAFILERLDPSAVLGLFPSDHVTSKPEAFKKDIAKAVQIAAAGENIVVLGIKPTRPETGYGYIEVGEQYERGVMRVRRFTEKPNAEKAAEFVESGHYFWNSGVFVWGAKTLANALREHLRETAPFLEKIAASYGTKEFAKTFAKLYPKCENISVDYAVLEPRSAKGEKSSNIFCIPADWGWNDLGSWAALFEHRAAEQQLSEHENVLTSKGAFTHDAGGNFVHSPRKFIAVVGVKDLVVVETDDALLITTRQKSQDVGKVVKFLDEKKLKNLV

SEQ ID NO: 29771 - protein, 418 aa, Aeropyrum pernix K1
MQPTDPLEEARAQLRRAVDLLGYDDYVYEVLANPDRVLQVRVTIKMDDGTVKTFLGWRSQHNSALGPYKGGVRYHPNVTMNEVIALSMWMTWKNSLAGLPYGGGKGGVRVNPKILSPRELELLSRKYFESISDIVGVDQDIPAPDVYTDPQVMSWFLDEYNRVKRGQFFGVVTGKPVELGGLNARIVSTGYGVAVSTRVAAEKFLGGLEGRTVAVQGYGNVGYYAAKFLAEMGAKIVAVSDSRGGIYDPEGIDPEEALKVKRSTGTVANYQRGKKISTMEILELPVDILVPAAIEEVITDENADRIKAKIISEGANGPTTTAAEKILVKKGVLVLPDILANAGGVIMSHIEWVNNRMGGWITDEEALKKLEQKMVENTKTVITYWEKNLKPEENSLRDAAYMIAVERVFRAMKLRGWI

SEQ ID NO: 29772 - protein, 613 aa, Oryza sativa Japonica Group
MSGPLDRFARPCFEGFTHNDEKKEIRSDADNSEGEKKTKIGSFKKKAINAGNKFRHSLRRRSKKKNEPRGSIEDIRDVQDLQAVDAFRQCLVDEDLLPQQHDDYHTMLRFLKARKFDVEKAKSMWSDMLKWRKEFGADNIEEFDYTEADEVMKYYPQFYHGVDKEGRPIYIELIGKVDANKLMQVTTIERYVKYHVKEFERCFQMRFPACSIAAKRPIDSSTTILDVQGVGLKNFSKAARDLITRLQKIDNDNYPETLRRMYIINAGQGFKMLWSTVKSFLDPKTASKIHVLGSKYQNKLLEIIDENELPEFFGGKCKCEAFGGCKKSDKGPWKDPNIIKRVLNGEANYGRQIVTISSTDGKIIRYAGPQYPTRKGSDGSAESGSEVEDGASPMASRNLITNPLLTPVHEESKLAAHGFTSASPSIIEESIPVVDKVVDDGWGSPRASSSPSRSLPITFDGLWTQVITWLTVLIVSLFAMVRSVPSRMAKRFSSQSTDHDHSYVEYPQEAEYKEEFRPPSPAPSYTEKDVLSSMVRRLGELEEKVQALETKPSEMPFEKEELLNAAVRRVDALEAELISTKKALYEALMRQDELLAYIDKQDMIKFRKKKFCF

SEQ ID NO: 29773 - protein, 498 aa, Lolium rigidum
PLFLLGSLALAVSLLVLLGHGRGKTRLPPGPPALLFLAKFVALRRSIFDLGPLIVDLHARHGPVISIHLFRTLIFVADRKMAHRALVQGGATFAERPPPVDPTRLFTSGGRDISSSPYGTYWRLLRRNLAAEALSPARVAHFAAARRSACDGLVSSLLREQERQGQEEAVTLRPFLRRAMFELLVFMCFGARLEREAMDEVEELQHQVLVAFTSFPVFAFFPAVTKRLFRRRWAEYLAVRRRHEEVFVPLIHAERAGGDPPCYAESLLAVRMADDVRLTDAEMVSLCSEFLNGGTDTTVTLLEWIMAELVNHPDVQAKVYEEVRANPELNDLQGMGMPYLKAVVMEGLRLHPPGHFLLPHGVQHSGDGGVEIGGYMVPKGAEVNFLVAEIGRDETVWTAAREFRPERFLEGAEGHGVDITGSREIKMMPFGAGRRMCPGYSLGMHHAEYFVARMVMDVEWRPPVEGEEVDMAETLDFTTVIKHPLRARLFARTNSHNA

SEQ ID NO: 29774 - protein, 65 aa, Zea mays
  misc_feature (18)..(18): Xaa can be any naturally occurring amino acid
QGGEEGVAVTITWVKARXIFDSRGNPTVEVDVGLSDCSYARGAVPSVSFTGIYEALELRDAGSFF

SEQ ID NO: 29775 - protein, 338 aa, Bacillus cereus G9241
MAILITGGAGYIGSHTCIELLNNNYKIIVVDNLSNSSIESLNRVKEITGKQFEFYKEDVLNREKMNEIFLENNIEAVIHFAGFKAVGESTTIPLTYYYNNIISTIVLCDVMQKHNVKNFIFSSSATVYGIPKTSPITEEFPLSVTNPYGQTKLMIEQIMRDVAKADDEWSIALLRYFNPFGAHQSGRIGEDPNGIPNNLMPYVTQVAVGKLKELNIFGNDYPTKDGTGVRDYIHVVDLAKGHVKALEKVLKTKGIEAYNLGTGKGYSVLEMVKAFEKVSGKKIPYKVIGRRPGDVAICFADVSKAKRELGWEAEYGLEEMCVDSWRWQVNNKNGYQMI

SEQ ID NO: 29776 - protein, 403 aa, Prochlorococcus marinus str. NATL1A
MAKVCVIGLGYIGLPTAVVLAKAGHSTLGIDIDPHVVKNVNNGVTHFREPNLNSSLISVVSNGMLRASEKIKDADIFIIAVPTPFRKTNNKNPVPNLDYVISAINSILPFIRKGNSIVIESTCPIGTTAKVKNIIIENTKLKENDFNLAYCPERVIPGNIMVELINNDRVIGSHNNQSKEKIINFYKTFCKGNILSTTAETAEMVKLTENSFRDVNIAFANELSIISDHINIDVIELIKLANFHPRVNILKPGCGVGGHCIAVDPWFIASEVPEKSQLIQTARKINDYKPQWVIEKITKKARELKSTLRKDPIIGCLGITFKPNVDDLRESPALKIVQGLDKTQLKLIVADPNIKSHNELSISPLNNLINNSDLYVFLVAHNEFKYISLKNREYLDFCGVINK

SEQ ID NO: 29777 - protein, 232 aa, Glycine max
MASSQNVASIEPWMLRPPVTDSWLAEFFARDADTLTRALQKSLSGAVLPQDNHLSPFLHQPAAAAATPTVSSLSGSDQESAPRRRAAPPPSGKISKRKSRASKRSQTTFITADPANFRQMVQQVTGVRFGGAPIAPAAVVKPEPQRASGLARFPAGVGCLPTLDTSAFLLDHHQQQVVPASVNSGPGTGLSGPGPLPFAQPLLDAHAASFASSGLDFDTFSNFPTLESWKVM

SEQ ID NO: 29778 - protein, 497 aa, Silicibacter pomeroyi DSS-3
MTLSHAEYRSIAATLEPNGMAFIDGAFCAAADGDSFETINPATGEILARVAHCKAADVDRAVAAARRVFNDGTWSRAEPEARKEVLLKVADLVRKHSDELAVLESLDTGKTITDCLAEIGGEVPKFFQWYAELADKTFGKIAPTSPGALALITREPAGIAGAVLPWNFPLVMAAWKIAPALAVGCSAVIKPAEQTPLSTIRLAELMQEAGVPAGVVNIVPGFGETAGKAIGLHNDIDTVSFTGSTEVGRMFMRYSGESNLKGVGLEMGGKSPFIVLDDAVIDDALIEHAAMSAFWNGGQNCSANMRQLIATPLVEEFTARIIARVKSFRLGDPLDPATDIGSMITKDHKDMVLSYIQSGVEEGAQKVIGGNSDLPGFFIEPTVFRNLSPEMKIAREEIFGPVLGIMPVASPQEALAIASDTEYGLHATVFTRDIDRALHIARSLPCGTVSINGFSEGDIKTPFGGYKQSGSMARDNGTEALEQYLQTKTIWIETQAG

SEQ ID NO: 29779 - protein, 529 aa, Mycobacterium tuberculosis H37Rv
MLQSTLDPNASAYDEAAATMSGKLDEINAELAKALAGGGPKYVDRHHARGNLTPRERIELLVDPDSPFLELSPLAAYGSNFQIGASLVTGIGAVCGVECMIVANDPTVKGGTSNPWTLRKILRANQIAFENRLPVISLVESGGADLPTQKEIFIPGGQMFRDLTRLSAAGIPTIALVFGNSTAGGAYVPGMSDHVVMIKERSKVFLAGPPLVKMATGEESDDESLGGAEMHARISGLADYFALDELDAIRIGRRIVARLNWIKQGPAPAPVTEPLFDAEELIGIVPPDLRIPFDPREVIARIVDGSEFDEFKPLYGSSLVTGWARLHGYPLGILANARGVLFSEESQKATQFIQLANRADTPLLFLHNTTGYMVGKDYEEGGMIKHGSMMINAVSNSTVPHISLLIGASYGAGHYGMCGRAYDPRFLFAWPSAKSAVMGGAQLSGVLSIVARAAAEARGQQVDEAADAAMRAAVEGQIEAESLPLVLSGMLYDDGVIDPRDTRTVLGMCLSAIANGPIKGTSNFGVFRM

SEQ ID NO: 29780 - protein, 155 aa, Candida glabrata CBS 138
MSQKACYVCGKIGHLADDCDSERLCYNCNQPGHVQSECTMPRTVEHKQCYNCGETGHVKSECSIQRCFNCNQTGHVSRECPEPRKGRFGAASKNVSCYKCGGPNHVARDCMQTDTKCYSCGRFGHVSRDCPNGPNEKVCYNCNETGHISRDCPVL

SEQ ID NO: 29781 - protein, 154 aa, Idiomarina loihiensis L2TR
MQVIEGGINAAGKKFAIIVSRFNHFMVESLLDGAVQTLKHYGEVADDDITVVRVPGAYEMPVTAKRLASSGKYDAIIAVGAVIRGGTPHFEFVAGECNSGLGRVATEFDLPVAFGVITTDTLEQAIERSGSKAGNKGSEAALSALEMVNVLKQL

SEQ ID NO: 29782 - protein, 501 aa, Brucella suis 1330
MRSMKHTGSAGSSSIDAGSPDIRGARLPAGDYAHVFDDLHPPLSPHEAIVESDRCYFCYDAPCMNACPTGIDIPLFIRQINAGNPAGAARTILAENILGGMCARVCPTETLCEEVCVREVAEGKPVKIGHLQRYATDMLMATGNHPFTRAAETGRHIAVVGAGPAGISAAHRLAMHGHQVTIFEARPKGGGLNEYGIAAYKTVNNFAQRELDFVLQIGGIHIEYNQTLGQDITVEALKAGYDAVFLAMGLPGVNDLGLAGEDAPNVLDAVDYIANLRQARNLSTLPVGRDIVVIGGGMTAIDVAIQTKKLGANNVTIVYRRGQESMNASAYEQELAQIHGVVIRHWLQPHALERSEDGIVHAITFEYTANRDGKLVGTGEYLTLEADQVFKAIGQTFDPEPLRGSGIALAKGRISVDAEGRTSVEGIWAGGDCVAGGKDLTVASVEDGKVAALSIHAALTSRPEAVEGFAEAVLSGAAHYAPAAPSRHATVQPGSEQGLGD

SEQ ID NO: 29783 - protein, 549 aa, Brucella suis 1330
MARDATKLEATVAKLKKHWAESAPRDMRAAFSADPGRFGRYSLCLDDLLFDWSKCRVNDETMALLKELAVAADVEGRRAAMFAGEHINNTEDRAVLHVALRDTSSKEVLVDGHNVLPDVKHVLDRMAAFADGIRSGALKGATGRKITDIVNIGIGGSDLGPVMATLALAPYHDGPRAHFVSNIDGAHIADTLSPLDPASTLIIVASKTFTTIETMTNAQTARKWVADTLGEAAVGAHFAAVSTALDKVAAFGIPEDRVFGFWDWVGGRYSVWSAIGLPVMIAVGPDNFRKFLAGAHAMDVHFRDAPLEKNLPVMLGLIGYWHRAICGYGSRAIIPYDQRLSRLPAYLQQLDMESNGKSVTLDGKPVSGPTGPVVWGEPGTNGQHAFFQLLHQGTDTIPLEFIVAAKGHEPTLDHQHEMLMANCLAQSEALMKGRTLDEARAQLQAKNLPASQVERIAPHRVFSGNRPSLTLIHDMLDPYALGRLIALYEHRVFVEAQIFGINAFDQWGVELGKELATELLPVVSGKEGASGRDASTQGLVAHLHARRKA

SEQ ID NO: 29784 - protein, 185 aa, Haemophilus influenzae Rd KW20
MKFNIPIFLTIFRVILIPFFVIAFYLPIESSPFITTLIFFIAGVTDWLDGYLARKWKQTTRFGAFLDPVADKVMVVAALVLIVEHQHTFWITIPAIIMISREIIISALREWMAELGERSKIAVSWWGKWKTTAQMLALGGLLWRYNNYMEIAAIILLYIAAILTIWSMIQYLQVAKGSLLDNIQL

SEQ ID NO: 29785 - protein, 176 aa, Haemophilus influenzae Rd KW20
MADFNQILTPGDVDAGIINVVNEIPEGSCHKIEWNRKVAAFQLDRVEPAIFAKPTNYGFIPQTLDEDGDELDVLLITRQPLATGVFLEAKVIGVMKFVDDGEVDDKIVCVPADDRDTGNAYNSLADLPANLIKQIEFHFNNYKALKKPGSTKVTHWGDVEEAKEVIRESIKRWNER

SEQ ID NO: 29786 - protein, 273 aa, Vitis vinifera
MASILESAWQYLITHFSDFQLACLGSFFLHESVFFLSGLPFIYLERLGYLSKYKIQTKNNTPAAQNKCITRLLLYHFGVNLPVMIFSYPVFRYMGMQSSLPLPSWKVILTQILFYFILEDFVFYWGHRILHTKWLYKHVHSIHHEYATPFGLTSEYAHPAEILFLGFATILGPAITGPHLFTLWLWMVVRVLETVEAHCGYHFPFSLSNFIPLYGGANFHDYHHRVLYTKSGNYSSTFVYMDWIFGTDKGYRKLQALKRYEAEASNNQTSREK

SEQ ID NO: 29787 - protein, 406 aa, Coprinopsis cinerea okayama7#130
MGLFNRKKPNAADDDASESKKEKGGWRRPANTAFKQQRLKAWQPILTPKTVLPTLFIIGIIFAPVGGLLIWASSKINEMTFDYTDCDQLSPATSIDDASFTTMPSNKYNYRLSAENEKLPKPSAPRYAFINNTGTSDVDVSEELQCVVEFDIPADLQPSVFFYYKLTNFYQNHRRYVKSLNTDQLKGKFVSAKDLDNGDCKPLATIDGKPIFPCGLIANSLFNDTFGSPILVNPGNSDEPERPYEMTSKGIVWPGEAKKYATSPIGPDGYDSPSDIVPPPNWARRFPDGYTEDNIPDLRNDEHFQNWMRTAGLPTFTKLYSRNDQDTMLKGTYRVVIGMNFPVRPYKGTKSFVISTVSAIGGKNPFLGWAYVAAAGVFVLLAVLGLARHLIKPRRLGDMSLLSWNR

SEQ ID NO: 29788 - protein, 259 aa, Arabidopsis thaliana
  misc_feature (90)..(90): Xaa can be any naturally occurring amino acid
  misc_feature (104)..(104): Xaa can be any naturally occurring amino acid
MSSMSRSRSRSRSRSRDRFRSRSPRDRRMRSERVSYHDAPSRREREPRRAFSQGNLCNNCKRPGHFARDCSNVSVCNNCGLPGHIAAECXTAESRCWNCREPGXHVASNCSNEGICHSCGKSGHRARDCSNSDSRAGDLRLCNNCFKQGHLAADCTNDKACKNCRTSGHIARDCRNDPVCNICSISGHVARHCPKGDSNYSDRGSRVRDGGMQRGGLSRMSRDREGVSAMIICHNCGGRGHRAYECPSARVADRGFRRY

SEQ ID NO: 29789 - protein, 213 aa, Haemophilus influenzae Rd KW20
MSNPSCIIIAITGASASGKSSIASTVHKELCNELGCQEIGIITEDSYYKDQSHLEMTERVKTNYDHPNSMDRDLLIQHLKNLKNGSAVDVPVYSYVEHTRTNETTHFTPKRIVILEGILLLTDERVRQLADISVFVDTPLDICFIRRLQRDMEERGRSLQSVIDQYRATVRPMFLQFIEPSKQYADIVIPRGGKNRIAINMLKAQILHLLNQK

SEQ ID NO: 29790 - protein, 156 aa, Zea mays
MMSRERKKAAALQEKLKILRSITHSHALSNTSIIMDASAYIKELKQKVVRLNQEIACAQDALRHKASSYPTAGSSFLVNVFSDKSCPGLLVAVLEAFDELGLSVLQATASCADSFRLEAVGGENVADNVDEHVVKQAVLQAVRSCSEGGSEHDDEE

SEQ ID NO: 29791 - protein, 206 aa, Thiobacillus denitrificans ATCC 25259
MIRSQPVAARGYNARLSVFPTETPMSLDRVSSGRNLPDDFNVIVEIPAHGEPIKYEVDKESGAMFVDRFMSTAMHYPCNYGYIPHTLSEDGDPVDVLVITPIPLITGVVVRCRPIGMLKMTDEAGVDAKLLAVPVEKLCGLYKGVNRPEDLQPLLLKQIAHFFEHYKDLEDGKWVKVEGWTGVDDARAEILAGVERYRNAADKPAF

SEQ ID NO: 29792 - protein, 342 aa, Synechococcus sp. WH 7803
MVNSSPQVLCVGEALVDRLGPLGGDPATAAPGECDDRLGGAPANVACALARLGTSVAFIGRLGRDAIGDSFLELLNDRGVDLRGLQHDDERPTRVVLVRRDASGERVFQGFAGDRGAGFADQSLDQAALDPHWPALAERARWLLIGTIPLASAPSAAALRSLLAQAERDGVRVALDVNWRPTFWDAGADPAAGPDAQALALMQPLVQQADLLKLAREEAEWLFHTSTPDQISAALPRRPDVVVTDGGDPVRWCIAGHCGAMPVLAPPQVVDTTGAGDAFTAGLLHQLVSLAPLEGQPQTLDAAGVQAVVRYAAACGALVCAGAGGIDPQPLPSRVLGFLEQV

SEQ ID NO: 29793 - protein, 104 aa, Zea mays
MAEREHRTVFVTVGTTCFDALVMAVDSPEVKKALLQKGYSNLLIQMGRGTYVPSKVSGDATLQVDHFTFSPSIADNMRTASLVISHAGSGSIFETLRLGKPAYR

SEQ ID NO: 29794 - protein, 1483 aa, Aspergillus oryzae
MASHKKSEDPLVVKDRQEQECESSDSTIASENASEHRSPMGLIDEDGIETLNRIASQSSRRRSSVYPPNVPTRTSTLATISENDPAVDPQGPSFDLNKWLKMVLRESERQGREAHRTGIVFKNFTVSGTGAALQLQDTVSSMLSAPFRIGEMMKNRHSPPKRILNEFNGLLKSGELLLVLGRPGSGCSTFLKSLCGELHGLSMSKESVIHYDGVPQQRMIKEFKGEVVYNQEVDKHFPHLTVGQTLEFAALARTPAQRIRDMSREEFAKHITQVVMAVFGLSHTYNTKVGNDFVRGVSGGERKRVSIAEMALAHSPLAAWDNSTRGLDSATALKFVEALRLFADLSGSAHAVAIYQASQSIYDIFNKVVVLYEGRQIYYGPAKDAKSYFERQGWECPQRQTTGDFLTSVTNPSERKARPGMENQVPRTAEDFEAYWRKSPEYQKLMSEISHYEQEHPLEEEGDALATFQQKKREIQAKHTRPQSPYLLSVPMQIKLNTKRAYQRVWNDISSTVSTVISQIIMALIIGSVFYGTPDATAGFTAKGATLFFAVLLNALIAMNEINSLYSQRPIVEKHNSYAFYHPATEAIAGVVSDIPVKFVIAVVFNLILYFLAGLHRSAGQFFLYLLVTFIVMFVMSAVFRTMAAITQTVSQAMGLAGILILALIVYTGFVLPVPSMHPWFEWIHYLNPIYYAFEMLIANEFHGRDFICSQFIPAYPNLSGNSFVCSSAGAKAGQRAISGDDYIQVNYQYSYGHVWRNFGILIAFLVGFMMIYFIATELNSSTSSTAEVLVFRRGHEPAYLRTDSKKPDAESAVELSAMKPTTESGEGDMSIIPPQKDIFTWRDVCYDIEIKGEPRRLLDHVSGWVKPGTLTALMGVSGAGKTTLLDVLAHRTSMGVITGDMFVNGRGLDQSFQRSTGYVQQQDLHLETATVRESLRFSALLRQPPNVSIQEKYDYVEDVIRMLKMEDFAEAVVGVPGQGLNVEQRKLLTIGVELAAKPKLLLFLDEPTSGLDSQSSWAICAFLRRLADSGQAVLCTIHQPSAILFQQFDQLLFLARGGKTVYFGPIGQNSNTLLNYFESNGARKCADDENPAEWMLEIVNAGTNSEGENWFDVWKRSSECQGVQTEIDRIHREQQSKTQASDKDNESWSKSEFAMPFWFQLYQVTYRVFQQYWRMPEYIASKWVLGILSGLFIGFSFFQAKSSLQGMQTIVYSLFMLCSIFSSLVQQVMPLFVTQRSLYEVRERPSKTYSWKAFLIANIIVEIPYQIMMGILTYACYYYAVVGVQDSERQGLVLLLCIQFFIYASTFAHMAIAAMPDTETASAIVVLLFAMSLTFCGVMQTPTALPGFWIFMYRVSPFTYWVSAMAATQLHDRVVQCSPSEMSIFDPPSGQTCGEYMSSFMSMAGGQLSNPNATSDCNYCSVAVADDFLSSVNIYWSERWRNFGLMWVYIVFNIFLATMLYYTFRVKKWNLSGLKERFSKKK

SEQ ID NO: 29795 - protein, 315 aa, Synechococcus sp. WH 7803
MDCLCLGLLCADLVCHPVPSLPEQGQLMETERMELSLGGCAANTAFDLARLGVSTGISGCVGDDVLADFIVATLNAAGVDTRGVVRSAAVATASTAVINVRDQDRRFISYAGANTAMSAAAIPEGLLESASVLYIGGFLMLDGLESDAMLQRLARAREAGTRILLDVVQVDDADAMERLQRFLPYTDVFLPNNDEAAVLTGVSDPWEQADAFRAAGARTVVITEGDRGAHLVNAQMKLRVGAYDTDYQGGTGAGDAFDAGFIAALLQGHDLPTCLRWGSALGASCVRSTSATGSVFNRDEALQFMERHAITVERC

SEQ ID NO: 29796 - protein, 394 aa, Prochlorococcus marinus str. MIT 9313
MATTQTLPQVDQSHKTVLEPIATPSRLLFGPGPSNADPKVLQALARSPIGHLDPLYLELMGEVQELLRYTWQTDNRFTLPMSGTGSAAMEATLANTVEPGDTVLVAVNGYFGNRLADMAARYRANVQLIEKPWGEAFSLAELEAALSEHRPAILALVHAETSTGVCQPMDGVGDLCHKHDCLLLLDTVTSLGAVPVFLDQWKVDLSYSCSQKGLSCPPGLGPFTMGPRAEEKLVARSSKVPNWYLDVSLLNQYWGSDRVYHHTAPVNMNFGMREALRLLADEGLENAWDRHRCNAEVLWAGLESLGLELHVPEALRLPTLTTVCIPNGVDGNAFRLHLLNEHGIEIGGGLGSLAGKIWRIGLMGYNSTPKNVELLLNLFESELPRFRENVAVAA

SEQ ID NO: 29797 - protein, 473 aa, Prochlorococcus marinus str. MIT 9313
MGKSPQDVLRQIKDEGIELIDLKFTDLHGKWQHLTVCSDLIDEEAFANGLAFDGSSIRGWKAINESDMDMVPDASTAWIDPFYRHKTLSLICSIREPRSGEPYARCPRALAQKALGYLAGTGLADTAFFGPEPEFFIFDDVRYNSGEGGCFYSVDTIEAPWNSGRIEEGGNLAYKIQLKEGYFPVPPNDTAQDIRSEMLLLMGQLGIPMEKHHHEVAGAGQHELGMKFAELIEAADNVMIYKYIVRNVARKYGKTATFMPKPVFNDNGTGMHVHQSLFKGGQPLFFGEGTYANLSQTARWYIGGILKHAPSFLAFTNPTTNSYKRLVPGFEAPVNLVYSQGNRSAAVRIPLTGPNPKAKRLEFRPGDALANPYLAFSAMMMAGVDGIKNQIDPGDGFDEDLFELPEERLASIPTVPASLNGALEALNADKNYLMEGGVFTEDFIDNWIDIKYEEVQQLRQRPHPHEFTMYYDA

SEQ ID NO: 29798 - protein, 338 aa, Vibrio vulnificus CMCP6
MKVLVTGGCGYIGSHACVALVRAGHQPIVLDNFSNSHPNVVARIETLIGQPLVVYQGDIRDRLVLDAIFDQHEIGAVMHFAGLKAVGESVEKPLEYYDNNLAGTLNLLAAMRVAHVYRLIFSSSATVYGDPKTVPITEAAPTGATTNPYGTSKHMVERCLSDFSAANPDWSITLLRYFNPIGAHPSGLIGEDPSGIPNNLMPFITQVAIGRRERLSIFGDDYPTADGTGVRDYIHVQDLVEGHVAALEKRGNVRGLHTYNLGTGNGVSVLQMVAAMNRVLGRELPVRIEPRRAGDIAQCFAQADKAAQELGWKAQHDLTDMVEHSWHWQQRNPNGYQS

SEQ ID NO: 29799 - protein, 453 aa, Bacillus cereus G9241
MIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGRLEDLKFKTPLYPLVPILGFGLYDIILISLIFIPEQRLGIYCTVPFIIFCYTYYHFKVKKRISTNTQSETKISETM

SEQ ID NO: 29800 - protein, 516 aa, Nostoc punctiforme PCC 73102
MTNSDLERVTVRPTDEYNQKLVSYVHPPNWVNPQPADVYDLVVIGAGTAGLVVAAGAAGLDLGLKVALIEKHLMGGDCLNVGCVPSKTIIRSARVVGEIWDAKDLGVNIPQHNIDVDFPKVMARMRRIRADISPNDSAERFQKLGVDVFLGSGRFASKNTVEVGGKTLRFKKAVIATGARAAQLSIPGIEKAGYLTNETVFSLIQRPERLAVIGGGPIGCELAQAFRRLGSEVVLFHSGSHLLNKEDAEAAEILQKVLIREGIRVVLNSKLEEVVTVTEGKRLYFSSNSHRDSVTVDEILVGAGRSPNVENLNLEAVGVEYDKHQGVKVNDYLQTTNPKIYAAGDICMNWKFTHAADAAARIVIKNTLFSPFGIGRSKLSSLVMPWVTYTDPEIAHVGMYEHEAQKLGIEVTTIKIPFSSVDRAIADGEESGFLKIHHKKGSDEIIGATIVSSHAGEMISEVTTAMVNKLGLSKLSSVIHPYPTQAEAIKKAADAYRRTLLTSNTKKLLGFLTKLS

SEQ ID NO: 29801 - protein, 162 aa, Ashbya gossypii ATCC 10895
MSKVFFDVEADGQPLGRIVFQLYNDVTPKTAENFRALCTGEKGFGYAGCPFHRVIPDFMLQGGDFTHGTGVGGKSIYGGKFPDENFVKKHEKPGLLSMANAGPNTNGSQFFITTVPCPWLNGKHVVFGEVSEGMDVVKKVESMGSSSGATRARIVISKSGEL

SEQ ID NO: 29802 - protein, 541 aa, Vibrio vulnificus CMCP6
MRAVKHRQLSLLFPFLKWLPSVNAQSLQADFWAGLTGAIIVLPQGIAYAMIAGLPAEFGLYTAIIPAILASLFGSSHHLISGPTAALSVIVFTTVSQFAEPSTPLYIQLCFTLTLCAGVIQLLFGLLRFGAVVNFVSHSVVLGFTAGAAIVIGVSQLKHVLGLQYNSGETAIENLLLLGSHAVHFNAKELSVGMVTILVCIMCKRIWPKLPHMLLATLASMAFALWMNQAGYPVLMVSEVSSSSLSLSSPFAGLSHVEPMLGGIVAVAMLGLVEAISISRSVALKSRQSLDSNQEFVGQGLSNIVGSFFSCYVSSGSFTRSGVNYSSGAKTPLAAVFAALLLLVIMLLLAPYAAYIPIAGMGGLLLVVAWYLVDVHHITTIVKHDKKEAVVLVATCLAALFLHLELSIYVGVGASLFFYLRKTSRPAIERLSHDELNLEQQDDIAVIRINGSIFFGCVQYLHQEMQNVSAKHLIILGRGINFIDHLGVQMLDDYVSTSGRHVYFCRFKASAKASLLNGATSVREEHFSERLTPLLTLICKG

SEQ ID NO: 29803 - protein, 484 aa, Rhodococcus erythropolis
MQALTSSVPLVIGDQLTPSSTGATFDSINPADGSHLASVAEATAADVARAVEAAKAAARTWQRMRPAQRTRLMFRYAALIEEHKTELAQLQSRDMGKPIRESLGIDLPIMIETLEYFAGLVTKIEGRTTPAPGRFLNYTLREPIGVVGAITPWNFPAVQAVWKIAPALAMGNAIVLKPAQLAPLVPVALGELALEAGLPPGLVNVLPGRGSVAGNALVQHPSVGKVTFTGSTEVGQQIGRMAADRLITASLELGGKSALVAFGDSSPKAVAAVVFQAMYSNQGETCTAPSRLLVERPIYDEVVELVQARVEAARVGDPLDPDTEIGPLISAEQRESVHSYVVSGTEEGATLISGGDQSPTGAPEQGFYYRPTLFSGVTADMRIAREEIFGPVLSVLPFEGEEEAITLANDTVFGLAAGVFTRDVGRALRFAQTLDAGNVWINSWGVLNPASPYRGFGQSGYGSDLGQAAIESFTKEKSIWARLD

SEQ ID NO: 29804 - protein, 851 aa, Ashbya gossypii ATCC 10895
MTGPRIGLFPEKNNYETTHGSSGLISTNNTDKDEEEDAWRTGESDLHATGVESGSAAAERTSQVEMRILEDILMEDMVCGYEEFQERIKNDRFYLTKRYNTKVGLNELNTDADARRDDIDFLTYSQKVASEYSFRENAEKLLKSINKQPIRVLTGEELHENYARGEEELVPVRPGTFGLRHFFKSSVKGRMLRQPTESDLVNTNGGISASTQVIDLEKNGQRAIDESSNKSNIYESHRKELLPNGIHHPTSRGCLRNALIYLINNPLCESLRKPDRYHIQRKLKVRHLQMIAIGASIGVGLFLTSGNAFAVAGPFGTLLGFSICGTVCLATMLSFTELSTLIPISSGFSGLASRFVEDAFGFALGWSYWLSFTVTFPSQIIASVFMLSYYEKVVATRISTAGLVTVFWLYATAANLLDVRLFAEVNYISAFVKVLITILAMILMLFLNVRGVDGKSGAIGFRFWNSSSSETELTYGLFRPTFDLHDTGQGSLNGIGGARGRFLAIILVVLISTYSFNGVEMAFVASGEAINPRKTLPSATKRAFTKIVTLYILSITFVGLNMYSGDPRLLRYGVDVPTVVYRNTPGLQWQRDYSCMEQDIMQLHNMENGNRSPWILALQSFGLCSLASAFNGVLVFFGISAASSSLFASSRTLYSMATQQKAPKLFQTCTSYGVPWIAILFSGSFGIIAYISVAESSMANFQTLSSIASGTNAIIWLGLNVSFLRFYYALKRRPDIISRDDPTYPYRSPMQPFLSFYGLIGSGLVVIFMGFTNFLHGFWSTRSFLSSYGGLIFFITSYFAYKLFGASKIQSLEQLDMDTGRREMDRMIWDEHRQYSGSLWERFKYVITWLL

SEQ ID NO: 29805 - protein, 400 aa, Haemophilus ducreyi 35000HP
MNEQLVDGFRQQFPFFTQYAEWSYLDSAATTLKPAVLIEAMSDFYASAGSVHRSQYDLAQTQDYELARQLVVKWFNVESAEGVIWTSGTTHSTNLVASGLAYSLNACDEIIISIAEHHANFIPWQQLAMQTQAKLIILPVSANLELTVEQLKQVLSTKTKIVALNLVSNVTGIRQPVESLIPIIRQYSSAKILLDCAQAVCSESIDVQRLGADFYTFSAHKMYGPTGVGVLMGKVQSLAQIRPLFFGGKMLSDVSIDHLELAELPYRLEAGTPNIAGIIGFGKVLQWLAKWDMDTLNQAVKQLSIQAYQRLTGYSNIRLFCDKPTTIISFAVDRIHHADIAAIMAESKVAIRSGEHCAKPYLAHLNQPGTLRISLAPYNQAQDLNRLFEALEVAFTLLAD

SEQ ID NO: 29806 - protein, 406 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALRYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGFGLVLFYQDSFFGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 29807 - protein, 135 aa, Hyacinthus orientalis
RCELSTTSIKGLKVRELPAHVKPKLSWTNIKKTTDQAVDRYIEKYIDTSSVEPLFHVCIGGMIFSYLVALPHERRHLEHQQQHAAGHHRSHGQGGRSDCGVSSLVAEIITKESPSNVFFLIDFRNKFSFIWTIMF

SEQ ID NO: 29808 - protein, 215 aa, Moritella sp. PE36
MSDFPLADQPISIRAETSIADPDTCKFIVSRTLHPGGPFFFANKERAAGSPLGEQLFALPGVANVLIAESIVTICKEPTASWSGLKAAIGTAIRAQLLTGVPAILEMYIHTDTQTGMQRRSDAELITVIQGLLDKEINRSIANHGGKISIVEIRQGKLYISMSGGCQGCASAQVTLRQGFEVMLKRVAPEIEEIVDTTNHAAGKQPFYPRHEEPL

SEQ ID NO: 29809 - protein, 339 aa, Roseovarius nubinhibens ISM
MGKLVDGIWRDSWYDTSATGGAFKRDSARFRNWITPDGAPGPSGEGGFAAQSGRYHLYVSLACPWAHRALIFRALKGLEDHIGVSVVHPDMLGEGWEFRADYPGATGDTLYGLPYLRDLYTRADPGISGRVTVPLLWDRERDTIVSNESAEIIRMFNGAFDALTGNRDDYWPEDLRAEIAPVNDRIYDTLNNGVYKAGFATSQEAYDAAVHPLFDTLDWLEERLSHRRYLMGTRITEADWRLFTTLIRFDLVYHTHFKCNRARITDYPALWAYLRELYQWPGVAETVNFDHIVRHYHYSHDTVNPHRIIPINPDPDFTAPHDRERLTAASEGQPRAQAQ

SEQ ID NO: 29810 - protein, 1529 aa, Neurospora crassa
MRNVSERAREWQTFRFLSTVRDSRAVPDPAHTSPSKSRRASSDTVLTALAQLGVLQLSARRGVLSLFDHDVQHIAAEATPTLPLRPYARDEITPLLLRGRDISRSEVICDNVIREQRRHPEDLIVFVIPDLLADPRFHHIPSLLEQEIYPRFYAGVPICSPSGVVIGLFSVFDTSPRQKLDELDIDFMKDLSRTISRQLGSYRKQSVLLQTERILRGVSNGSIDPPTHTTVSEDAIDGTLSSSEYEAEHLRKLSLPDHRSLDSRLKAGDTHSRGSDKPMPPDTPTQGTLGADVRLSEIQKSFAKASNIIRQSMDAAGVIFLDANTSPFHCWQDGDANTTSDVHPRAASISSNKVNGVANSEIDLEVKPHKRPCDILGFSVTPTGTPDGTTIDPTGPLRHPGPHRSWRVLSESFLRKLLRRYPRGTIWEFDAAGNFISASEAVPMPSPPSSTSPSCPYSDSEIDTAAKRQRRGRARRKSGTLMRKPRKSEWDTIHAAFPEARAVSFFPLWGTQMQRWFAAGLSWSRESLRTLAPQDELGLFNAFGKNIMAEVARIDATLANQAKSDMLGSISHEMLSPLHGILGAAELLLDTDLSTSQMELICLVEASVRTLLDTVDHLLDHSKINSLVENTKLSNARRGSFQSDDLEHSEGPDLSGPPETSRTRLRSGSLAPKPWPWERPTLTRFYDIDLAVMLEEVVESLYAGYSFQRWCNQRGADPGDDNVAIHLDIDPTVNWSYYAQPGALRRILMNLFGNALKFTHKGFINLSLTAQPIPSEPRPSFASTDLDDEAEDPGIETDSKHSSSYPKSKTGWNDQNRSNVVLTVSDTGKGITQRFLREKAFSPFQKEDSLTPGPGLGLSIVKQIVCALNGRVVIDSRPGEGTTVRVIIPLQHSSPETTSEDRDMVEHKEALGGLRICLLGFDGLGDGDPDGNQWGEPVSAKERKVLRGRIMERMCRDWLGSQVVTNPAEAQMTICSDRFVLEMCTKDGADDKTGGRGFASKTLAGPLVVVCGNEVVAQNLSLARGESAAGGKGEASVMEFIGQPVGPRKLAKTLRKCLQQHPVSLKEREGERTSSESSIDLDVLQRKMSDPEVFQIANKKSRFLPYLADDFGDNLFSTDQGTAAAATRPLVQRIKSTGGRPLVQRTSMGKDGKGEGGKMGYAPVSDMEEGEKVEEAAIPEPTLLQNVKQEETSLPLSSQKKNIKMPLTRPPLPPRYHTGKEKTNSMDLGFTTVSISEVSSPFDSIISPPVLTNVPASPEDEQVSPMSHAINTIPPSGTIDASTSIIGNAGPTGGAIVGAAAAPATSNTMTGTEAVPNVPLPPKPLELLEPYEVQRQQSILITSPVLTGGQPPELHLDTRRLSKASNFSMNTTSSPSQPSPPSQSLSNSPSQPRKISSNFSPNQDEKACLLVDDNPINLHILASAMRKTHRPYATARNGLEAVEIYKENPGRYKWVLMDISMPVMDGLEATRKIRDTEGELINGLEPATVVALTGVTSGTIQKDALASGVDLFLTKPVRMKDLGAILGDG

SEQ ID NO: 29811 - protein, 325 aa, Zea mays
  misc_feature (242)..(242): Xaa can be any naturally occurring amino acid
MTTVSRALGSAFAGFTRAPAVAQTATTLPSPYGSSALHQHWRWSRACRTRRFSSGRAARISMSLRAGIVGLPNVGKSTLFNAIVENGKAQAANFPFCTISPNVGVVAIPDPRLQVLSKLSKSQQTVPTSIELVDIAGLVKGASKGEGLGNQFLSNIREVDSVFRVVRCFEDDDIVHVNGKVDPRSDIDVINLELIFSDLEQIEKRLDKLSKSKTKDTQVKVKEQAEKSRLEKIQQALMEGKXPARSIYLAEHEKQAIKHLYLLTMKPVIYVANVTESYLAEPDINPHVKEVSKPTSDLQSGMVTIPARVYCIHRSTRTFEEISDK

SEQ ID NO: 29812 - protein, 96 aa, Brassica napus
  misc_feature (33)..(33): Xaa can be any naturally occurring amino acid
LNSRIRVLHQYLGAMQKGDIPCDNSLLRQVASXLRSLPAAQSEKFKEDFLMEYNDKLLMSYLAMITNCTSNMNEVVDKFNTAYERNSRRGGRTPFM

SEQ ID NO: 29813 - protein, 337 aa, Brassica napus
  misc_feature (168)..(168): Xaa can be any naturally occurring amino acid
  misc_feature (314)..(314): Xaa can be any naturally occurring amino acid
RLQRPGGSPLTRIFQVIVAAFRKVSVKVPEDKSLLFETADDESNITGSRKLEHTDNLMFFDKAAVESHSDSIKDGEVNPWRLCSVTQVEELKSIITLLPVWASGIVFATVYSQMNTMFVLQGNAMDQHMGKNFEVPSASLSLFDTVSVLFWTPVYDQFIVPFARKFTXRQERGFTQLQRMGIGLVISIFAMVTAGVLEVVRLDYVKSHNAYDDKKIPMSIFWQIPQYLLIGCAEVFTFIGQLEFFYDQAPDAMRSLCSALSLTTVALGNYLSTVLVTVVMKLTKKNGKPGWIPDNLNRGHLDYFFYLLAVLSFXLNFLVYLWISKRYKYKKAIGRAH

SEQ ID NO: 29814 - protein, 61 aa, Glycine max
  misc_feature (33)..(33): Xaa can be any naturally occurring amino acid
VACNPLTKSGCPLIHQSMRLTFGSLANSTPYLXRLLLLINSAYLASSKSLNTQFTALRKED

SEQ ID NO: 29815 - protein, 269 aa, Synechococcus sp. WH 7803
MTGGPSQLETGQGPEDAGTASTKATLLVVDDEPAVRRVLVMRLQLAGYRVVCAEDGEQALEVFSRESPDLVVLDVMLPKLDGFAVCRRLRAESCVPIIFLSALEAISERVAGLDLGADDYLPKPFSPKELEARIATILRRVGRGSANAEPRELPTGQGVVRVGELVVDTNRRQVTRGSERIALTYTEFSLLELLFREPGRVVPRAEILEQLWGYPPRRAADLRVVDVYVARLRGKLEPDPRNPELILTVRGIGYSSQRMGDNAPVAAAG

SEQ ID NO: 29816 - protein, 299 aa, Bacteroides fragilis YCH46
MSPLNFTHILTQTVDELSESESYKGLFHQHKDGEPLPSPRVLCDVIELARSILFPGYYGNSTVNSRTINYHIGVNVEKLFNLLTEQILAGLCFGNGDRCDECTEAKREEAARLAAKFISKLPHLRRVLATDVEAAYNGDPAAQSFGEVIFCYPAIKAISNYRIAHELLELGVPLIPRIITEMAHSETGIDIHPGARIGTHFTIDHGTGVVIGATSIIGNNVKLYQGVTLGARSFPLDADGKPIKGIPRHPILEDNVIVYSNATILGRITIGRDATVGGNIWVTENIPAGARIVQTKAKK

SEQ ID NO: 29817 - protein, 464 aa, Oceanobacter sp. RED65
MADYHYDVIVLGTGPSGEGAAMNAAKKGKKVAVVEEAPLVGGNCTHWGTIPSKALRHSVKQIISYNTNPMFRDIGEPRWFSFPRVLKTAERVIAKQVKLRTEFYSRNRVHLYHGHGQFVDSHCIEIFDGPASGTRLHAEQVVIATGSSPFRPPTVDFNHERIYDSDTILKLEHTPRTMVIYGAGVIGSEYASIFSGLGVKVDLINPGERLLPFLDDEISDALSYHLRNNGVLIRHNELFDRVEADEHSVKVYFQSGKVIKADAMFWAAGRSGNTQNLGLEHVGLTPNGRGQLEVDDHYKTQADHVYAVGDVVGWPSLASAAYDQGRSVAAYMAGDDDFWFVEDVPTGIYTIPEISSVGKTERELTNEKVPYEVGQAFFKSIARAQITGENVGMLKLLFHRETFEILGIHCFGDQASEIIHIGQAIMKQKNGGNTVKYFVGNTFNYPTMAEAYRIAALNGLNRVC

SEQ ID NO: 29818 - protein, 433 aa, Haemophilus ducreyi 35000HP
MAKIVKVIGREIIDSRGNPTVEAEVHLEGGFVGLAAAPSGASTGSREALELRDGDKSRFLGKGVLKAVAAVNNEIAQAIVGKEGCAQSEIDQTMIDLDGTENKSKFGANAILAVSLATAKAAAASKGLPLYAYIAELNGTPGVYSMPLPMMNIINGGEHADNNVDIQEFMIQPIGAKTLREALRIGAEVFHNLAKVLKAKGLSTAVGDEGGFAPNLASNADALACIKEAVENAGYVLGKDITLAMDCASSEFYNKENGLYEMKGEGKSFTSQEFTHYLENLCKEYPIVSIEDGQDESDWDGFAYQTKILGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGEMAPFLGLKAIKGQA

SEQ ID NO: 29819 - protein, 309 aa, Candida glabrata CBS 138
MSYNPYSFQGEATANDRFRHGSQPSMEQGQPLFGAQQASQQQMPPQQQQQQQQPGFNFQNPTQSMAFQLGQSAFSNFIGEQNFSQFQETVSKATSANGSLSLYFQVTTNYVINKLRVILIPFTNKNWQRIPEAQQGSNGALSFMPPKDDINSPDMYIPIMGLVTYILIWNTQQGLKGSFNPENLYYKLSSTVAFVLLDLVILKLGLYLLVSTNSRTTNIVELICFVGYKFVPLILALFLPSSPIYLKMIVQVYLFIAFGVFLLRSVKFNLFTNTNSDMVTFNKATVRKCNYFLFVYGFIWQSILMWLMG

SEQ ID NO: 29820 - protein, 211 aa, Arabidopsis thaliana
LLRENKRMLDKSIREIERERQGLQTQEKKLINQIKKTAKQGQMGAVKVMAKDLIRTRHQIEKFYKLKSQLQGVSLRIQTLKSTQAMGEAMKGVTKAMGQMNRQMNLPSLQKIMQEFERQNEKMEMVSEVMGDAIDDALEGDEEEEETEDLVSQVLDEIGIDINQELVNAPSGAVAVPAAKNKVVQAEATGAEDSGGIDSDLQARLDNLRKM

SEQ ID NO: 29821 - protein, 306 aa, Mycobacterium tuberculosis H37Rv
MSRPEVLTPFTAIVPAAGLGTRFLPATKTVPKELLPVVDTPGIELVAAEAAAAGAERLVIVTSEGKDGVVAHFVEDLVLEGTLEARGKIAMLAKVRRAPALIKVESVVQAEPLGLGHAIGCVEPTLSPDEDAVAVLLPDDLVLPTGVLETMSKVRASRGGTVLCAIEVAREEISAYGVFDVEPVPDGDYTDDPNVLKVRGMVEKPKAETAPSRYAAAGRYVLDRAIFDALRRIDQGAGGEVQLTDAIALLIAEGHPVHVVVHQGSRHDLGNPGGYLKAAVDFALDRDDYGPDLRRWLVARLGLTEQ

SEQ ID NO: 29822 - protein, 221 aa, Phaseolus vulgaris
MATAPTITDVQVEFLHFPAVVTSPATAKTYFLGGAGERGLTIEGKFIKFTAIGVYLEDKAVASLATKWKGKPSEELINTLDFYRDIISGPFEKLIRGSKILQLSGTEYSRKVMENCVAHLKSVGTYGDAEAKGIEEFAEAFKKVNFPPGASVFYRQSPDGILGLSFSEDATIPGEEAVVIENKAVSAAVLETMIGEHAVSPDLKRSLASRLPAVLNGGIIV

SEQ ID NO: 29823 - protein, 507 aa, Prototheca wickerhamii
ADPPSGKPTHHLSTGDLPARTPMAPCLATVVPTSVGTLQGARALPKGAFGPRPSALATRQAQRAPRNPAGPAPRSLSHRTAAVAPGTAQAPNSSMASPTAQSEVGLIGLAVMGQVNPGSEAASRVHQGAGNPWMQLWGGPALRKRLCSDRVYRDVMSDSGRDPHAFPQNLALNVAEKGFHISVYNRSGEKTDAAVSRAVKEGVGERLHGVQGAKDFVLSLKRPRRIIILVKAGAPVDSTSKQLTEFVVEPRDIIIDGGNEWYENTERRQAELATKGSHHIGMGVSGGEEGARNGPAMMPGGDKGAYSHLRPVVEKVAAQTDDGACVTYIGPGGAGNYVKMVHNGIEYGDMQLIAEAYDVLKTVGGLTNAELASVFSEWNGGELESFLIMITAIIFAVKDEGGEGELVDKILDKTGMKGTGKWTIQEAAELSVAAPTMAAALDARFVSGLKDQRVAAEAVYAGLGLGPPTPPPASYKAALVADVRDALYAAQDLSYAQGVQHHPCQVG

SEQ ID NO: 29824 - protein, 379 aa, Oryza sativa Japonica Group
MSTSAPTSSPEPPEFIRGSLIPALPDDLAIHCVALLPRAAHPSLALVSRAFHTLLCRDPGPLLAARRRLRLSDPHVILSLRPPASASPLFFLLLPHPGWPPLPLPSPPVPVSSSSSVAVDGNRVFLFGGSVSGVPSPSVQILDPRTRSWSVGPRLSSPREFAAAVAHSGVLFVAGGCVPSSPFWAESLNLSSPDAKWSPVPSPPHFREKWMHGSASLAGKVLAVADRGGLAYDPAAPPTEAWAPVSPILDMGWKGRAAVVGGILYSYDYLGQVKGYDPDTDCWSKVEGLEQELPKFLCGATLANVGELLYLVWEGKWKGKGKAKGKGEARSMVVIDWAAIAVTKAEEGRLTGKVLSRDTIVFKDMPKGSAITHCIALEL

SEQ ID NO: 29825 - protein, 486 aa, Rhodococcus aetherivorans
MALLDESIWQGKIFVGDWIPGGAGEIKVVEPATGATLGSVGLADEGDLERAVDRAVAAQRDWAARPHTERAAVLRRAGDLWQRHADEIERWIMRESGSLRPKAQLETHVAAQECFEGAALPSHALGEILPSEAPRLSMSKRVPVGVVGVIAPFNFPLILAIRSVAPALALGNAVILKPDPRTAVCGGVALARIFEQAGLPAGVLSVLPAGADVGAALVDDPRVPVISFTGSTPAGRAVGAAASRNLKKVHLELGGNSAIVVLDDADLAATVAAGAAGSFLHQGQVCMTTGRHIVHESVYDEYVAQLAAKAEALPVGDPATEQVALGPIIDHGQLEKIHALVTASVDAGARLVAGGTYKGLFYRPTVLADVPAGAPAYAREVFGPVAPVVKFSTLDEAVALATDTEYGLSLGIFTRDVGKGLALAERIPTGIAHINDQTVGDEANIPFGGLGASGNGARFGGAANSIEAFTESRWITVSRDVPVYPF

SEQ ID NO: 29826 - protein, 413 aa, Coprinopsis cinerea okayama7#130
MSLSNKLSITDLDVKGKRVLIRVDFNVPIQEGKITNPAGLLKEYLIVILGAKSVVLMSHLGRPDGKVNEKFSLKPVAAKLEELLGKSVIFTNDCVGADVEKAVNGAPDGSVILLENLRFHIEEEGSVKNKDGTKTKADPAAVTAFREGLTKLGDVYVNDAFGTAHRAHSSMVGVKLPQRAAGFLMKKELEYFAKALEHPERPFLAILGGAKVSDKIQLIENMLDKVNSLIICGGMAFTFKKALDGVAIGNSLFDSAGAEKVASLVEKAKKNNVKLVFPVDYITADKFDKDAATGTATDKDGIPEGWMGLDAGPESRKLYRETVLEAKTILWNGPPGVFEFPAFANGSKELLKATEEAVAKGATVIIGGGDTATVVAQFGDESKLSHVSTGGGASLELLEGKTLPGVAELSEKQ

SEQ ID NO: 29827 - protein, 500 aa, Mycobacterium sp. JLS
MTANRRPEGVPQRIQHFIGGKLVDSLADTWFDVIDPVTNQPYAQAAAGQADDVDRAVAAAKVAFRTGPWPNMQARSRSRVLNRIADAIESRDARLAELESFDSGLPITQALGQARRAAENFRFFADLVVAQADDAYKVPGSQINYVNRKPKGVAGLITPWNTPFMLESWKLAPALASGCTVVLKPAEFTPLSAGLWADIFRDAGVPDGVFNLVNGIGEEAGDALVKHPDVRVISFTGESATGEIIFRNCATGLKGMSMELGGKSPAVVFADADLDAALDSTLFGVFSLNGERCTAGSRILVQEEIYDEFVERFAARAAGIVVGDPQDPRTEVGALVHPEHFAKVMSYIDVGKTEGRLLCGGGRPAHLPQGNFVAPTAFADVEPNARIFQEEIFGPVVALSRFQTEEQALALANGVKYGLAAYIWTNDLKRAHRFAQNVDSGMVWVNSHNVRDLRTPFGGVKASGLGHEGGYRSLDFYTDQQAVHITLGDVHTPRFGITAR

SEQ ID NO: 29828 - protein, 274 aa, Triticum aestivum
  misc_feature (268)..(268): Xaa can be any naturally occurring amino acid
MASPALISDTDQWKALQAHVGAIHKTHLRDLMTDADRCKAMTAEFEGVFLDYSRQQATTETVDKLFKLAEAAKLKEKIDKMFKGEKINTTENRSVLHVALRAPRDAVINSDGVNVVPEVWAVKDKIKQFSETFRSGSWVGATGKPLTNVVSVGIGGSFLGPLFVHTALQTDPEAAEAAKGRQLRFLANVDPVDVARSIKDLDPATTLVVVVSKTFTTAETMLNARTIQEWIVSSLGPQAVSKHMNAVSTNLSLSRSRNCPYQAFAFWXWVGGPS

SEQ ID NO: 29829 - protein, 325 aa, Pseudomonas fluorescens PfO-1
MAKRIQFRAHGGPEVLEYVDYQPAEPGPQQVRVSNKAIGLNFIDTYYRSGLYAPPALPSGVGAEGAGIVEAVGSEVTRFKVGDRVAYGSGPLGAYSDVHVLPEANLVHLPDAISFETAAGVMLKGLTVQYLLRQTYELKGGETILFHAAAGGVGLLACQWAKALGVKLIGTVSSKAKADLAKAHGAWETIDYSHENVAQRVLELTDGKKVPVVYDGVGKDTWPASLDSVAPRGLLVSFGNASGAVDGVNLGILAAKGSLYVTRPTLATYANNAENLQRMADELFGMITSGKLKVDISQRYPLADAAKAQTELSARRTTGSTVLLP

SEQ ID NO: 29830 - protein, 292 aa, Glycine max
  misc_feature (202)..(202): Xaa can be any naturally occurring amino acid
  misc_feature (248)..(248): Xaa can be any naturally occurring amino acid
MAATFKHHPTGLHGWGAPRSSRNLPSFFSMRFPCSTRHHHIRASVSHHSSTEAESALILIRHGESLWNEKNLFTGCCDVPLTNRGVEEAIEAGQRISYIPIDMIFTSALIRAQMTAMLAMTQHSQKKVPIIIHDESEQATTWTQVYSEKTTKQSIPVITAWQLNERMYGELQGLNKQETAERYGKEKVHEWRRSFDIPPPKXEPQLKSGKHVMVAAHGNSLRSIIMYLDGLTSQEVTSLEISTGIPLXLYIYKEGKFNSRGSPVGPTEAGVYAYTQSLAVYRQQLDDMSSCY

SEQ ID NO: 29831 - protein, 637 aa, Dechloromonas aromatica RCB
MIMNLQHWKLVADAAGIATATLDKAGESANSLSAEVLSEFSAILDRLDAYPPKGLIIRSGKEAGFIAGADIAEFSQLDTPEKSRALVERGWNLFNRLAAVKYPTLALVRGHCLGGGLELALACRYLLAVDESGTKMGLPEVMLGIFPGWGGMLRLPQRVGPAAALDLMLTGKTLDAKRAKKMGLADDCVPPRVMEMAARQLVLSGQPRRQLPFVQRLLNGPLKSVVANGARKQVAKKARPEHYPAPYAIIDLWAKHDGNALAAPEVVDRIISSPTARNLLRVFHLQERLKGFGKESAFKAKRVHVIGAGVMGGDIAAWCALRGMTVTLQDQTLERISPALKRAHALFTKRLREPLKIRDAFDRLIPDPKGDGVAHADVVIEAIFENVEAKHALFKSVEPRLKPGAVLATNTSSLRLEDLRTVLQRPERLVGIHYFNPVAMMPLVEVVAAEGADPSAVQAACAFVRQIDKLPLPVKSAPGFLVNAVLAPYMLEAMRAVDSGISPETVDEAMLAFGMPMGPIELIDTVGLDIAMAAGQQLAGGAEAPRCLIARVDKNQLGKKSGQGFYHWTDGKAKKGAAAGVPAGLADRLVKPLIDRVEQLVAAGVVADTELADAGVIFGTGFAPFTGGPLNYRRVNR

SEQ ID NO: 29832 - protein, 1080 aa, Hordeum vulgare
MDGDADALKSGRHGAGDVCQICADSLGTTVDGEVFTACDVCRFPVCRPCYEHERKEGTQACLQCKTKYKRHKGSPVIRGEEGDDTDADDGSDFNYPASGTEDQKQKIADRMRSWRMNTGGSGNVGHPKYDSGEIGLSKYDSGEIPRGYVPSVTNSQMSGEIPGASPDHHMMSPTGNISRRAPFPYVNHSPNPSREFSGSIGNVAWKERVDGWKMKQDKGAIPMTNGTSIAPSEGRAATDIDASTEYNMEDALLNDETRQPLSRKVPIASSKINPYRMVIVLRLVVLSIFLHYRLTNPVRNAYPLWLLSVICEIWFALSWILDQFPKWFPINRETYLDRLALRYDREGEPSQLAAVDIFVSTVDPLKEPPIVTANTVLSILAVDYPVDKVSCYVSDDGASMLTFDALAETSEFARKWVPFVKKYDIEPRAPEWYFSQKIDYLKDKVQPSFVKDRRAMKREYEEFKIRINGLVSKALKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKAVREAMCFLMDPNLGPQVCYVQFPQRFDGIDRNDRYANRNTVFFDINLRGLDGIQGPVYVGTGCVFNRTAIYGYEPPIKAKKPSFLASLCGGKKKASKSKKRSSDKKKSNKHVDSSVPVFNLEDIEEGVEGAGFDDEKSVLMSQMSLEKRFGQSAAFVASTLMEYGGVPQSSTPESLLKEAIHVISCGYEDKSEWGTEIGWIYGSVTEDILTGFKMHARGWRSVYCMPKRPAFKGSAPINLSDRLNQVLRWALGSVEILFSRHCPLWYGYGGRLKFLERFAYINTTIYPLTSLPLLVYCILPAICLLTGKFIMPEISNLASIWFIALFLSIFATGILEMRWSGVGIDEWWRNEQFWVIGGISAHLFAVFQGLLKVLAGIDTNFTVTSKANDEEGDFAELYMFKRTTLLIPPTTILIINMVGVVAGTSYAINSGYQSWGPLFGKLFFAFWVIVHLYPFLKGLMGRQNRTPTIVIVWAVLLASIFSLLWVCVDPFTTRLAGPNIQTCGINC

SEQ ID NO: 29833 - protein, 1051 aa, Hordeum vulgare
GGQVCQICGDGVGAAANGELFAACDVCAFPVCRPCYEYERKEGTQACPQCKTKYKRHKGSPPARGDESEDDASDFNYPASGNQDHKHRAPEKMLTWRRNSGASDDIGLTKFGSGEIGLHKYDSGEIPHGYIPRFSHSQASGEIPGASPDHMMSPAGNVGKRGHPFAYVNHSPNPSREFSGSLGNVAWKERVDGWKMKDKGAIPMTNGTSIAPSEGRGNGDIDACTDYGMEDPLLNDETRQPLSRKVPIPSSRINPYRMVIVLRLIVLCIFLHYRFTNPVRNAYPLWLLSVICEIWFAFSWILDQFPKWSPVNRETYLDRLALRYDRDGELSQLAPVDIFVSTVDPMKEPPLVTANTVLSILAVDYPVDKVSCYVSDDGAAMLTFDALAETSEFARKWVPFCKKYNIEPRAPEWYFAQKIDFLKDKVQTSFVKDRRAMKREYEEFKVRVNSLVAKAEKVPEEGWIMQDGTPWPGNNTRDHPGMLQVFLGHSGGLDTDGNELPRLVYVSREKRPGFQHHKKAGAMNALVRVSAVLTNGQYMLNLDCDHYINNSSALREAMCFLMDPNLGRKICYVQFPQRFDGIDTNDRYANRNTVFFDINLRGLDGIQGPVYVGTGCVFNRTALYGYEPPMKKKESGLFSKLCGGKKKSKKSDKHADGSVPVFNLEDIEEGIEGSGFDDEKSLVMSQMSLEKRFGQSSVFVASTLMEYGGGPQSATPESLLKEAIHVISCGYEDRSDWGREIGWIYGSVTEDILTGFKMHARGWRSIYCMPKRPAFKGSAPINLSDRLNQVLRWALGSVEILFSRHCPIWYGYGGRLKFLERFAYINTTIYPLTSIPLLIYCILPAVCLLTGKFIIPQISNIASIWFISLFISIFATGILEMRWSGVGIDEWWRNEQFWVIGGISAHLFAVFQGLLKVLAGIDTSFTVTSKASDEDNDFAELYMFKWTTLLIPPTTILIINLVGVVAGTSYAINSGYQSWGPLFGKLFFAFWVIIHLYPFLKGLMGRQNRTPTIVVVWAILLASIFSLLWVRIDPFTTRVTGPDIQMCGINC

SEQ ID NO: 29834 - protein, 270 aa, Aeropyrum pernix K1
MARYGVAVVKIGGSIASRLERVADEIAVLAREGLRLVVVHGGGKVVDEYSRRMGVEPRYVLHPSGVRSRYTSWEELEVYVMVMAGLLATSISSELASRGLKVLSLTGLDGLSVEARRRERIVIVNERGRPQAIPGGYTGKIERVDSMFVGSMLQQVDVILYSPVAYGREGDRVVALNVDGDQMAASLSAALKAPLALVTDVPGVILDGRVVDRIRVSEAREIAAKAGVGMNRKILMAAKAVSEGSPYAAIGDPPIQSLINGEKGTLVTRS

SEQ ID NO: 29835 - protein, 212 aa, Thiobacillus denitrificans ATCC 25259
MLYDFERTAPEPQGLGLVPMVVEQSGRGERAYDIYSRLLKERVIFLVGPVNDATANLIVAQMLFLESENPDKDIYLYINSPGGSVSAGLAIYDTMQFIKPDVSTLCIGQAASMGAFLLTAGAKGKRYCLPNSRVMIHQPLGGFQGQASDIEIHAKEILYLKARLNGMLAKHTGQSLEVIDRDTDRDNFMSAEDSVKYGLVDKVLTSRNEAGN

SEQ ID NO: 29836 - protein, 236 aa, Physcomitrella patens subsp. patens
MNKQDAQTAEQGNEEKENGSEKEVKCLTKCESLPTNSSSVESDDDESQAEQEAACAAFNEKELGPLVSLKEQLEKDKEDESLRRWKAQLLGVASLEEGDGFVEPEVKVVSLGVMAKGRADSEFPLPLGTNSRGYTFSLKEGSTVALKYVFTVRNNIVSGLTCVNTVWKVGLQVDQTRDMMGTFAPQQEAYVHIAEEEVTPCGPLARGAYTARKKFVDDDGRVYLELDYSFEIRKEW

SEQ ID NO: 29837 - protein, 102 aa, Ashbya gossypii ATCC 10895
MSTSGIPVKLLNEAQGHTVSLELTTGETYRGKLVGSEDNMNCQLRDVTATARNGQVTHMDHVFVRGSHVRFFVVPDMFKNAPLFKSESAHKPPPPIRGPRRK

SEQ ID NO: 29838 - protein, 451 aa, Prochlorococcus marinus str. MIT 9313
MSDATSHEIDHFMKGLMKRNPGEPEFHQAVHEVVETLIPFILSNRVYKDAQILERMTEPDRVVIFRVCWEDDSGNIRTNRAWRVQFNNSIGPYKGGIRFHPNVTLSVLKFLGFEQTFKNSLTGLPMGGGKGGSNFNPKGKSDREIMRFCQSLMIELHRHIGEDTDVPAGDIGVGSREISYMFGQYKRLENRFSGILTGKGLSFGGSLVRTEATGYGCAYFCENMLNHIEDSLVDKICSISGSGNVALYAVEKAIELGAKVVTLSDSDGFVHVPNGINLEMLAFIKELKTVRRGRIHEFANHYKGVDFYAGKRPWNVPCDIAFPCATQNEINRADSQELINNGVKAVVEGANMPTNLDGIHEFRHAKVILAPAKAANAGGVAVSGLEQSQNALRLSWSREEVDQRLKSIMLEIHSKCVQHSHKYEDYTDYITGANIAGFTKVADAMLAYGIV

SEQ ID NO: 29839 - protein, 198 aa, Ashbya gossypii ATCC 10895
MSEKEVTIDEDLNVDDELNEFDDGEEAPVDNAMLFGSQPPEDRAGADPKHRKLFEIPEFTRKDKTVNELLDLMTDNPPIIPDAVIDYYLTKNGFECTDVRVKRLLALATQKFVSDIAADAYEYSRIRSSIAVHNSNNGQARARQLMLGQQQPGTQQISQQQHQQNEKTNANKVTLTVNDLSSAVAEYGLNISRPDFYR

SEQ ID NO: 29840 - protein, 460 aa, Ralstonia eutropha JMP134
MKHLQRNLGARHIRFLALGSAIGTGLFYGSASAIQLAGPAVILAYILGGAAVYMVMRALGEMAVREPVSGSFGRYASEYLGPLAGFLTGWTYILEMIIVCLADVTAFGIYMGFWFPEVPQWIWVLGIVMLICGLNLCNVKVFGELEFWLALVKILAIGAMIIGGTLILFLGVKMNGEHSPGLTNLWAHGGFLPHGAGGLIASLAVVMFAYGGIEIIGITGGEAKEPEKVIPRAINAVPARILLFYVLTMVVLMAIFPWTGIGGQGSPFVQIFSGLGIKSAAAILNLIVISAAISAINSNIFGAGRMMFGMAEQGQAPRLFAITSRQGVPWVTVLAMAAALLGGVVLNYLIPEQVFVIIASIATFATVWVWLMILLSQVAMRRRLSAEEVRALKFKVPMWPVGPALAIAFMLFVICVLGYVEDTRVALYIGAGWVALLSLAWYLRAKPHEDRILTGESSAL

SEQ ID NO: 29841 - protein, 211 aa, Arabidopsis thaliana
LLRENKRMLDKSIREIERERQGLQTQEKKLINEIKKTAKQGQMGAVKVMAKDLIRTRHQIEKFYKLKSQLQGVSLRIQTLKSTQAMGEAMKGVTKAMGQMNRQMNLPSLQKIMQEFERQNEKMEMVSEVMGDAIDDALEGDEEEEETEDLVSQVLDEIGIDINQELVNAPSGAVAVPAAKNKVGQAEATGAEDSGGIDSDLQARLDNLRKM

SEQ ID NO: 29842 - protein, 392 aa, Methanocaldococcus jannaschii DSM 2661
MIILKADYKKYNVSELEKLRMDEEKFYETFDNAILLQTCNRVEIIFDADSLEEIKGIENIDLEKFDILFGDKAIEHLFRVACGLESMIVGEDQILGQLKNAYLKAKEKGRISKKLEKIILKAIHTGQRARVETKINEGGVSIGSAAVELAEKIFGLEGKNVLLIGAGEMANLVIKALKEKNIKAIIVANRTYEKAEKLAKELGGMAIKFDKLEEALRYADIVISATGAPHPILNKERLKNAGKTIIIDIANPRDTTDDIRELPDIFLFTIDDLRLVAEENLKKRKEEIPKVEMIICEELERLKEFLDKMRFETAIKELGQYIENVRKKEVEKAKKILKNKNKPVEEVLEDFSKALCKRIIYDIIKIFENVEDKEVFECLAKEFKKLGNKNKN

SEQ ID NO: 29843 - protein, 410 aa, Aeropyrum pernix K1
MEAGSIVLGLVGKTNVGKSTFFAAATEVPVKIENRPFVTIEPNVGVGYARKRCAHVELGLPRCDPVNSLCIEGWRFIPVKLLDVAGLVPGAHRGRGLGNRFLDDVRKADALLLVVDASGSTDPEGVPVKPGSYDPVEEVGLMLGEIYEWMLQNLARDWERFARRVDTAGNVDLVTALSQRLSGFEIPRGVVAGVLEETGLGEKRLSSWSREDLRLFVKLVLERGKPAVILANKVDVPGAEENVERLGSSYPGIPVVPASALAELMLRRLAREGRVRYIPGDPDFTVKDPGGLGGKALKALELVRERVMKRWGGTGVVQAINTAVFDVLDMIAVYPVEDPNRYTDREGRILPDVILVKRGSTPRDLAYRIHTDLGKTFLYAVNAKTKQRVGEGYRLQDGDVVKIVAAAGKR

SEQ ID NO: 29844 - protein, 407 aa, Ralstonia eutropha JMP134
MNNVLQQRPRATIVGGSLGGLFAANMLQRNGWDVTIFERTPETLTGRGAGIVTHPELFEALAAAGVAIDDSIGVRIRTRVTLSRDGSTVSDREMPQTLTAWGKMYDVLGHAFSGEYRTGATVTDVDSRSDHAVVKLEDGSTHRADLVIAADGFRSGVRERLVPSAALEYAGYIAWRGLVDEAKISRETHAAIFDKFAFCLPPHEQILGYPVAGDGNSTTPGQRRYNFVWYRATREHDELPDLLTDATGKVWNNGIPPALIRADVLADMESAAADRLAPQFAEIVSSTAQPLFQPIFDLTVPRMAFGRIALLGDAAFVARPHCGMGVTKAAGDAMALVRALAGHESVETALEAYSAERVQVGQAVVEHARHLGAYMQAQLKSEQDREMAERYRTPEAVMRETAVSRRF

SEQ ID NO: 29845 - protein, 514 aa, Yersinia pestis CO92
MAVSQPLSAAPCGAEYLRAILRAPVYEVAQVTPLQVMEKISSRVGNTVLVKREDRQPVHSFKLRGAYAMISSLTEEQKACGVVTASAGNHAQGVALSAHKMGIKALIVMPVATADIKVDAVRAFGGEVLLFGANFDEAKTKAIALAQEQGYTFVPPFDHPAVIAGQGTLAMELLQQDAHLDRVFVPVGGGGLVAGVAVLIKQLMPQIKVIGVEAEDSACLRAALDAGQPVDLARVGLFAEGVAVKRIGDEPFRLCQEYLDDVITVDSDAICAAVKDLFEDVRAIAEPSGALALAGLKKYVQQHNIQGERLAHVLSGANVNFHGLRYVSERCELGEQREALLAVTIPEQKGSFLRFCELLGGRSVTEFNYRYADAENACIFVGVRLTRGYAERVEILAELQDKGYQVVDLSDDEMAKLHVRYMVGGRPSKPLRERLFSFEFPESPGALLKFLHTLGTHWNISLFHYRSHGTDFGRVLAAFELSATEPQFEERLAALGYYCHDETDNPAFKFFLAG

SEQ ID NO: 29846 - protein, 346 aa, Pyrobaculum aerophilum str. IM2
MEDGSVFAGRLIGAEKIAVGEVVFTTSVVGYPQTLTDPSYKGQIITFTMPLIGNYGVSEDQLESDGIKAEGVVLFEATFPSHYKSVMSLEEWLASSGVPGVARVDTRALVQMLREHGVMMGAIGPEDPAVLMEALRKSPHYEDVVYVDMVSVKEPVLLGEGRLCIGVVDCGVKRSIVREFLKRGVRVKLVPCRRTELAFDCDALFISNGPGNPKLLDFLSAKVSEYVEYKKPLMGICLGHQVIAMALGAGIYKLKFGHRASNKPVRDIRFTGRTYITTHNHGYAVDPRGTDLKVWAVQPDDGTVEGLYHERLPILTTQWHPEASPGPQDTRWVFDKFLKLVERHGH

SEQ ID NO: 29847 - protein, 399 aa, Clostridium perfringens SM101
MKKFNLVEEAIEDIKNGKMVIVIDDEGRENEGDLVMAGELVTGEKINFMATYGKGLICAPVSESIAESLGLNPMVSHNTDNHETAFTVSIDYKNTTTGISAFERAHTIKELINEESKAEDFRRPGHVFPLIAKNGGVLKRAGHTEAAIDLAKLAGLKEVGVICEIMKDDGTMARTDELLEFAKIHNMKIITIEDLIAYRTERDNFVYRVVETNMPTKYGEFKAIGFIDKLTGEHHVALVKGEIKSEEPVLLRVHSECLTGDVFGSRRCDCGEQFHRAMEKINEEGKGILLYMRQEGRGIGLINKLKAYKLQDEGLDTVEANIALGFPEDLRDYGVGAQILKELGVREIRLMSNNPKKITGLEGYGLKIVERVPIEIKCNEENEFYLKTKKEKMHHLIMQ

SEQ ID NO: 29848 - protein, 429 aa, Acidithiobacillus thiooxidans
MTTHIQKPATGSPLTLLNGVLQVPDQPIIPFIEGDGIGCDVTPAMRSVVDAAVAKVYGGQRQIAWMELFAGQKAVQLYGEGQYLPDETMAAIREYKVAIKGPLETPVGGGIRSLNVAMRQDLDLYVCLRPVRYFEGTPSPMRHPEKVDMVIFRENSEDIYAGIEWPAGSPEAEKIIRFLREEMGVTKIRFPDSSAIGIKPVSTEGSERLIRRTIQYALEHGKPSVSLVHKGNIMKFTEGGFRDWGYALAEREFAGRVFTWRQKAAISKAEGKAAGQKAEQQAIADGKLIIKDVIADNFLQQILLRPEDYSVVATLNLNGDYVSDALAAEVGGIGMAPGANLSDTHAIFEATHGTAPDIAGQGKANPSSLILSAVMMLEHLGWGEAAQAIVAAMNATIAAGEVTGDLAALRGDVPALSTTEFTAALIRRF

SEQ ID NO: 29849 - protein, 218 aa, Aspergillus nidulans FGSC A4
MANSETEAKSTIKPKPERLPITVSKPTPYTFDLGHLLANDPNPLELPKSEPLNASLKATARDGVQSLLNQLLTTCPITSSQQGVLLTLPAPSTILPRHKPLPTPKPPTKWELFARKKGIGKYSNKPGAALADKERRKKLVYDEESGEWVPRWGYKGKNKDDDQWLVEVKEKDWKKEEEAAAKGSSIRGMSRAERKERIRRNERKMRANERNSRKSGGK

SEQ ID NO: 29850 - protein, 522 aa, Pseudomonas fluorescens PfO-1
MALPSRRSLFPFLTWLPRQTRASVGRDLVVGLSGAILALPQSIAYALIAGLPPEYGLYAAIVPVLIACLWGSSWHLICGPTAAISIVLFASVSPLAVPESQDYITLILLLTFLAGIFQWLLGLLRFGALVNFVSHSVVLGFTLGAAVVIAIGQLPNLLGLELPAKATALDSLMDLLRHLGAVDKPSLVLGVATVVVGALLKQWLPRWPTLLMTLVLGSLVVWLWPAMFGHVQLVSAFFGRLPPFSGLPLDMDLILRLLPSAVAVGMLGLVTSLSIARSISARSQQLLDANQEVRAQGLSNIVGAFFSGSLSAGSFTRSGLSYEAGACSPLAGVFSALWVALFAIFGAGLIAHIPIPAMAGSILLIAWGLVDHRGIRALLRVSRADFVVMSLTCVATLLLELQTAIYAGVLASLFFYLKRTSQPRVQHWRDGEDDVLRVGGSIFFGASHYLQVRLQRMQGARVVIEAQQINFIDYSGVEMLHQEARRLLRQDRSLTLRQARPQVVEELRKLEGPEKCPIRFED

SEQ ID NO: 29851 - protein, 532 aa, Burkholderia xenovorans LB400
MRIRHVTSRQCRLSPSPPGQSLEASHMNHADMQFLDVEFPYARQYGNFIGGEWVPPVRGEYFDNVSPITGEPFTSIPRSTEEDIELALDAAHRARKAWADTAPALRANVLNRIADRMEQNLSRIAFSESIDNGKPIRETLAADIPLAIDHFRYFASCIRAQEGTLSEIDHDTVAYHFHEPLGVVGQIIPWNFPILMAVWKLAPALAAGNCVVLKPAEQTPASILVLIELIQDLLPPGVLNVVNGFGLEAGKPLASSKRIAKIAFTGETSTGRLIMQYASQNIIPVTLELGGKSPNIFFADVVDQDDGYFDKALEGFAMFALNQGEVCTCPSRVLIDEKIYDRFMERALKRVAAIAQGHPLDPRTMIGAQASQEQLEKILSYVDLGKQEGAECLIGGERNTLGGELSKGYYVKPTVFRGNNKMRIFQEEIFGPVVSVTTFRTEEEALEIANDSLYGLGAGVWTRDGTRAYRFGRQIQAGRVWTNCYHAYPAHAAFGGYKQSGIGRETHKMMLDHYQQTKNLLVSYSEQPLGFF

SEQ ID NO: 29852 - protein, 164 aa, Arabidopsis thaliana
  misc_feature (33)..(33): Xaa can be any naturally occurring amino acid
  misc_feature (152)..(152): Xaa can be any naturally occurring amino acid
  misc_feature (157)..(157): Xaa can be any naturally occurring amino acid
SSTIARFTWGTACAVSAVTRKANNYITSITTTXGRDSCMMVWPPIGKKNVETLSYLPDLSDVELAKEGDYLLRNKWIPCVEFELEHGFVYREHGNTPGYYDGRYWTMCKLPLFGCTDSAQVLKEAEECRMEYPGAFIRIIGFDNTRQVQCIXFIAYXPPSFTEA

SEQ ID NO: 29853 - protein, 178 aa, Bacteroides fragilis YCH46
MIMSKEKLIKSIREIPDFPIPGILFYDVTTLFKDSERLQELSDIMYEMYKDKGITKVVGIESRGFIMGPILATRLGAGFIPIRKPGKLPAETMEESYDKEYGKDTVQIHKDALNENDVVLLHDDLLATGGTMKAACNLVKKLYPKKVYVNFIIELKELNGKQVFENDQDVDIQSVLSL

SEQ ID NO: 29854 - protein, 266 aa, Xanthomonas axonopodis pv. citri str. 306
MIRIPMELRETVIAIARDAGDAIMEVYAQDFSVEIKDDASPLTQADLAANRVIVEGLRRVTPDVPVLSEESAHVAWEQRQYWTSYWLVDPLDGTREFVKRNGEFSVNIALIHMGAPVLGVVQAPVDGRVWYAARGENAFRRDGDRDEMLHTRTPAAMPLRVAASRSHRDARTAAALERMGEIDVVAQGSSLKFCRIAEGDLDVYPRFGPTSEWDTAAGQCVLHAAGGVLLAGASGKPFRYNRRDTLLNGDFIALGDPNLPWRDWLA

SEQ ID NO: 29855 - protein, 559 aa, Burkholderia xenovorans LB400
MISIRNVTLRRGVNVVLDRASVTFTPGEKIGLVGRNGAGKSSFFGLLNGTLHEDGGEFSIPAAWKMGQVAQEMPETGQSATDFVIEGDTVLLAAQAEVAAAEASDDGMRMAHAYMALHDAGAHDAPARAQALILGLGFSAAQLSQPVNSFSGGWRMRLQLARALMCPSDLLLLDEPTNHLDLDALVWLEAWLKRYQGTLVVISHDREFLDAVTQVTVHVDNAKLVRYGGNYSKFEEMRAEQLVLQQAAMARQADKIAHLQKFIDRFKAKASKAKQAQSRVKALERMEKIAPVLADAEFTFEFKEPLNVPNPLLSMLDASFGYPAPAGAPPGTPPTVIVRGINRSVLAGQRIGILGANGQGKSTLVKTVAHELAPITGEISEGKGLNIGYFAQQELDVLRPLDTPLEHMIRLAKDTPAHMRAPGQSGTEQSLRTFLGTFSFSGDMVHQAVGTMSGGEKARLVLCMIVWQRPNLLLLDEPTNHLDLATREALGMALNEFEGTVLLVSHDRSLLRAVCDEFWLVTKGGVEPFDGDLDDYQEFLRDEARRMREQAAVEQKAIA

SEQ ID NO: 29856 - protein, 391 aa, Physcomitrella patens subsp. patens
MGIIGTLVKHPDEIPPLIKLKIAAHRAQKAIPKDPNLAFCYRMLTRVSRSFSIVIQQLSPELRDAVCVFYLVLRGLDTVEDDMAIPIDIKVPILKAFHKHIYDPSWKFSCGEKDYKELMNKFELVSNAFLNLEEGYQKVIAEMTERMGNGMAKFIESEVSTVDDYDEYCHYVAGIVGLGLTRLFHASGLEAFKPDDLSNSMGLFLQKTNIIRDYLEDINEIPAPRMFWPHEVWGKYATKLEDFKHEDNSQNALRCLNALITNALAHATDCLKYMEDINQEDNLRFCAIPQIMAIATLAECYNNINVFRGVVKIRRGITAKIMQTRTMGDVYGTFFDFSKKIAAKIDDNDDSASVTRKHIEDIQEYCESHLLEPEKSYIQNYSLYRSCGLQK

SEQ ID NO: 29857 - protein, 485 aa, Trichodesmium erythraeum IMS101
MDENYLSWENKVKSFFDCDALNFQITNRFGEQIKYINLDNAATTTPLAGVKQYVDHMLNAYGSVHRGAGQKSQISTQKYDQSRDIIRKFVGASPENYVIFAQNTTGAINQAASLWAKRPGKILVSDIEHSSNLLPWLTCNNVTQYRTAPDGTINLAEIEKILKENKEKPAEKRIKLVTITGASTITGYKPPIYEIAKLAHNYGAKIFADLCQLIQHECVEMLPDADPCHLDFVAFSGHKMYAPYGTGVLIGPKEFFDRDFPYQIGGGNLPYITKKLEIKRFYTERAHDPGTPNAMGAIAIAQAIEVLEKIGREKIAEYEHFLVDYTFQKLQNIPGVILYISGSSLAHVIPFDLEGFDGYLVAEILAQEYGIGLRSGAFCTYEYIRKLKNISDQKDQEIAQEVERGITCNIPTIIRASFAVYNTLADCNSFVEAISQITANGFKHYLSDYEKNEITGVWKLKENTPISIARKQINRGQTLLGTCIE

SEQ ID NO: 29858 - protein, 488 aa, Synechococcus sp. WH 7803
MTTPLIPVILCGGTGTRLWPLSRASYPKQYWPLGGSGDETLLQQTQQRLDGLEGLAPPLLICNDDHRFIVAEQMRQIEVEPGAILLEPMGRNTAPAVAVAALQATARGEDPLLLVLAADHVIRDGEHFRAAIAAGRSAAEAGRLVTFGIVPTAPETGYGYIEAAEPLQPGALTPVPIARFVEKPDRATAEQFLASGRFTWNSGMFLFKASAMLAELERLAPEVVSCCRAALEQDVADLDFLRLEREAFAKCPSVAIDVAVMEKTELGSVLPLAAGWSDVGSWSALWDTADRDDDGNVLRGRVISEGSRNCYLRSEHRLVVGLGVENLVVVETDDAVLIADRSQAQNVKTIVKQLEADGSPEGKAHRKIYRPWGHYTGVVEDSRWQVKRISVKPGASLSLQMHHHRAEHWIVVKGTALVERDGDQQLIGENQSTYIPLGCRHRLTNPGRIPVELIEVQSGAYLGEDDIVRFDDVYGRSDAAARAALTPQ

SEQ ID NO: 29859 - protein, 438 aa, Ashbya gossypii ATCC 10895
MIMASVSESNCVGNLSSHTHAKDKSQLADDIRITTFPGESRPIAIQWGAKALSDRGPVVASRRGEGFSKHNAIGAYAGSYCIYQALAVGAKAVQADHIADYSMSEPMFHLPPQQAWFNKDEIVSMDPLGHLAPALFGRIAQDEQVEVRPTVAITKATMQVPEIREAVVLGRLPVDGKIVANKNGDLRVSKIAVEQVWYLPGIAKRFGMSEEELRTTLFEHTNGMYPELVTRPDLKVFLPPIGGLTVYIFGNPLDVSDPAKKLTLRVHDECNGSDVFGSDICTCRPYLIFAIEEGVKQAQAGGSGVVIYFRKEGRALGEVTKYLVYNARKRSGDHAAEYFKRTERIAGTEDMRFQQLMPDVLKWLGVTKVDRLISMSHMKYNAIADCGIKVLERVPIPSELIPADSHVEIEAKVHSGYFTHDKVPSVTDLRRCKGKQWF

SEQ ID NO: 29860 - protein, 233 aa, Bifidobacterium animalis
MASEEAQFVARAERLAGPAGIAGFQPAAARDRALAAQNRYVVPEFTERTPYGMKTQNPYTRLFDDRIIFLGVQVDDTSADDIMAQLLVLESMDPNRDVMMYINSPGGSMTAMTAIYDTMQYIKPDVQTVCLGQAASAAAIILAAGTKGKRLMLPNARVLIHQPAIDQGFGKATDIEIQAKEMMRMREWLENTLAKHTGQSRERISRDIEVDTFLTASEAKEYGIVDEVLEHRS

SEQ ID NO: 29861 - protein, 394 aa, Onion yellows phytoplasma OY-M
MGDQVKEGDVLVKVETDKLDVELTSPVAGKILKRDLNEGEVICVGDTIVLIQEPGDTDADVKKFSSQNPNETAATEKNDTQQAQTSAQTSLPPQKVLATPLVKSLAKELGLDLSTIKGTGVNGKILKVDVQNATNPLQTQPQPTTPFVQEEQIPTPTFATSSQETEVVKISRLRKAIAQKMVLSKGKIPETTLMDEVNITALVTLRKQAKDQAQSQGIKLTFMAFIMKAVAIALQEFPLFNASYDDVKEEVTYKKFINLGVAVDTKDGLIVPNIKDANKLTLLEMAQQLQQVAKATTERKVELNQLQNGTFTITNFGSIDITYGTPVINYPELAILGVGKITKKPVVENSQIVIADMLPLSLAIDHRIIDGADGGRFLKRVKELLNTPTLLLLS

SEQ ID NO: 29862 - protein, 374 aa, Ashbya gossypii ATCC 10895
MILEANDSLFGPLFKRHSHSHSEEPEECPTENEYDGSDGIRILSVFIILLASAIGTFFPMLGSRFSRVRLPTWAFFFAKYFGSGVIVATGFIHLLLHGHESLSNPCLGGVLSEYPWAFAICMMSLFTLFFVEINSHHFVNKAARSTAVAVAGDEKSIKEDESTEDTPPKPNTAVSGANSAVVSQHFAHDECHQDLEQAKSLAADPNREQYLNQLISLFILEFGVVFHSVLIGLSLAVTAEDHFTTLFVVLIFHQMFEGMGLGARIAETEWGVHRKWTPWLLGLGYCLSTPIAIAIGLGVRHSFAPESRPSLIVNGVFDSLSAGIMLYTGLIELMAHEFLFSNSFKGEGGFNKMMQGFVYMCLGAGLMALLGKWA

SEQ ID NO: 29863 - protein, 457 aa, Onion yellows phytoplasma OY-M
MKNYDVLVIGGGPGGYVAAIKAAQMGAKVALVEKHKLGGICLNYGCIPTKAYLKSAKMYKDIKRCADFGIKVQNGVSFDWSSILSRKNKIVAQLTTGISFLLKKNKIDFYHGFASVLSPCEVQVDTNLLHTQKLIIATGSTAFVTPIPGAQEAYQKGILKTSKELLQLESYPSKVTIVGGGVIGVEFATIFNSFGSEVTILERQDNILNGMDRDVVVAYTKKLQADGIQILTQVEVTKINDNQTTYTQKGNAKTITSDVILMAVGTKANLAGLEKLNLALNRNSVQTDNFCQTSIPGVYAIGDVNGKHMLAHVASHEGIVAVTHALEQKAQPINYDRVPACIYGFPEIASIGMTEQQAKEKQMDYKVSKISLGAVGKSLADGEKEGFAKLIVCKKHLEILGMHIYAYNATELISEMAVGMELEGTAYELSQAIHPHPTLSELTFEALLGAVDKPIHA

SEQ ID NO: 29864 - protein, 286 aa, Arabidopsis thaliana
MEGKEEDVRVGANKFPERQPIGTSAQSDKDYKEPPPAPLLEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 29865 - protein, 118 aa, Glycine max
  misc_feature (13)..(13): Xaa can be any naturally occurring amino acid
  misc_feature (73)..(73): Xaa can be any naturally occurring amino acid
VVVIYCAICFLYXRLNNHVPLPTRVKNKKANPNIGSMESLKLLESSKYIRNLATIEVVYRIMMNLGEVPCMSXLNAQFPSPNEHSCFMGDSHTASGIDTFTSDVDNQPRFYTDRCESC

SEQ ID NO: 29866 - protein, 361 aa, Kluyveromyces lactis NRRL Y-1140
MLRQGIAAQKKSFATLAAEQLLPKKYGGRYTVTLIPGDGVGKEVTDSVVKIFENENIPIDWETIDISGLENTENVQRAVESLKRNKVGLKGIWHTPADQTGHGSLNVALRKQLDIFANVALFKSIPGVKTRLNNIDMVIIRENTEGEYSGLEHESVPGVVESLKIMTRAKSERIARFAFDFALKNNRKSVCAVHKANIMKLGDGLFRNTVNEIGANEYPELDVKNIIVDNASMQAVAKPHQFDVLVTPNLYGSILGNIGSALIGGPGLVPGANFGREYAVFEPGSRHVGLDIKGQNVANPTAMILSSTLMLRHLGLNAYADRISKATYDVISEGKSTTRDIGGSASTSEFTNAVIEKLAKL

SEQ ID NO: 29867 - protein, 139 aa, unidentified eubacterium SCB49
MRTDRTFTMLKPDSVEKGHIGAILEKINAAGFRIVALKKTQMTTADAQAFYAVHNERPFFGELVEYMTRGPIVAAILEKDNAVEDFRTLIGATNPADAAEGTIRKLYAASIGENAVHGSDSDENAAIEGAFHFSGREMF

SEQ ID NO: 29868 - protein, 326 aa, Mycobacterium tuberculosis H37Rv
MSHDWTDNRKNLMLFAGRAHPELAEQVAKELDVHVTSQDAREFANGEIFVRFHESVRGCDAFVLQSCPAPVNRWLMEQLIMIDALKRGSAKRITAVMPFYPYARQDKKHRGREPISARLIADLLKTAGADRIVTVDLHTDQIQGFFDGPVDHMRGQNLLTGYIRDNYPDGNMVVVSPDSGRVRIAEKWADALGGVPLAFIHKTRDPRVPNQVVSNRVVGDVAGRTCVLIDDMIDTGGTIAGAVALLHNDGAGDVIIAATHGVLSDPAAQRLASCGAREVIVTNTLPIGEDKRFPQLTVLSIAPLLASTIRAVFENGSVTGLFDGDA

SEQ ID NO: 29869 - protein, 272 aa, Triticum aestivum
MGGLSMEHPWAFAFGLLGNVISFSSLLAPIPTFYRIFKSKSTEGFQSVPYVVALFSAMLWIFYALVKTGEGLLISINAAGCVIETVYIVMYLVYADRKAKIFTAKIVVLLNIAGFGLIFLLTLFAFHGETRVVSLGWICVGFSVCVFVAPLSIIGRVIKTKSVEYMPFTLSLTLTLSAIVWFLYGLLIKDKYVALPNILGFTFGVIQMVLYVFYMNKTPVASEVKEGKEAWKAPAEDHVVVINVGKADKSSCAEVRPVTEMAGAVDVPEMRC

SEQ ID NO: 29870 - protein, 236 aa, Catharanthus roseus
MAMATSFYCSTAIPSKKTNQNRENFLCSPVGGSKTTPSYIRLSTRQSRTLSLVVSAAASGAAVEAEPKFAAVTPSKILSFRVGHGFDLHRLEPGYPLIIGGINIPHDRGCEAHSDGDVLLHCVVDAILGALGLPDIGQIFPDTDPKWKGAPSSVFIKEAVRLMDEAGYELGNLDATLILQRPKVSPHKEAIRQNLCQLLGADPCVVNLKAKTHEKVDSLGENRSIAAHTVVLLMRK

SEQ ID NO: 29871 - protein, 416 aa, Triticum aestivum
  misc_feature (72)..(72): Xaa can be any naturally occurring amino acid
SKNPDPPPPHTSQKEKEKSRLALRHGRRLPPRARPLHLPAPPALAPAPAPPRPAPPPPLAAPRPRPLPAPPXHPASPIPPCHAAAEPAARPPPHPLLDALRRSLLDSLAALRKPALALLLAGALLAAAAPQHAALAASGGRVGGSAFSSRSSRSSPSPSYGYAAPAPRMGGGGYSSAPFYSPSPFVSVGPAFGIGFGGSGFLLTLVGFAAFLYLGGFLTDSSGGGSVLTDTQKTTVLKLQVGLLGMARSFQKELDQIAEKADTSTPAGLSFVLTETTLALLRHPDCCISAYSTVDVKRSMDDGEKRFNQLSIEERGKFDEETLVNVNSIKRQKAGTQRSSGFSNEYIVITILVAAEGVYKLPTINSSSDLKTALQMLGGVPSSKIMAVEVLWTPQNENDTLSERELLEDYPLLRPL

SEQ ID NO: 29872 - protein, 399 aa, Bacillus anthracis str. Ames
MRSEVTVKIKPKFIKEIKSGYPLILKDAIQNLNDVQEEGTIIKVVDEKNHFVGKGYYGKQNKGYGWILTRKESEQINQSFFESKIKSALHKRKQFYKSSDTTAFRALNGEGDGLGGLIIDYYDGYYVVSWYSEGIYTFRDEIIAALQKVANFKGIYEKKRFDTKGKYIEGDDFVAGERGEFPLIVKENGVNFAVYLNDGAMVGVFLDQRNVRKQIRDKYAKGRTVLNMFSYTGAFSVFAALGGASKTTSVDLANRSLSKTIEQFSVNEIDYEAQDIIVEDVFLYFKYAAKKKMKFDMVVLDPPSFARSKKYTFSAAKDYKNLLKETIAITENNGIIVASTNCSAFDMKKFKGFIDTAFKEMNGKYKVLEEHSLPEDFRTIDQFKEGDYLKVVFIEKIKG

SEQ ID NO: 29873 - protein, 596 aa, Bacillus anthracis str. Ames
MVESLLLSIVIIITLGIASQWTAWRFQLPAIVVMAVAGLLIGPVFGIINPKEVLGDVFSPLVSLSVAIILFEGSLSLDIRELRGLSKPVFRIVTFGAFIAWIAGSLAAHYVAGLDWAVAFIIGGLFIVTGPTVIIPLLRQARLKPRTAAILKWEGIIVDPFGALLAVFAFQIVNFLTKENVQLHTLLYFFAGSLFAMVLGYIFSIFMSYMILKGKVPEYLKAPILLVTVLLCFGIADEVMHETGMLAVTVMGITLARMKKYISSIGDIRHFNENISVLLTSTVFIILTASLPRTTIMEIFSWPIISFVLMMLFVVRPLSIWISTIGTELTKAERALVGWIAPRGIVALTVSSYFATELLQEGYKDASILTALTFALVITTVCAHGFSIGFLAKRLGLANTEPPGILISGASTFSSAFALHCKEMGVPSLIVDVSEEHLQCAKVKGLNTYNGQVLSEQLQFEVDMNQYEYLIAVTDTDSYNVLVANTYVPQFGHHNTFLLPIHDVEKIEQERISLSKKAHLLFGQNEIYEELNRKIEDGYTFKTIQVAEEQKINKEEINSEDLILFIRHRDGSLTFSTLYKYIAVMPGDELVVLAKQ

SEQ ID NO: 29874 - protein, 103 aa, Brassica napus
  misc_feature (66)..(66): Xaa can be any naturally occurring amino acid
  misc_feature (74)..(74): Xaa can be any naturally occurring amino acid
  misc_feature (78)..(78): Xaa can be any naturally occurring amino acid
  misc_feature (80)..(80): Xaa can be any naturally occurring amino acid
  misc_feature (84)..(84): Xaa can be any naturally occurring amino acid
  misc_feature (97)..(97): Xaa can be any naturally occurring amino acid
KLQFSPSLRRESRLIPSRSSSSFRRMESSPASSSSQTPVTASETDSLAKDLQNQNLGASADEGGAXIKRKLEDXNWNXPXAKEXPGDPRSDVTSREXACKPHT

SEQ ID NO: 29875 - protein, 349 aa, Burkholderia xenovorans LB400
MQWRIDLKAIRIVNYGGPEVLLRQNIPIPAPGPADVLIKVAFAGINFMDVHTRQGKYAKSTTYPVRLPVTLGMEGAGEVVAVGREVTSFVPGDRVAWCIAWGSYAELAVVPAARVARIPDAVGFDLAAAAIFQGSTAHYLCHDVGQLAPGRTCLIHAASGSIGQLLVQMGKRAGATIFATASSEQKAEVVRRLGADHVVLYDNGRFADAVREATGGKGVDVVFDPVGKVTLRDSFRATRTRGLVVNYGSVSGSLSDLDPIELGESGSLYLTRPRLADHLADAQSVQRRADDVFTALLDGSLSVSIQGSYSLDDVEDAHAALEERRQIGKAVLDLGKPLKKDYVLASDSA

SEQ ID NO: 29876 - protein, 268 aa, Brassica napus
MYAVTPPHRSDLGSNYGLRVYQTWKGSHIFCLQGRFIFGPDARSLGLTISLIVVPVIVFCIFVASKLMDDFSDTWGLSIVSVAVVFTIYDIILLMLTSGRDPGIIPRNSHPPEPEVIDGNSGTSQTPRLPRVKEVEVNGNIFKVKYCDTCMLYRPPRCSHCSICNNCVERFDHHCPWVGQCIAQRNYRFFFMFVFSTTLLCVYVLAFCCVYIRKIKKSEDITIWKAMLKTPASIALIIYTFICMWFVGGLTCFHLYLISTNQTTYENF

SEQ ID NO: 29877 - protein, 926 aa, Vitis vinifera
  misc_feature (338)..(338): Xaa can be any naturally occurring amino acid
  misc_feature (463)..(463): Xaa can be any naturally occurring amino acid
  misc_feature (482)..(482): Xaa can be any naturally occurring amino acid
  misc_feature (708)..(708): Xaa can be any naturally occurring amino acid
MGEPFTIQISSKLINQLADGGEKLKKKTKKPRQKLPGGRLQSQTKVPEKQVFDDSETRKGTAAAGWPPQSLLYMPVSTPQPAIRELDAIRSVLQDSERVLERLKTQEEHMVQEVTQRAKDLHDKEFKLPYQKPIPCLAERDACLECYKENVNDALKCANVGKAYGFLDYAIDEINSPFLTIGYGHYLVHHVIALGLYGTMLIYVKGALDASVSKLMLDKKDFSCSFLLILPDKVVCPLGAHGMSFIYLHPIHLIMVRGRDACWEHCVLVDATRQKVRCNYCHREFSGGVYRMKFHLAQIKNKDIVSCTEVPNDVRDQIQSILSTPKKQKTPKKTKVDXAANGQQNSSSASGDFHPNHGSSGQHGSTCPLLFPRPSPSEQPAVDDEQKQKQDDADKKVAVFFFHNSVPFSAAKSMYYQEMVDAIAECGVGYKAPSYEKLRSTLMEKVKCDVNDCCKKLRDGWRXTGCTILCDCWSDGRTKSLXVFSVTCPKGTLFLKSVDISGHADDAHYLFELLESVVLEVGLENVVQVITDSAASYVYAGRLLMAKYTTLFWSPCASFCIDKMLEDISKQEWVSTVLEEANTITHYIYSHAWILNMMRKFTGGRELIRPRITRFVTNFLSLRSIVVQEDNLKLMFSHMDWMSSVYSRRPDAQNVKSLLYLERFWKSAHEAVSVSEPLVKVLRIVDGDMPAMGYIYEGIERAKIAIKXYYNSIEEKYMPIWDIIDRRWNVQLHSPLHAAAAFLNPSIFYGPNFKVDLRMRNGFQEAMRKMATEDRDKIEITKEHPIYINAQGALGTEFAIMGRTLNAAGDWWAGYGYEIPTLQRAAIRILSQPCSSHWCGWNWSSFEALHTKKRNRMELEKLNDLVLVHCNLHLQAIIQSRDGKCKPIIFDEIDVGSEWPTEMESPSPLLDDSWLDNLPLECKGSP

SEQ ID NO: 29878 - protein, 153 aa, Physcomitrella patens subsp. patens
ASTPVGNKRLDAAYQEALTKCNGDTKSYPVFLFFSVNASGQFCGMAQMTGRVDFSKSVDYWQQDKWNGRFPVTWHIIKDIPNCQFRHIILENNDNKPVTNSRDTQEVKFEQGMAMLNIFKIFASKTSILDDFEFYENRQRALTEKRARQHAQQ

SEQ ID NO: 29879 - protein, 326 aa, Picea sitchensis
MSNPTRATDLPVVVVGSANADIYVEIDRLPKEGETIAARGGQTLAGGKGANQAACAGRLSHPTYFVGQVGKDAHGSLMKDALSSCGVRLDYLNTVSDPTGHAVVMLQPGGQNSIIIVGGANVSWPILEDGMSCLSANAQQIIREAGIVLLQREVPNSLNLEVAKIARSANVPVILDAGGMEGPIPENLLKCIDIFSPNETELERLTGASTNTIDEVIEAAAKCHEMGVKQVLVKLGEKGSVLVTEGLPPILQPAILAPMVLDTTGAGDTFTAAFAVALVEGNSVAESLRFAAAAASLCIQVKGAIPSMPDRNAVLQLLKSVCSSAD

SEQ ID NO: 29880 - protein, 160 aa, Bifidobacterium longum bv. Suis
MASEEAKFAARADRLAGRHGVAGFMPAAARAAQPAPTNRYIMPQFVEKTPYGMKTQDAYSRLFEDRIIFLGVQVDDASADDVMAQLLVLESQDPNRDVMMYINSPGGSMTAMTAIYDTMQYIKPDVQTVCLGQAASAAAILLASGTKGKRLMLPNARVLI

SEQ ID NO: 29881 - protein, 517 aa, Physcomitrella patens subsp. patens
MAVYEKLDIKGILGSLDKPIQGFSKTKIICTLGPKSRDVPMLEKLLRAGMNVARFNFSHGTYEYHSGTLDALKQAMYNTQIMCGVLLDTKGPEIRTGTLKEGQVIKLIRGQEIMITTDYKHEGDNTMIAMSYPKLAQDVKPGNLILCSDGTISLLVLECDTAGGKVKCRCENTASLGEHKNVNLPGVIVDLPTFTQRDIEDITIWGIPNRIDFIAASFVRKGIDVIRVKEILGRASKTIHIISKVENQEGLQNFDDILRETDAIMVARGDLGMEIPTEKIFLAQKMMIDKCNGKGKPVVTATQMLESMIKSPRPTRAEATDVANAVLDGTDAVMLSGETANGINPDVAVGIMARICREAEMAIDYATLFKDLCRNAPVPMSPLESLASSAVRTANKICASLIVVLTRGGTTARLVAKYRPKVPILSVAIPVMTTDSIEWTISEESPAHHSLICRGLVPLLAEGSVKATDADSSDEILNAALEYAVSRNLCKAGDSVVALHRLGNASLIKIMAVPDIY

SEQ ID NO: 29882 - protein, 159 aa, Bifidobacterium magnum
MASQEAQFIERAERLAGPRGVMGFQRAADRMPMAPQNRYVVPEFEEKTPYGYKRQNPYTRLFDDRIIWLGVQVDDTSADDIMAQLLVLESLDPNRDVMMYINSPGGSMTAMTAIYDTMQYIQPDVQTVCLGQAASAAAILLAAGTKGKRLILPNARVLI

SEQ ID NO: 29883 - protein, 365 aa, Oceanicola granulosus HTCC2516
MANPSLLILPGDGIGPEVMAEVRKVIDWFGSQGTPFDVSEDLVGGAAYDAHGTPLTDATMAKAQEVDAVLLGAVGGPKYDDLDFSVKPERGLLRLRKEMDLFANLRPAQCFDALADFSSLKKDVVAGLDIMIVRELTSGVYFGEPRGIVTENNERVGINTQRYTESEIERVARSAFELARKRGNKLCSMEKANVMESGILWREVVQRVGDEEYPDVELSHMYADAGAMQLTRWPKQFDVIVTDNLFGDLLSDLAAMLTGSLGMLPSASLGLPMANGRPKAMYEPVHGSAPDIAGQGKANPIACILSFAMALRYSFDMGEAADRVEAAVEKVLADGLRTADLLGEEGRAPVSTSDMGDAIVAALAD

SEQ ID NO: 29884 - protein, 464 aa, Synechococcus sp. WH 7803
MLAAAMPPLLMPLLGEISAHDLEMAETLIGVARFALIFVAARVLAEVLVRLQLPTILGELLAGVLIGASGLHLLVPPETQVELSNGVISLVSGLVNVPPDAVPEIYNESFPSLEAVAELGLYALLFLTGLESELEELIAVGAQAFTVAVAGVVLPFAFGTWGLMAIFHVDAIPAIFAGASMTATSIGITASVFGELGFLKTREGQIVIGAAVLDDILGIVILAVVVALASGGNLEIGPIVKLVAAAAVFVVAAIGLSRTAAPAFDWMIDKLKAPGEVLVASFVILALSCFTATAIGLEAALGAFAAGLILSSSKHNHAIQQAVLPIVTLFATIFFVLVGAGMDLSVINPSDPSSRTALVVAGFLFVVAVIGKIAAGWAFLSKQPTRRLVVGLGMMPRGEVGLIFLGLGTSAKLLSPSLEAAILLMVIGTTFLAPVLLRLVLGGNKPDDDDSVSDDVAAEPVGLL

SEQ ID NO: 29885 - protein, 160 aa, Bifidobacterium longum bv. Infantis
MASEEAKFAARADRLAGRQGVAGFMPASARAAQPAPTNRYIMPQFVEKTPYGMKTQDAYSRLFEDRIIFLGVQVDDASADDVMAQLLVLESQDPNRDVMMYINSPGGSMTAMTAIYDTMQYIKPDVQTVCLGQAASAAAILLASGTKGKRLMLPNARVLI

SEQ ID NO: 29886 - protein, 355 aa, Aeropyrum pernix K1
MVKGLILAAGEGSRLRPFTFSRPKHLIPLLGKPIIQYAIDDLVSINVRDIGVVVGYFGDKIKEFLGEDSRFGAKFTYIVQKKRLGIAHAIYRAIKQGFIDKEFIVYLGDNILSGGISRHVKSWGEAGSEVHILLTKVRDPGRFGIAVLRDGKILKLVEKPQEHISDLAVVGVYMFRDPELVAKAFSTLKPSWRGEYEITDLIQWFVDKGYKVTFSLVTGWWKDVGTYEGLLDAIYLLLDNVKPRVEGKIEGEVRGRVVVEEGAIVEGTVHGPAYIGKDVYIGRSGLVEHYVSMEQGSRIISGTVARSMILDESELYLNKARLVDSVVGPKSIIKSNREIYGDIKLVISDYSKVFL

SEQ ID NO: 29887 - protein, 426 aa, Acidobacteria bacterium Ellin345
MERNFYSIQDGPMSTYQEIVEREQQFLLGTYARYPLALQRGKGVYLFDFEGNKYLDMLSGLGVNALGHAHPRIVKVIRDQAAKVIHLSNLYYNEYQGLLAEKLCKLSGLQRAFFSNSGTEAIEGALKLVRAAGHDRGGEAKSKVVALDGSFHGRTLGALSLTGQPKYRKNFDPLPGAVQFIDRNDIEQLNAAVSDETCAIVIEPIQGEGGIRPASVEFLKAAREAATRHNAALIFDEIQCGMGRTGTMFAFQYFGVKPDVVCLAKPIAAGLPLGAFLVTEELGAAMSAGKHGTTFGGGPLASRVALEYFAILEEEHRLEQVQRVGAYFTAELQNLVDKFEIAVEQRGVGMIQALELSVPAKGFVEGAIAEGVLWNVTQENVIRFLPPFLTEEKHIDKGIKTLKKLLKATQKEAKAAKKAESAVAAQ

SEQ ID NO: 29888 - protein, 308 aa, Physcomitrella patens subsp. patens
LINGCWTLAGGHGRVVESEIIHVMEMYARSGLTSFDTADIYGPSESILGAFREQWMNNKQENDGLRDIFTKFCPNIFRMKMTPQVVEQSIRRSIAALRVPKLDLVQMHWWDYDMPGMVDVAKSLAELREKGLITSIGVTNMSTEALSQIIDAGVPVVCNQVQFSLLDQRPRMAMLKYCKERDIKLFTYGTLAGGLLSNRYLEEGKKGLFGKVNYTTPDLNTSSLKMYWRVVREAGGEGHWRKLLSTLGEIAASKEVSIASVALRWAMQQGPVHPIVGLRNSTHLDDNLTALSFSLEPAEMDKIEEVLR

SEQ ID NO: 29889 - protein, 152 aa, Bifidobacterium cuniculi
MASEEAKFVARAERLAGPGFRAAADRMPQDRYIVPEFEEKTPYGYKRQNPYTRLFDDRIIFMGVQVDDTTADDIMAQLLVLESLDPNRDVMMYINSPGGSMTAMTAIYDTMNYIQPDVQTVCLGQAASAAAILLAAGTKGKRLILPNARVLI

SEQ ID NO: 29890 - protein, 484 aa, Ralstonia eutropha JMP134
MFSLKDPGLLRQQAYVDGQWRAAESGKTLDVINPANNEPLGTIPACDAADTRAAIEAANRALPAWSALTTHQRAAVLRKWRELMVAHADDLALIMTLEQGKPLAEARGEILYGASFVEWFAEEGIRAYGETIPATHASRRIIARKVPVGVCAAITPWNFPNAMITRKLAPALAAGCAVVVKPSELTPYSALALAELGERAGIPAGVLNIVTGMPQGIGGELTANPIVRKLTFTGSTQVGKLLLRQCADTVKRVSMELGGNAPVIVFDDADLEQAVAGVMASKFRNSGQTCVCANRIYVQAGIYDRFSARLSEEVRKLKVGAGTEDGVSIGPLINDAALRKVVRHVEDAVAHGAKVIVGGASLSRGQQYFEPTVVTGATDGMLIASEETFGPVAALFPFESETEIIRRANDTPYGLAAYLFSTDVNRVFRVSEALEYGMVGANTGVISSAVAPFGGVKESGLGREGSHHGIDEFLEVQTLHLEIV

SEQ ID NO: 29891 - protein, 172 aa, Methanocaldococcus jannaschii DSM 2661
MVNIMEHRHVISALVLNKPGVLQRISGLFTRRGFNISSITVGITENPQISRVTIVVNGDDKILEQVIKQLNKLIDVIKVSELEEKKSVQRELCLIKIYAPTESAKSQVIQYTSIFRGNVVDLSPESLIVEITGSEDKINAFIDLVKPLGIKEMARTGITALARGPKILKPKS

SEQ ID NO: 29892 - protein, 375 aa, Sinorhizobium meliloti 1021
MDARAAVAIQAGKPLEVMTVQLEGPRAGEVLVEVKATGICHTDDFTLSGADPEGLFPAILGHEGAGIVIDVGPGVTSVKKGDHVIPLYTPECRACPSCLSRKTNLCTAIRATQGQGVMPDGTSRFSLNGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTRVMRQALEASHRGWGKSVIIGVAGAGQEIATRPFQLVTGRTWMGTAFGGARGRTDVPKIVDWYMEGKIAIDPMITHTMPLDDINKGFELMHSGESIRSVVLF

SEQ ID NO: 29893 - protein, 429 aa, Ralstonia eutropha JMP134
MALESTHQDLAAARAQHVARGVVTAHPIFVDHAQGSRVWDVNGRSYLDFVGGIGVLNVGHNHPRVVAAVKQQLERVSHAAFQVAGYDVYIELAARLNRLVGGSEAYKTVFLTTGAEAVENAVKIARAYRNAPGIIAFRGGFHGRTLLGMTLTGMSTPYKQNFGPFAGDVYHTPYPDPYRGFSGDDALRALDDLFATQIAPDRVAAIILELVQGDGGFLAAGSDFLKKLRALTTKHGIVLIADEIQTGFGRTGELFAFQEAGIQPDLVTVAKSLAGGLPLSGVVGRAEIMDAPLPGGLGGTYAGNPLACAAALAVLDLFEDEKLTERARELGTTLRGGLLALADKYQEIGTIRGVGPMLALEFVKHGDPHQPDADFAQRVVDACRDEGLLVIKCGVHRNNVRLLAPVNTELDDAHEAIAILGRAIAKVRG

SEQ ID NO: 29894 - protein, 59 aa, Arabidopsis thaliana
  misc_feature (44)..(44): Xaa can be any naturally occurring amino acid
KKFSSIFIHMLIVFLLLWTFHSRIESAPPYHHELFLGKKRVKYXKPHSAIGTSSSTSDH

SEQ ID NO: 29895 - protein, 466 aa, Yersinia pestis CO92
MQQHFHFDAIVIGSGPGGEGAAMGLVKQGARVAVIERYNNVGGGCTHWGTIPSKALRHAVSRIIEFNQNPLYSDNARTIKSSFADILNHADRVINQQTRMRQGFYDRNHCHMFSGDASFIDANTVNVRYADGTSDTLQADNIVIATGSRPYRPVNVDFNHERIYDSDTILQLSHEPQHVIIYGAGVIGCEYASIFRGLSVKVDLINTRDRLLAFLDQEMSDALSYHFWNNGVVIRHNEEFEQIEGTTDGVIVHLKSGKKVKADCLLYANGRTGNTSGLGLENIGLEADSRGLLKVNSMYQTALSHVYAVGDVIGYPSLASAAYDQGRIAAQAMIKGEANVHLIEDIPTGIYTIPEISSVGKTEQELTAMKVPYEVGRAQFKHLARAQIVGMDTGSLKILFHRETKQILGIHCFGERAAEIIHIGQAIMEQKGEGNTLEYFVNTTFNYPTMAEAYRVAALNGLNRLF

SEQ ID NO: 29896 - protein, 429 aa, Mycobacterium tuberculosis H37Rv
MPIIEQVRAREILDSRGNPTVEVEVALIDGTFARAAVPSGASTGEHEAVELRDGGDRYGGKGVQKAVQAVLDEIGPAVIGLNADDQRLVDQALVDLDGTPDKSRLGGNAILGVSLAVAKAAADSAELPLFRYVGGPNAHILPVPMMNILNGGAHADTAVDIQEFMVAPIGAPSFVEALRWGAEVYHALKSVLKKEGLSTGLGDEGGFAPDVAGTTAALDLISRAIESAGLRPGADVALALDAAATEFFTDGTGYVFEGTTRTADQMTEFYAGLLGAYPLVSIEDPLSEDDWDGWAALTASIGDRVQIVGDDIFVTNPERLEEGIERGVANALLVKVNQIGTLTETLDAVTLAHHGGYRTMISHRSGETEDTMIADLAVAIGSGQIKTGAPARSERVAKYNQLLRIEEALGDAARYAGDLAFPRFACETK

SEQ ID NO: 29897 - protein, 149 aa, Prototheca wickerhamii
RKAVATGTSRGLAANPSSSNPAPFPVGMSTILRSTLTAANAEAGPSSMLQMSTGFRPISRVAYQGAPGAYSEMAALKALPNWEPMPCEQFEVAFQALSQWLAERAVLPVENSLGGSIHDVYDLLLHYRLHIVGEVSVVVNHCLLALPGV

SEQ ID NO: 29898 - protein, 243 aa, Yersinia pestis CO92
MFTSQEGKKVPQVTFHTRQGDQWIDVTTDDLFSNKTVIVFSLPGAFTPTCSSSHLPRYNELAGVFKQHGVDSILCVSVNDTFVMNAWKSDQHAENITFVPDGNGEFTKGMNMLVEKADLGFGPRSWRYSMLVRNGVVEKMFVEPNKPGDPFEVSDADTMLKYLAPDFKVQESVAVFTKPGCPFCAKAKQMLQDHGLQYEEIVLGKDATTVSLRAVSGRSTVPQIFIGGRHIGGSDDLEKYLPA

SEQ ID NO: 29899 - protein, 158 aa, Opitutaceae bacterium TAV2
MAIATGTKAPDFSLKSKTADGLTDIKLSNYLGKSQVVILFFPLAFTGVCTTEMCDVSGGLTAYEDLGAKVIAISVDSPFAQEAWAKANRIGLTLASDLNKTTAAAYGTLLADLNGLGSVSARAAFVIGKDGIVKYAEQTPTPKDLPNFAAIKAALAAA

SEQ ID NO: 29900 - protein, 192 aa, Prototheca wickerhamii
RPLRVTMQLTGAICQGAVVARPSSRLAFHAAHAPRCLTTPPRVHGTRVPARAASAVARASSETTDSPATSASEGEGYDVYVYEAEPLEEGVSKHTLNVFVGDEAGMINRVAGVFARRGANIESLAVGLTQDKALFTIVATGTDATVANLCKQLAKLVNVRYVEDITSSEHIQRELFIAKVAAPPGVTRTEIQ

SEQ ID NO: 29901 - protein, 2259 aa, Aspergillus nidulans FGSC A4
MSGSDVDHVSGLVDAGLSQSRRLSSSSTAECFYDALSDNGSHNPSLTLPSSRPSSSRSGTTYTTKQGASGPQSFALPATVVPNGSPNRHQRSSPDPDEYYRSHSPTLPLETATRIRAESASLPGASNPAADGRAVYTTQRVPSGPVHLPGLSSVERGQYRSVSDTSLQGRFDFPTGPASVRPLAVRSKQTSFKDLVNKFNNNVDQVLPFPSASASASRDHSRASSPAPGDHIIQSGTASRRRDTGTSIAQKQRASRRDSEGDAGQVFSTQIISPSSNTTGLSNSSLNDHQPSNLLPRRRLFGELLTVDTDFQGYGIPSHLRRRGSDGSIPSPNPVLFDQFDQSSNQTPLTPTAWYLGRTPFLEAVSTGESSGRHRRTRSDIPRNSPVGASTHPSDFHMAVSGPLQPGSRTYSTSPHSKSRIPLYSHRLNSPSASKESSPSPEAQSPINGRSNTQVPFPPKGLSRLPKPSPKSPRDLVSQGKSKFSTTTTTTPTRGRREIGYGRSRVKLSEKSPQLEAYIAAPPPKKSPPLRSSRPRQPVSHTAPSASKSRVGETVSNLQKQIYRERELRNSRPRERRLPELGNVDFATRRQKIQQAFNRTVKENERREEEAAELRRRASEIESISKHKDNLSSDTKPIENKEAATVPAVQPDDTATVIEDSVEPCGEEPPDIGDVEAFPELHIDTDAPDHGPPALMMDSPTLGQSNLPQMEEEDSKPSVLPPPSSATSCSEDSPVTNFDPEPQAEIAQQDVHTSHRTLLNEIMRIRESSPSSSSCDEQEYGFSDNDDKESIPILLRDKLSFENLTSRTGPLEAQHNQTAGDISNRWSMSSWSSSLRNQHSTDGQCDGSGDEISQMQQSVEDSELATQSCSASSITQSDTGPHVTGSIAHDFGPERRQDNASSRKSFGHSKTPSLAKLGGWDSRKITQLYLEELARGRDHSLPLDVRASPEPRFSIHDLRADGRTDSLTDEPVLVSSVDEISGPDRLSHTASLVLRDDWEHASPSIMDWMQIAADDAPVPQDQSADISPQNDSAQTPTLVTSNRQASCIEDGNTGLGLAINIQSPQEPATHEFSISLPRHDSSLPASKTQVDGNITQQSLERSRSIRLGQQPVITQETACFVPLDPVHSTGSSQDSLARHDPSPSPQARDSSATSLVPSSSEQLRTSTSSPSPDQRRLKKRRHVIKELVDTEYTFGRDMKVVDDIYKGTSSSCLDLSAEDIKILFANSDQIVHFSMTFQDALKEAAKSVYVMPKSQRWSSKRSGRNSHVSKNDSESIEGAGPSDLEKDRATSIGQGFLNHISQMEKVYTEYLKNHDAANKKLQTLQRSANVTIWLNECREWASDLTSAWDLDSLLVKPVQRILKYPLLISELLDSTPPDHPDHASLVKALEEVTNISVRINELKRRADVVGQVVGRKRKESDVRMGFSKAFGRRTEKLRQQVGLSDMVADKDYDALAQRFGDNFFQLQVVMRDAEMYTRETQASLDRFSEFVTAIEAFIDVSHTSYPELEGKWRVFKISVQDIMAATLPEHLDVVRKSVIDPMVTLLKLHEGPQRVMKKRDKRLMDYARFKSIKARGDKPDKKTAEQADQFVALNETLKDELPKLYSLTARLMEACLKNFVQIQTTWYIVLQKKIGPLIDTFPEEVQKIVDDWTTRFDFSEARALSLGICNGSLLADTVNLVNFNTPSTAPGVSSPRRPSTVHSTSTRAMDESPKVSHDFNASNQSFQSPIMDAQSQVSFGRHRADSAFSTRIASETPDLLITQVLQQGNNASTSSVPSPQSQTESFPRLPSISLDTPFLADVIPLANNDNAADENRPSSSAGRYSGFFSSAMPMSDSSQEIAESEANVVKEPTVLFLAASIYEFNIDRARREAGYPYLTYVAGEIFDVIAEKDVECASLQSSHSATGDVLWVPHFPQSGTSLIAVRLSQAANALLSFPSFQLFSTAHAQPVARGYSSLQFTIFSHPMNYSQLGLVIAISDSGRHFYPTSLSTYLFTQADNLNTGALSTTNKMRDGGLGKLQKRMRRFGDTLNPDDAYLSLTRGDLQSLKDDWLTDNIISFWEEYLEREFLTEYKSSNIVLLRPSMSFMILQTPNPHSLRDALPDFTRTTHVFLPINDCRNVTEAEGGTHWSLLLISIVDGVAFHYDSLPPGNYWEAKTVTMKFGALLNRPIRFVNLDDSPTQENGSDCGVFVCLSMRHLLLKRLLRANSNEKVSMSLGGWKVDARLGRKEIAKIIEGFRKEGERRRSYVSKLPCFFCSR

SEQ ID NO: 29902 - protein, 419 aa, Gloeobacter violaceus PCC 7421
MIREVTMPALSSTMTEGKIVTWKKQEGDAVSRSDILLVVESDKADMDVESFDEGILANILVSDGGSAPVGSVIALIAETEAEVAEAKKRPPSGTAAAPPATVPTPAPAPSAPAPVAAATTPVSSGSNGGRIVASPNARRLAEQLGVDLASITGSGPGGRIVGEDVERAAAGAKAPAPAPAAKPASAPAPLPAAAASGQPVAFSALQQAVNRNMEAALAIPAFRVGYTITTDAFDELHKSVKSKGVTVTTMLVKAVAITLAKHPLLFAAYTESGLRYHSAVNVAVAVAMEEGGLITPVLRAADSKDLYTLAREWKDLVERARLKKLQPEEYTSGNFTLSNLGMFGVDRFDAIVPPGTSAILAIGAAKPTVVVTEAGHIAIQKQMQVNLSGDHRVFYGTDGARFLQDLAKLIEQSPQQLTL

SEQ ID NO: 29903 - protein, 478 aa, Gloeobacter violaceus PCC 7421
MVTTTAKNVGYITQIIGPVVDAEFPEGDLPAIYNALLIEGKTDSGLDIRLTCEVQQLLGDKKVRAVSMSTTDGMVRGMKAIDTGAPITVPVGKSTLGRIFNVLGEPIDELGPVEIVDKFSIHRSAPKFTDLVTQPEIFETGIKVIDLLAPYRKGGKIGLFGGAGVGKTVLIQELIHNIAKEHSGVSVFGGVGERTREGNDLYNEFKESNVLGQVALVYGQMNEPPGARMRVGLTALTMAEYFRDVSKQDVLLFIDNIFRFVQAGSEVSALLGRMPSAVGYQPTLGTEMGDLQERITSTNEGSITSVQAVYVPADDLTDPAPATTFAHLDATTVLSRQLASLGIYPAVDPLSSTSTMLQPAVVGEEHYNIARGVQSTLQRYKDLQDIIAILGLDELSPEDKLVVNRARKLQRFLSQPFHVAEIFTGSPGKYVSLDKTIAGFKRVLQGEFDDLPEQAFYLVGDLDEALEKAKKLKDEGKS

SEQ ID NO: 29904 - protein, 416 aa, Saccharomyces cerevisiae
  misc_feature (21)..(21): Xaa can be any naturally occurring amino acid
  misc_feature (109)..(109): Xaa can be any naturally occurring amino acid
  misc_feature (189)..(189): Xaa can be any naturally occurring amino acid
  misc_feature (199)..(199): Xaa can be any naturally occurring amino acid
  misc_feature (212)..(212): Xaa can be any naturally occurring amino acid
  misc_feature (232)..(232): Xaa can be any naturally occurring amino acid
  misc_feature (257)..(257): Xaa can be any naturally occurring amino acid
  misc_feature (274)..(275): Xaa can be any naturally occurring amino acid
  misc_feature (294)..(294): Xaa can be any naturally occurring amino acid
MGSSHHHHHHSSGLVPRGSHXTVYTASVTAPVNIATLKYWGKRDTKLNLPTNSSISVTLSQDDLRTLTSAATAPEFERDTLWLNGEPHSIDNERTQNCLRDLRQLRKEXESKDASLPTLSQWKLHIVSENNFPTAAGLASSAAGFAALVSAIAKLYQLPQSTSEISRIARKGSGSACRSLFGGYVAWEXGKAEDGHDSXAVQIADSSDWPQXKACVLVVSDIKKDVSSTQGXQLTVATSELFKERIEHVVPKRFEVXRKAIVEKDFATFAKETXXDSNSFHATCLDSFPPIFYXNDTSKRIISWCHTINQFYGETIVAYTFDAGPNAVLYYLAENESKLFAFIYKLFGSVPGWDKKFTTEQLEAFNHQFESSNFTARELDLELQKDVARVILTQVGSGPQETNESLIDAKTGLPKE

SEQ ID NO: 29905 - protein, 499 aa, Populus tremula x Populus alba
MVLSKTASESDVSVHSTFASRYVRASLPRFKMPENSIPKEAAFQIINDELMLDGNPRLNLASFVTTWMEPECDKLIIASINKNYVDMDEYPVTTELQNRCVNMIAHLFNAPLGDSETAVGVGTVGSSEAIMLAGLAFKRKWQNKRKAEGKPYDKPNIVTGANVQVCWEKFARYFEVELKEVKLSDGYYVMDPEKAVQMVDENTICVAAILGSTLNGEFEDVKLLNDLLVEKNKSTGWDTPIHVDAASGGFIAPFIYPELEWDFRLPLVKSINVSGHKYGLVYAGIGWVIWRNKEDLPEELIFHINYLGADQPTFTLNFSKGSSQVIAQYYQLIRLGYEGYKNVMENCRDNMLVLKQGLEKTGKFNIVSKDKGVPLVAFSLKDNSLHNEFEVSDMLRRFGWIVPAYTMPPDAQHVTVLRVVIREDFSRTLAERLVIDIGKVLHELETLPSRISAKIVLANEEKDAVAAGKEKKDVQNETREIITAWRKLVVQRKKLNGVC

SEQ ID NO: 29906 - protein, 320 aa, Oryza sativa Japonica Group
MSGRRDDSAKMAKLKELLHRSENCICADCSAPDPKWASANIGVFICLKCSGVHRSLGTHISKVLSVTLDQWSDNEIDNVIEVGGNSHANAIYEAFLPQNHSKPHPDSTQEEREKFIRSKYELQEFLEPSLRIVSHQSSDSGKHAGSASHSVSSKSEVGMIEFIGILNVKVKGGTNLAIRDMSSSDPYVVLTLGQQKAQTSVIKANLNPVWNEELKLSVPQQYGPLKLQAFDHDMLSKDDLMGEAEIDLQPMINAAAAFGDPGLLGDRQIGRWLKSGDNALVRDSAVVVPGGEVRQELALKLQFTESGEVELEMQWFPLNM

SEQ ID NO: 29907 - protein, 559 aa, Phanerochaete chrysosporium
MLFALLALGAAIGVGAAPSSGPPVVQVPSMDNFVLGSGVAGQPPQVRHYEFVVEEMLGAPDGVTKPMLVVNGLFPGPTIEVNQYDRLVVRVINRIQNATTIHWHGIPQNGTAYYDGTAGITECGIPPGQSLTYDFTFGDFSGTTWWHSHYDTQYTDGVTGALIVHPTFPDPPGFPTWDEELVIELTDVYHTFSTILNAQYLSPSGPIGGSAGDEPVPDSGALNGLGQYHGLGNYFNFTLQPNKTYRLRLIHTGSLADIRFSVDNHPLTVIEADGTLTEPTVVAGLTLAVAQRYSVLLTTNQTNGSYWMRTLQQTDMFTYKLPGQNPDNRGIISYGTGTGPTLPPAKEDPGATLGGMQLNDLDPYTLPPAVPEAVPDNTKFYQVSFEFDNLPSGASRAYMNGTSWDPLPKTNILLEIQRAYNAGRAFAPEGASVQFGNQFLITEDKIEVLDLVLENNDNGDHPFHLHGYSPWMIGVGDSPYDPNNVTLNTVNPLSRDTVEIPANGWVRLRFITYNPGAWTLHCHISWHMSAGLLMQFVTLPSVAATLPIPQVIANMCSAA

SEQ ID NO: 29908 - protein, 1166 aa, Ustilago maydis
MQAVTASRPNADSASASHRIPSQPNASNPPSASLRPPDQQLPTTAASLMREGPRDFTVIKDVGDGSFGTVCLADWKSPLPSGTMLSPMQHPTTRPEYIGKRLVAIKKMKKPFPSWQECMKLKELKSLLTIPPHPNIIPLYDAFLMPTTKELHFVFECMEGNLYQLTKSRKGRPLAAGLVASIYEQIVLGLDHIHQHGYFHRDMKPENLLITTTGLADYPNLQPALAAERDVLVIVKLADFGLARETLSKPPYTEYVSTRWYRAPEVLLRSRDYSNPVDMWALGTILAELVNLKPLFPGHSEVDQVLQICDILGDPSHSYGHDSRNRRNGGGPWDRGIRMARAVGFTFPIRKPAKFSRFFSDRVPQNLIDCIEDLLRYDPQARLTSKDCLQHDYMRLDAPRLRPPQAKPLVSATAPLRPQQNASRPLPSSHSTLLSSNHARPPFGAADSNLKPLAVLRQPDGSPIVRVNAAATSDPSLANGTTPASPMQEDATEVHWAPPVVSSSRDVSLSGYPAFPDSASLYAASSSTHPDGPPSGAPSSDATMVMSDAQLTDSTLKHTDPRHAQALQAHQYEQYQRQYRHDAGQSQSPGYDAHAAAAYDRDAALRGAAFVPFVASYPGSAATGQLAAATSSGELSQKNDSNASNETISSRDKERRRSKVWGLNISSKFGGSGSSGTLAGSSSGGAANATGTHLYAVGNAAAGRLPPNGPMQESRVSLEPTPAQRIAAEHSNATLATLPNGAPAKTADSKKARKEAEKAAREAEKAKREAQQKAARDRARAVMQKRNQLLASSNSKDPVEWLAGAIQSDEPYRSSPSEKARGKQPAIPGSQLSPSMPSFASGEFPRSPLQQPIHGLSPDYGMNANPAVMGSMAWRGVGAARYSRSNKARRREHDDDHSMSSFEDAVDPRRASMQSYQTGDSDPGPGTGQQVAQGHYVQRASSSSSLASAPSLVDQRRFAPSLESHRSSADTRSISSLDHQLITNMERMTAVEARARTPGNVSPGPAHVVGARQSLSRQSRTNSRASSTSAHRQGSASPLHHASGIPRFHPYSHGGPVTPSTGYHANYQLPPLHQSLAHPSGAQRSDTAGDRSVSPAFYSNASQPQQHVHQHHINPIFHVPAGNSGHGTTLPPFSSIAASIDVPAIDEKATQMLYAQARSPGPLPQS

SEQ ID NO: 29909 - protein, 406 aa, Shigella flexneri 2a str. 301
MSFDSLGLSPDILRAVAEQGYREPTPIQQQAIPAVLEGRDLMASAQTGTGKTAGFTLPLLQHLITRQPHAKGRRPVRALILTPTRELAAQIGENVRDYSKYLNIRSLVVFGGVSINPQMMKLRGGVDVLVATPGRLLDLEHQNAVKLDQVEILVLDEADRMLDMGFIHDIRRVLTKLPAKRQNLLFSATFSDDIKALAEKLLHNPLEIEVARRNTASDQVTQHVHFVDKKRKRELLSHMIGKGNWQQVLVFTRTKHGANHLAEQLNKDGIRSVAIHGNKSQGARTRALADFKSGDIRVLVATDIAARGLDIEELPHVVNYELPNVPEDYVHRIGRTGRAAATGEALSLVCVDEHKLLRDIEKLLKKEIPRIAIPGYEPDPSIKAEPIQNGRQQRGGIRLMNKRKTA

SEQ ID NO: 29910 - protein, 142 aa, Acidobacteria bacterium Ellin345
MPAILELLKQNHHDLHVVQHDQSVIEAVHFMVENNVGAVPVLDHGHLVGIFSERDVMTRVVVRGMDPHSTTVETVMTPEPLAVAPETSVHDCMVLMKQHKFRHLPVCEGRRLVGFLSLRDLLLYEVDEKDVEVRMMRAYIAS

SEQ ID NO: 29911 - protein, 186 aa, Debaryomyces hansenii CBS767
MSQVEISELAKEIRASLKQFPNFPSEGILFEDFLPVFTKPDLFQKLVRAFQLHVGEQKVDYVVGLESRGFLFGPTLALALGAGFVPVRKAGKLPGPVFTAEFQKEYGSDKFQIQKDVIEEGAKVLIVDDILATGGSASSAGELVKQTGGDIVEYLFVMELDFLNGRDKLDKPAFTLLSGQAEKLQN

SEQ ID NO: 29912 - protein, 420 aa, Mycobacterium sp. JLS
MGQVAELAGSAVPWAFVAGAVVAAVSAYSYVRCASANPSSGGIAMILKAAYGPGVVAGTFSLFMYVSMVLAESLLARTFGTYALRPFGLQGSAILVPVLAVLAIVIATSVNLVGNRWVESSATVTAIVKITGIAVLAIAGIYATGLSSLSQVFETGAEATPPRSGILGFLAGVTLCILAYKGFTTITNQGDDIRDPRRNIGRAIVISLVVCAVVYLLLTIAVTGSLSVAEIVDARDYALAEAAEPLFGSWGVRLTVAVAVVATMSGLIASLYSVSRLYDMLRHMHQVPDVPGSVHRPSLLITAAAAIVTAALFDLSRIASLGAMLYLSMDIAIHWGLLRRLRHDVDFKVWVPLLAIALDVVVLVPFVILTARNSLPTLVIFGVVSAVIVLGQQAAVRHRNRSSAAPAAPNDGTDENQDRS

SEQ ID NO: 29913 - protein, 160 aa, Bifidobacterium animalis subsp. lactis
MASEEAQFVARAERLAGPAGIAGFQPAAARDRALAAQNRYVVPEFTERTPYGMKTQNPYTRLFDDRIIFLGVQVDDTSADDIMAQLLVLESMDPNRDVMMYINSPGGSMTAMTAIYDTMQYIKPDVQTVCLGQAASAAAIILAAGTKGKRLMLPNARVLI

SEQ ID NO: 29914 - protein, 358 aa, Physcomitrella patens subsp. patens
MASEMEIETLPGAGGEHELDLGNLLVAHYRDPVTLSNGTAMSEAERDVEYVEQGRNLVQVLVDRLFNMPSTVDKTGRLVTLPKPSFQLPREKPLPKPRPMTKWEAFAQTKGIKKRKRSKLEFDEGKEEWRRRHGYKRVNDENDIPIIEAKAGDEPGEDPFLKLRESKKERVAKQDKNQLENLKRAAKQGGKGALPSTLQLAATSLAVTGGKQPGQKLSKNDLGDAAGLASTATASIGKFDKKLPGEKPAKKLGKHRKFLPVVDGQGKEKELITNVMKKVLAENDFSGLDVNKAVRAHNVEESGKPSKKVGGKKRAEGAFKKGGSRKGMAPSGKSGKKSSFGGKSGGKAGGKERKSSKR

SEQ ID NO: 29915 - protein, 774 aa, Ralstonia metallidurans CH34
MTSPQQSPSQDDLKQQQREALRKAALEYHEFPTPGKISVTPTKPLSNQRDLALAYSPGVAAACEEIVANQANSFRYTARGNLVAVITNGTAVLGLGDIGAAASKPVMEGKAGLFKKFAGIDVFDIEVDEKDPEKLVDIIASLEPTFGGINLEDIKAPECFYVERKLRERMKIPVFHDDQHGTAIVVGAAVINGMQVVGKDISKVKLVASGAGAAALACLDLLVDLGLPIENIWVTDLAGVVYEGRTELMDPEKARFSQKTDKRKLAEVIEGADIFLGLSAAGVLKPEMVQKMADKPLVMALANPNPEIMPELVKEVRPDAVIATGRTDYPNQVNNVLCFPFIFRGALDCGATTITREMEIAAANAVAELARQEQSDIVASAYGIQDLSFGPEYLIPKPFDPRLIVKIAPAVAEAAAKSGVASRPIEDMDAYRLQLQQFVYHSGTLMKPIYAAARKVQKEKKRIVFAEGEEERVLRAVQVIVDEKLANPILIGRPAVLAHRIERFGLRLRMGEDFTVVNPEHDERFREYSDAYYRMMAREGITPQYAKLEMRRRTTLIGAMLVEKGEADGMICGTVSTTAAHLRYIDQVIGGTNCVYAAMNGLVLPGRQIFLVDTHVNVDPTAEQLAEITIMAAEELKRFGIEPKVGLLSHSNFGTSEAPSARKMRDTLKILRDRAPDLEVDGEMHGDSALDEKLRDSLVPDSALKGEANLLVCPNIDAANISYNLLKVAAGNNVAIGPILLGVKAPVHILTPSATVRRIVNMTALVVVDAAAKV

SEQ ID NO: 29916 - protein, 367 aa, Ashbya gossypii ATCC 10895
MRLHSRQASNPHRQYSAAQSLHSSSDDSEHKEIPSTMGWAKRLMRWMVTVDQPHTFETSLKNYQSLAHVTNYIFFCGGRLRTVAKTKYLSVLVLVMLIAPIVLFSVFETGYLWKHVAGAKPCVVLCYYFWTLCFASFISTGATDPGTLPRNIHLAQLQDDYKLPLEYYSIITLPSPVANAPVRLKYCTTCRIWRPPRASHCAVCDSCILSFDHHCDWLNNCIGQRNHRYFLAFLFSSVLSSIWLLTCCALKLRHAGSPSAAPVSLLLICYCAVSIWYPLLLAIYHLFLTGTQQTTHEYLKAVDSRNPIFHKVTHPERNPFVTGSCARNMLLLMCQPRGYDFLHTRSEHQAGDWRFFRLPIPHSFEKV

SEQ ID NO: 29917 - protein, 398 aa, Acidobacteria bacterium Ellin345
MEKLIYFDNAATGWPKPENVYRFMDEFYRTHGVNPGRSGYDLAMETGSMVDRSRKRLTKFFGGDEDAPDRLVFTSNVTDALNLVIPGLVGHGDHVVTTNLEHNSVIRPVNHMVRDCGAEATYVPFKAHGFIEPEAIAAAIRPNTKAVVVNHGSNVIGTVQPVADIGKICRERGVTFVIDTAQTAGVVPINMRAMNVDVVAFTGHKALMGSVGIGGLCIRKHVEVKRVRSGGTGVRSVDPYHLEEYPWRLEYGTPNLVGIASLWAGQDWLDEHGVEMVHAREMKLAKKLVDGFRQVEGVTLYCCENLANHLPTILMNIDTMDPGDVGVMLDVDYNIAVRTGLHCAPLVHTQLGTVKRDGGVRFSIGAFNTEEEVDAAIHAVSEIAKWAMSRSAKSRVTA

SEQ ID NO: 29918 - protein, 554 aa, Bradyrhizobium sp. BTAi1
MNIMNPAHKEVSRAAVLDEAHIGDIHGALGTIRHHDHGPRRGFWARWRTLIAILGPGLIVMVGDNDAGAFGTYTQAGQNYGTTLLWTLMLLIPVLYVNQEMVVRLGAVTGVGHARLIFERFGKFWGAFSVIDLFLLNALTLVTEFIGISLALRYLGLSQFWGVLASALIVMLAVSTGNFRRFERFAIVLVFGSLLLVPVVLMVHPPVEQIAADFLVPKMPKDGNLSEVMLLIIAVVGTTVAPWQLFFQQSYLIDKRITPRFIQYERWDLCLGIALVILGAVAMISFSAAIFTGRPEFGNYTDALGTAVGLEKYAGRLPAVLFALALLDASIVGAAAVSLSTAYAIGDVFSLKHSLHRRPSDAKGFYGVYFALIIVAAVLVLTPGTPLGLLTNAVQTLAGVLLPSATVFLLLLCNDTAVLGPWANSRMLNLFTGAIIAVLVLLSTILTASVLFPDMGEQWIVGILVGGSILGGLLTIGAKIFELSRRPSAARAWPKRAKRKVDVYDNWRMPPLSELPPAQLSVLSRVWMIVLRGYLLVAGGLVLVRIFQLATAGA

SEQ ID NO: 29919 - protein, 370 aa, Ashbya gossypii ATCC 10895
MTTVYCASLQCGKATDSALKCPLCLKQGIQSVFCNESCYRDCYKSHKALHIKDDSDKSYDPFQNFKYTGELRAQYPLTPKRAVPDDIEKPDWAANGLPLSEQRNDRLNKIPVYNKEEIKRIRKACMLGREVLDIAAAALRPGITTDELDEIVHAETIKRGAYPSPLNYYNFPKSVCTSVNEVICHGIPDKYVLKDGDIVNLDVSLFYQGMHADLNETYYVGDNISKEALNTVETARECLKIATKMCKPGVRFQDLGDAIEKHAKQNKCSVVKTYCGHGVGKFFHCSPSIPHYANNKTPGVMKPGMVFTIEPMINEGVWQDLTWPDDWTAATKDGKLSAQFENSLLITETGVEILTARTKKSPGGPRPRTK

SEQ ID NO: 29920 - protein, 356 aa, Magnaporthe grisea
MMGACMSASSEESEQKKRSQKIDKDLEEDSKRLRRECKILLLGSGESGKSTIVKQMKIIHLKGYSDDELYNYRPTVFKNLIECAKAVISAMRQFDIEPQLEGNKELCDYLLDYMVESGPQAEIDPKVGQAVQSIWNDPAREQLMDRQTEFYLMDSAEYFFQEVLRIVSPDYLPNEMDVLRARTKTTGIYETRFQMGQLSIHMFDVGGQRSERKKWIHCFENVTSIIFCVALSEYDQVLLEESSQNRMMESLLLFDSVVNSRWFMRTSIILFLNKVDIFKQKLGRSPLGNYFPDYSGGNDVNKADKYLLWRFNQVNRAHLNLYPHLTQATDTSNIRLVFAAVKETILNNALKDSGIL

SEQ ID NO: 29921 - protein, 353 aa, Magnaporthe grisea
MGCGMSTEEKEGKARNEEIENQLKRDRLQQRNEIKMLLLGAGESGKSTILKQMKLIHEGGYSRDERESFKEIIFSNTVQSMRVILEAMESLELPLEDQRMEYHVQTIFMQPAQIEGDVLPPEVGNAIEALWKDRGVQECFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSITLFLNKIDRFKEKLPISPMKNYFPDYEGGDDYAAACDYILNRFVSLNQHETKQIYTHFTCATDTTQIRFVMAAVNDIIIQENLRLCGLI

SEQ ID NO: 29922 - protein, 355 aa, Magnaporthe grisea
MCFGSRNVHDEAGAARSRELDKAIRADEKRLQKEVKLLLLGAGESGKSTVLKQMKLIYAQGFSKNEKIEWKPVVFQHIVQSFRLIHDAMQELDIEFENKENERNITLIMEEQELGAHDALPIEFLDPIKALWVDAGVKKAIAKGNEFALHDNLDYFCDDLDRIWDKSYVPTDQDLLRSRLRTTGITETVFDLGQLTYRMFDVGGQRSERKKWIHCFENVNCLLFLVAISGYDQCLVEDKDGNQMNEALMLWESIANSHWFTKSALILFLNKMDLFKEKITKSPITEYGFTDYHGPSDDWKQTSKYFMDKFRALNRNPEKEIYGHFTNATDTNLLKITMTSVQDMIIQRNLKQLIL

SEQ ID NO: 29923 - protein, 314 aa, Clostridium perfringens SM101
MKKVLCPGEALIDFVSNEHGKALKDTSGFIRKAGGAPANVAAAISKLGADAYFCGTVGDDFFGEFLEETFKKNNINTEMMIKLKDKSTTLAFVSLKEDGDRDFKFMRNADSDLTFDEIKNNLDQFDLFHFGSATAFLEGELKNTYYKLKDYALKNNKIITFDANYRDALFGEDKDTFVSCCKDFIKDSKIVKLSDEEACLISGMENIEEAAKYIIDLGCENLIITLGKKGALLTTKEKQILIPTNEMKMVDATGAGDAFIGAVIAQVLDIPNKSIEDIIKTANLVGGITTTRIGALESIPTWDEVKQYSKLDQI

SEQ ID NO: 29924 - protein, 251 aa, Desulfotalea psychrophila LSv54
MKRKALIAGNWKMHMTVLEGCRLAAEIVASCKDYTDREVLLAPPCTIISEVSHILAGSKIILSSHNVCWEEKGAFTGEISPTMLQDAGASCAIVGHSERRQVFFESDEVINKRLKGALAFGLMGILCIGETLEEREAGNTQAVLERQVRKGLADVPASQMKQVVLAYEPVWAIGTGVTASKEQVQETHAALRQLISEIYEKDIAEGLRILYGGSVKATNVDELMSQQDIDGALVGGAALDSISFARIINFE

SEQ ID NO: 29925 - protein, 257 aa, Yersinia pestis CO92
MNPLVIKLGGVLLDSEEALERLFTALVTYREKHERPLVIMHGGGCLVDELMKRLALPVVKKNGLRVTPADQIDIITGALAGTANKTLLAWAVKHQINAVGLCLADGNTVTVTLLDAELGHVGKAQPGSAALVQTLLAAGYMPIISSIGITVEGQLMNVNADQAATALAATLGADLILLSDVSGILDGKGQRIAEMTAQKAEQLIAQGIITDGMVVKVNAALDAARSLGRPVDIASWRHSEQLPALFNGVPIGTRISV

SEQ ID NO: 29926 - protein, 392 aa, Desulfotalea psychrophila LSv54
MKSLRELELAGKRVLVRVDFNVPMDDKQRITDDIRIRMVLPTLRYVLEQGGRLIICSHMGRPKGKRVEEYSLAPIARHLAGLLGRDVGIAPDCIGAEVEAQVAALGVGEVLLLQNLRFYGEETENDAVFAGKLAGLADVYVNDAFAVSHRAHASVVGVAERVAEKCAGFLLQTEIDYFHKSMNDPIRPLVALVGGAKVSSKIGALENMLGKVDKMIIGGAMANTFLMSQGVDVGASKVEDDLLVTARNFLQAAGERGMKVYLPVDFVVADRFAADAVHKTVPADSVPEGWMALDVGPASSILFREALQGAGTIVWNGPMGAFEMDAFAGGTMSLCRDVAASQALSITGGGDSNAAVKKSGEADNISYMSTGGGAFLQLMEGKTLPGVDALEA

SEQ ID NO: 29927 - protein, 401 aa, Sinorhizobium meliloti 1021
MRNGTSHLFVPGPTNIPDAVRRAMNVPMQDMRAPDFPDLVLPLFADLKGVFRTDNGSIFLFPGSGTGAWEAAISNTLNRGDRVLMSRFGQFSHLWADMAGRLGLDVECLDVEWGEGVPVEEYRRRLDADKNRRIKAVFVTHNETATGVTSDVAAVRAALDDTGHKALLFVDGVSSIASIEFRMDDWGVDLAVTGSQKGLMLPAGLGILAVSPKALEAHASSTIERCYFSFEDMKAPSETGYFPYTPPTQLLLGLRASLDLIFAEGLDAVIARHHRLAEGVRRGVHAWGLNLCATEKKWWSDTVSAIVVPEDVDARQVIANGYSKYRTSFGAGLSKVAGRVFRIGHLGDLNEVMCLSALAAAEMSLRDAGAKIEAGSGVAAAQEWYRSQIGLAAPNLQERAA

SEQ ID NO: 29928 - protein, 512 aa, Clostridium perfringens SM101
MSKKPVMLMILDGFGISPNKEGNAVAAANKPNYDRLFNKYPHTELQASGLEVGLPEGQMGNSEVGHLNIGAGRIIYQELTRITKEIKEGTFFTNKALVKAMDEAKENNTSLHLMGLLSNGGVHSHIDHLKGLLELAKKKGLQKVYVHAFMDGRDVAPSSGKEFIVELENAMKEIGVGEIATISGRYYAMDRDNRWERVELAYNAMVLGEGEKASSAVEAIEKSYHDNKTDEFVLPTVIEEDGHPVSRIKDGDSVIFFNFRPDRAREITRAIVDPEFKGFERKQLHVNFVCMTQYDKTLECVDVAYRPENYTNTLGEYVASKGLNQLRIAETEKYAHVTFFFNGGVEQPNTNEDRALIASPKVATYDLKPEMSAYEVTDELIKRLDEDKYDMIILNFANPDMVGHTGVQEAAVKAIEAVDECLGKVADKVLEKEGTLFITADHGNAEVMIDYSTGKPMTAHTSDPVPFLWISKDAEGKSLKDGGKLADIAPTMLTVMGLEVPSEMTGTCLLNK

SEQ ID NO: 29929 - protein, 245 aa, Herminiimonas arsenicoxydans
MNPLRLWHGWGMHPAVWSGLCTELAQQDIATQTPALPGYDQSETVAPYNLDALVDAMLPATNIPYVLCGWSLGALLALHAARRHPQRISRLILIGATPSFVQRADWPHGIPLAVVDEFIAAVAHDPAAALKRFMALSNQNDVHARSMARTLTQMLTANPLPTAETLIAGLTLLRDSDLRAGIADITQPVLLLHGARDPLMPVAAAQWLADALPQAQLDILPEAAHTPFLSDQQHCCASIASFYRA

SEQ ID NO: 29930 - protein, 128 aa, Triticum aestivum
NTPTPFDPNTPPFSTGPYGYWMSHPGVIWGLFGYWCPLVRLFGPSAAVPFGYDLTVPEALANTRADGVGALYREGTASLLNSMVSSGFPFTTAQVKDAFGAALSSGDDRAAAAQAQLFKMANEGLAKH

SEQ ID NO: 29931 - protein, 232 aa, Glycine max
MASSSDSWVKEYNEALKLADDISGMISEQSSFPASGPETQHHSSAIRRKITILGTRLDSLQSLLSKLPGKQPISEKEMNRRKDMLSNLRSKVNQMASTLNMSNFANRDSLLGPERKPDAMTRMVGLDNNGLVGLQRQIMKEQDDGLEQLEETVASTKHIALAVNEELDLHTRLIDDLDQHVDVTDSRLRRVQKNLAVLNKRTKGGCSCMCMLLSVVGIVALIVVIWLLVKYL

SEQ ID NO: 29932 - protein, 242 aa, Prototheca wickerhamii
GGICRSGPSHESHPAKEAVVTMGGSHSKKSGATTDPLVTVLENKPSRSQATPPADTAPPPAKKNIVSSNITQVIGNTPLVRLNHLAETEGAKATILLKMESLEPNSSVKDRIGLAMIEDAEQSGKITPGKTTLVEPTSGNTGIALAFVAAARGYKLVLTMPATMSLERRIVLRAFGAQLVLTDPAKGMKGALLKAEEIAAATPDSYILQQFENPANPAIHYTTTGPEIWNDAGGDVDVFIAG

SEQ ID NO: 29933 - protein, 214 aa, Pseudomonas fluorescens PfO-1
MQLKNPILGLCQQSTFMLSAAKVDQCPDDEGFEVAFAGRSNAGKSSALNTLTHASLARTSKTPGRTQLLNFFKLDDERRLVDLPGYGYAKVPIPLKQHWQRHLEAYLGGRESLKGLILMMDIRHPMTDFDLLMLDWAVAAGMPMHILLTKADKLTYGAAKNTLLKVQSEIRKGWGDQVTIQLFSAPKRMGLEEAYTVLAGWMELADKGAELPAE

SEQ ID NO: 29934 - protein, 667 aa, Treponema denticola ATCC 35405
MPFIQLSKISLAFGDRDILKDITLILTAGTKAALTGANGCGKSTLMKIVAGQIKADSGDIATEKDTSIAYLPQSGIVHKGKTLAEEAETAFAYGYDIIKAMDEVGEKMKTEKDEQKLLTLANDYHALQTRLDNSGWNSKKGLIDETLRGLGFSSADFNKNTEEFSGGWQMRIALAKVLLQNADIIVLDEPTNYLDIEARSWLELWLKKFKGGFLLVSHDRYFLDQTVTETYELFKGTLKKYKGTYSDYERIRTIEVEGLIKAYEQQQEEIAKTEDFIRKFRYTESRAALVQDRIRRLEKMERIELPEHLKKIRFSFPPAPHSGKIVLQAEGISKAYSRASGPAVSPTHSQTGGLHRVIENLDLTVEKGERLVLAGKNGAGKSTLLRILAGEDKNFTGSLKEGAGVKMGYFSQDESETITGSESIIDLLERSAPTDLVPKLYDMLAAFLFRGDDIYKSLSVLSGGEKSRLALLLLLLKPLNLLILDEPTNHLDLHSKDVLLDALKRFDGTIVFVSHDKGFIQDLATRVLELKADEEGLNPSRIRNFPGTYDYYLYRIEQEEAEDKNGAIRKTDNTNPSKASANLSYEEQKRLRSERRKLEKEEERLLNEIEKCETEIAENEALLAEPEVYSNGEKSKAVQKKIEELRARAEELSESWAEAASKLEASV

SEQ ID NO: 29935 - protein, 965 aa, Arabidopsis thaliana
MTSMIVKTTPELFKGNGVFRTDHLGENRMVSRSNRLGDGSNRFPRTGTIHCQRLSIAKTGLHRETKARAILSPVSDPAASIAQKILERNYHRSLVFTFGKGRSEGNKGMKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 29936 - protein, 746 aa, Arabidopsis thaliana
AFFLLLCLGFCHVSSSSSDQGTYIVHMAKSQTPSSFDLHSNWYDSSLRSISDSAELLYTYENAIHGFSTRLTQEEADSLMTQPGVISVLPEHRYELHTTRTPLFLGLDEHTADLFPEAGSYSDVVVGVLDTGVWPESKSYSDEGFGPIPSSWKGGCEAGTNFTASLCNRKLIGARFFARGYESTMGPIDESKESRSPRDDDGHGTHTSSTAAGSVVEGASLLGYASGTARGMLHALAVYKVCWLGGCFSSDILAAIDKAIADNVNVLSMSLGGGMSDYYRDGVAIGAFAAMERGILVSCSAGNAGPSSSSLSNVAPWITTVGAGTLDRDFPALAILGNGKNFTGVSLFKGEALPDKLLPFIYAGNASNATNGNLCMTGTLIPEKVKGKIVMCDRGINARVQKGDVVKAAGGVGMILANTAANGEELVADAHLLPATTVGEKAGDIIRHYVTTDPNPTASISILGTVVGVKPSPVVAAFSSRGPNSITPNILKPDLIAPGVNILAAWTGAAGPTGLASDSRRVEFNIISGTSMSCPHVSGLAALLKSVHPEWSPAAIRSALMTTAYKTYKDGKPLLDIATGKPSTPFDHGAGHVSPTTATNPGLIYDLTTEDYLGFLCALNYTSPQIRSVSRRNYTCDPSKSYSVADLNYPSFAVNVDGAGAYKYTRTVTSVGGAGTYSVKVTSETTGVKISVEPAVLNFKEANEKKSYTVTFTVDSSKPSGSNSFGSIEWSDGKHVVGSPVAISWT

SEQ ID NO: 29937 - protein, 172 aa, Brassica napus
MGDYTIQISSRLINQLAEGDNQPKRKAKKTKPKVSPQSKADQAKTHHDAEKPKPMTELPTQPPFFFPVPQQAAANTELESIKSILKEGEKVLEKVERQERSIVHEVTERAKDLREKEFKIPEPKPMPCSSDHEAWKKCYEENVDNPLKCSSLVMRFQDCARRFRQQVSSKET

SEQ ID NO: 29938 - protein, 456 aa, Coprinopsis cinerea okayama7#130
MTCVGASLLVWLTSGLLAWTGASSFAELGSAIPQNGGAQAYLAYAYGPLVSYLFAWTAIIALKPGGNAVISLIFAEYMNRIFWNHTKEDASPDSIPQWAIKLVAVLAVVIVTIICIAAQKLGTRVAVVFTTLKLLVTVLGLVQLARGKAASSFHEPWLSGSSTSPSSYSLALYSGLWAFDGWDQANYVGGEMHHPEKNIPRAIHSSMIIVTLLFLLANLSYFVVLDKNLVGLSNTVAMDFGRALWGKAGGTVFALLVAISCFGALNGSLYTSSRLVYAAGRERYLPALFGRLHTTRKTPINAALLQSAITITFILIGGGFRSLINFSVVASWAFYFLTVLGLVILRFKEPMLERPQVALFLLLMPIIAAPLEAIAVLGFVAAGVPVYFLTQVDEKPRIFGGSRSLLDLAALFICNILGFFSDLIARIRGRPPSADGWEAVATDADELEMTQANTRR

SEQ ID NO: 29939 - protein, 213 aa, Pseudomonas putida
MKSYDVVIIGGGPGGYNAAIRAGQLVLSVACVEGRSTLGGTCLNVGCMPSKALLHASELYEAASGEEFAHLGIEVKPTLNLAQMMKQKDESVTGLTKGIEYLFRKNKVDWIKGWGRLDGVGKVVVKAEDGSETALQAKDVVIATGSEPTPLPGVTIDNQRIIDSTGALSLPQVPKHLVVIGAGVIGLELGSVWRRLGSQVTVIEYLDRICPGT

SEQ ID NO: 29940 - protein, 209 aa, Silicibacter pomeroyi DSS-3
MFDPVDTYMNTLVPMVVEQTSRGERAYDIFSRLLKERIIFINGPIHDGMSHLIVAQLLHLEAENPNKEISIYINSPGGVVTSGLSIYDTMQYIKPKCSTLVIGQAASMGSVLLAGGEKGMRFSLPNSRIMVHQPSGGYQGQASDIMIHAAETQKLKDRLYDIYVKHTGQTKKAVEKALDRDNFMSPEEAKEWGHIDEIVESRSKGDDAE

SEQ ID NO: 29941 - protein, 508 aa, Debaryomyces hansenii CBS767
MPQTVNNENEYRLTRSKAMQNQSLRGNEGGPKTHAQTQMEAQSQKGGRGEAVMGDGNGDTKDGLYNLSQHSSEEVLAGTRSYLGDVSNQYGSSGVKPNMGSKRRPLGGDNAPLQQHQRIMLKPNNSSTNTNHLLASQPKDTVTTTTATINDNTNGNITTNNHTSASSSNSSTQNLAVPARMPQKRQATESSTNLVEKLHISGPHSNHVSYKKSRIIDYEWQDLDEEDIDDPLMVSEYVNDIFPYLSELEHKTLPDSQYLFKQKHLKPKMRSILVDWLVEMHTRFRLLPETLFLAINIMDRFMSLEIVQIDKLQLLATGSLFIAAKYEEVFSPSVKNYAYFTDGSYTEDEILQAEKYILTILNFDLNYPNPMNFLRRISKADDYDVQSRTLGKYLLEITIIDYKFIGMLPSLCSASAMYIARLILGKTPVWNGNLIHYSGGYRVSDMKDCIELLVQYLIAPVEHDEFFKKYATRKFMKASILCRSWAKKIVSENKDIFANDLFINKAEN

SEQ ID NO: 29942 - protein, 271 aa, Acidobacteria bacterium Ellin345
MKIDLSGKVAVVTGGAMGIGEACARKIALAGASVAILDPNEDAGTKTAAAIRAHGGECKFFRCDVSKSKDVEQAVGDVITKHSQIDILVSNAGIQYYGDVITTPEDDWDRVIGVNLKGCFLISKFCVPHMISNGGAIVVLGSVQSFTAIQNSAAYVTSKHAVLGLARAMALDYAHKGIRVNCVCPGTIDTPMLHWAASLSPDPESVIRTCDRMHALGRIGKPDEVADAVLYLASPMSSFITGAALLVDGGMLVPAGGMAFQEGGTGASTKK

SEQ ID NO: 29943 - protein, 367 aa, Zea mays
MGKEGVAAGPAAEGSKSRSECINSSNPYHECSDYCLRKIAEARQRLDDELPDSWKRPPEQRTVHPDCINASNPYHECSDYCFKRIADAKSPACGAGDSFPVNSNRLEREERQPPADVFAAAGMSDAVEQHRPVDNDPDEQEGAGPDDGYPQMTEKQKKLFELRLKMNEARKANQQAMVAEKKRMEPRGESRGVSKQKWLDDRKKKIGKLLDSNGLDMKMAYMLDTQETAEAKYKKWEKEPAPYGWDVFNQKTLYDAYKKRTKNIEVDMEAYNKAKEADPEFYRDASSLQYGKVSNVPEENIDKMVKELREREEKRKSFSRRRKFNEDKDIDSINDRNEHFNKKVERAFGKYTLEIKNNLGRGTALPD

SEQ ID NO: 29944 - protein, 271 aa, Ashbya gossypii ATCC 10895
MSRVGVLVLGPAGAGKSTFCNGIISYMQSVGRRAHIVNLDPAAEASEYEFTVDIRDLISLDDVMEELSLGPNGSLVYCFEYLLENLDWLDEEIGDYNDEYLIFDCPGQIELYTHIPVLPTIVRHLQNQLNFNLCASYLLEAPFVIDTSKFFSGALSAMSAMILLELPHINVLSKVDLIKDEYSKKRLKRFLNPDPMLLVDSANADTNSKFHQLNKAIANLVDDFGMVQFLPLEAKNPDSVSTILSYIDDITQWGEAQEPKEPNDALEIEDM

SEQ ID NO: 29945 - protein, 199 aa, Trichodesmium erythraeum IMS101
MTDECLRVGQKAPDFTATAVVDQEFETIKLSDYRGKYVVLFFYPLDFTFVCPTEITAFSDRYKEFELLNTEILGVSVDSEFSHLAWIQTDRKSGGIGDLNYPLLSDIKKEISTAYNVLDLEAGIALRGLFIIDREGIIQHATVNNFAFGRNVDEAIRTLQAIQYVQIHPNEVCPVGWKPGDKTMNSDPIKSKEFFAAVS

SEQ ID NO: 29946 - protein, 333 aa, Thermus thermophilus
AYRICLIEGDGIGHEVIPAARRVLEATGLPLEFVEAEAGWETFERRGTSVPEETVEKILSCHATLFGAATSPTRKVPGFFGAIRYLRRRLDLYANVRPAKSRPVPGSRPGVDLVIVRENTEGLYVEQERRYLDVAIADAVISKKASERIGRAALRIAEGRPRKTLHIAHKANVLPLTQGLFLDTVKEVAKDFPLVNVQDIIVDNCAMQLVMRPERFDVIVTTNLLGDILSDLAAGLVGGLGLAPSGNIGDTTAVFEPVHGSAPDIAGKGIANPTAAILSAAMMLDYLGEKEAAKRVEKAVDLVLERGPRTPDLGGDATTEAFTEAVVEALKSL

SEQ ID NO: 29947 - protein, 140 aa, Oryza sativa
  misc_feature (46)..(46): Xaa can be any naturally occurring amino acid
QDLPIDYPGFLPVVFGVLGVMFRYKGCLWVPFIFWGQFLVNIKNFXNVFNPFSLAFFFSVLGLVTNFFGPPCPGPKRLSGCPLCPCFRVSLVFFCSQNFWPRSPFLIFFGPVAHPVIPSPPLLGAKKCLIPHNFILRGWG

SEQ ID NO: 29948 - protein, 851 aa, Listeria monocytogenes str. 4b H7858
MTNIGLPVPPGFIISTDACNDYTANNKHLSEAIFEEVKIHLAELEKQTGKIFGFAENPLLVSVRSGAPFSMPGMMDTVLNLGLNDQAAEGLANLTGDARSAYDSYRRFIQMFGDVVFEIPSYQFEQALSRIKKANNYRLDTELTATDLSNLIDAYKLIFSQATGIDFPQDPLEQLRLAIIAVFDSWMNPRAVIYRRLHDIDASFGTAVNIQAMVFGNTGETSGTGITFTRNPSTGEKKVFGEFLLNAQGEDVVAGIRTPEPISALEERMPTVYKELLQTCELLENHYLDMQDIEFTIEKGKLYVLQTRSGKRTAKAAIQAAIDFVHEGKITRQEAIMRVETKQLNQLLHPTFLESALKNGQVIATGLPASPGAATGQIFFEAKEAVQAAERGIPVILVRNETSPEDIEGMARSNAILTAHGGMTSHAAVVARGMGKCCIAGCAELTINEKDKTIILPTGDTLHEGDALSLDGSSGKVYLGEIALREAKIGGYFDELMAWADAEKRLMIRVNADTPADFKKALLFGAEGIGLCRTEHMFFDEKRIPYVRQMILAESLNERESVLAILKEMQKADFNELFRIADGRSVNIRLLDPPLHEFLPTMKQEIEQLAGAMNRTVPQITNRINGLREANPMLGHRGCRLAITFPEIYRMQAEAIIESAIIVHNEGIDVHPEIMIPLIATKNELSYIKKELQQAVQAIFDREQVLIPYDIGTMIEIPRACVTAAEIAEEAAFFSFGTNDLTQLTYGFSRDDATKFLADYYEKDILPKDPFVSIDKNGVGALVEMAVTRGRMTSEHLKMGVCGEHGGDPESIQFFHQLGLSYVSCSPYRVPIARLAAAQAALAEKQLVPTI

SEQ ID NO: 29949 - protein, 1100 aa, Candida albicans SC5314
MLESLNRRNSIDSNQGDNDNDNDNHSNDELSPSELYYSPSGSPPKSQLLLRKSSSPSSYSPIKSDLPNIYSHLRSNDSESPPQPSPKQQSSLSSSSSSSSSSNTKSSTTKNIFKKLLRINKSSDNIDESRSIVSNNGGSPMSDSTTVTSTLSTDTAPKRGKSIQRSQILHHTDSDSLYLENQIELRPEISKSIGNIKIPSIFTNDGMPLLKISHKSKKRILFWIDPSCFKFSWRMANSTTTTTSATTSATTSGLPQGITNTTALSNSAIISTPAIATSAIHRLSITNRTTHEFALDDIKSIYIQNEGSGYREELNISQKLEKNWITIIYFNHKKNSLKSLHLITDNDHDFKKLISAIYNLKQLRSQLAKEFLIDLNELDENYVKMLLNKELLAGDNGNVDGNEVDIQKSHKHVREFLSFNDILKYSKRLNINVNTNHLQQIFDQVLLLSSATTEKPVSTPLFEKGLNFEQFKQFVSILKDRKDLQEIWDSLAQGKEVLQFDEIKNFIINIQKENFSDDDDNSTINLIFQKYCSNDNGWNKESLNEYLLSSYSTPYREITQTQTNYYDYPLNEYFISSSHNTYLTGRQVAGDSSVEGYIRTLQRGCRCVEIDIWNGDSNTTTTTVIGTKDDDDKNEYEPIVNHGRTFTKPISFANVIRAIKKFAFIVSPWPLILSLEIHCSPECQIKVVNILKDILGENMIIAPIDIDSVILPSPAELKHKFIIKVKKTTSFQNLIETENGSFTTSTTTTTTTTTTTTTTATSLSEDNENNKSNSSSTSSFIIRRRKNKSPKIINELSNLGIYTQGIKFRNFSLPESKTFNHCFSLGEKSINRMIKDDDKKISLDKHNRRYLMRVYPSGTRLKSSNFNPLPYWSHGVQMVATNWQTYDLGQQLNEALFENKIFQGYVLKPSVLRKPTLKSSSSNVDTRTSLTTTNSKTIRFNFEIISGHQLPKFPKDDYKDQAINPYISFEIIGAQDVQWDNNDSSPIAPTTSSSPFIRTTKIIRENGFNPNFNTKFSGSIITTTNDLIFIKFVVYASTSLNYPDYGENFPIAILVTKLNYLKQGYRYIYLNDLLGEQLVYSSIFIKIEYDEDLLNEFINK

SEQ ID NO: 29950 - protein, 473 aa, Yersinia pestis CO92
METKDLACATSSASSKLIHGGLRYLEHYEFRLVSEALAEREVLLKLAPHIAFPMRFRLPHQPHLRPAWMIRTGLFLYDHLGKRTSLPASKGLRFGPESVLKPELVRGFEYSDCWVDDARLVVLNVQEVVKHGGEVRTRTKVTRTWREQGLWMVEALDVNTGKTFTWRAKGLVNATGPWVKQFFDDGLKLKSPYGIRLIKGSHIVVPRVHNQPQAYILQNEDHRIVFVIPWLDDYSIIGTTDVEYHGDPKEVKIDDQEMTYLLKVYNDHFKKQLGRDDIVWTYSGVRPLCDDESDSPQAVTRDYTLDVADEAGQAPLLSVFGGKLTTYRKLAEHALEKLSAYYPNVGPAWTKTGALPGGDIGGSRDSYTVQLRHRYNWLPEGLARRYTRTYGSHSELILANATRLESLGEHFGHGLYEAELRYLVENEWVVELDDAIWRRTKLGMALSDEEKQRVAQWLADAHTEKQQALPLVS

SEQ ID NO: 29951 - protein, 160 aa, Opitutaceae bacterium TAV2
MTSRIGHGYDIHRTLAGRPLVLGGVHFENSDFGLDGHSDADCLTHAVCDALLGAAGLPDIGHFFPNTDPAYKDINSQILLQRTAAELRVRGWEIVNIDATLIAERPKIQPRLADMRLTLAASAGISHEQIGLKATTNEGVGDIGKHLAIAAHAVALIQKT

SEQ ID NO: 29952 - protein, 237 aa, Arabidopsis thaliana
TAASPWLGKTSPMGRLTFLVAARLKDSQNTFAMLTTFNEVDMTNLMKLRSDYKDAFVEKHGVKLGFMSGFIKAAVSGLQNQPIVNAVIDGEDIIYRDYIDISVAVGTAKGLVVPVIRDADKMNFAEIEKEINTLAKKANNGTLSIDEMAGGSFTISNGGVYGSLLSTPIINPPQSAILGMHSIVSRPIVVNGQVLPRPMMYVALTYDHRLIDGREAVFFLRRIKDVVEDPRRLLLDL

SEQ ID NO: 29953 - protein, 223 aa, Triticum aestivum
  misc_feature (10)..(10): Xaa can be any naturally occurring amino acid
  misc_feature (19)..(19): Xaa can be any naturally occurring amino acid
  misc_feature (39)..(39): Xaa can be any naturally occurring amino acid
  misc_feature (46)..(46): Xaa can be any naturally occurring amino acid
FGYARADRKXMGRESIAAXLVADLITEAGAHRVLACDLXSGQSIGXFDIPVDHVYGQPVILDYLASKTICPNDVVVVSPDVGGVARARAFAKKLSDAPLAIVDKRRLGHNQAEVMNLIGDVRGKVAVMVDDMIDTAGTMHKGAELLHREGARAVYACSTHAVLSPPAVERLSGGLFQEVIITNTVPVPPDQRFPQLTVLSVANLLGETIWRVHDECSVSSIFQ

SEQ ID NO: 29954 - protein, 476 aa, Yersinia pestis CO92
MVRFESTDSLMLARQLPNKTVALILAGGRGSRLKDLTATRAKPAVHFGGKFRIIDFALSNCLNSGVRRIGVITQYQSHTLVQHIQRGWSFLNEEMNEFVDLLPAQQRLSTEQWYKGTADAVCQNLDIIRRYDAEYIVILAGDHIYKMDYSRMLLDHVEKGAECTVACIPVPISEGSEFGIMEVTADYQITAFYEKPANPPPIPGDPSNALASMGIYIFNADYLFKLLEEDNNTPGSSHDFGKDIIPQLTARKVVWAHPFDLSCVTSNAELPPYWRDVGTLDAYWRANLDLASVTPELDMYDRAWPIRTHMEPLPPAKFVQDRSGSHGMTMNSLVSGGCIVSGSVVVHSVLFPRVRVNSFCTIDSSLLLPDVHVGRSCRLRRCIIDRACHIPEGMVIGENADEDSARFYRSEGGGGVSDSGYAGKVRGKIEPLGFLFVRLDLLIRLSLLIRLNLFIRMNLLIILTLFFKLASIQASH

SEQ ID NO: 29955 - protein, 196 aa, Prototheca wickerhamii
PAWPADREHMWGASRAAVERCAPAHRHLPPRGTSGVTLSCVPARRAPSGPSTCPSSPWLPAPRAPRRGRPTPWDDVVYRAKDGGLLDVQHDFEALAKYDAKYWKTLFDGRVGTARWPHGSGVWSKKEWVLPQISDDDIVSMFEGNSNLFWAERFGRQIGMSDLWVKQCGNSHTGSFKDLGMTVLVSQVNPAEQDQA

SEQ ID NO: 29956 - protein, 164 aa, Prochlorococcus marinus str. MIT 9312
MNQFFSRRTFILIPTMSILKIIFQPMKVLASSFSSKDEWNLSKDEWKSRLSPESYYILREEGTERAFSSELNNEKRKGVFHCAGCDLPLFLSDKKYDSGTGWPSFWDPIKGSVATKVDFKLIVPRTEYHCSRCGGHQGHVFNDGPLPTGKRYCNNGLALRFVPE

SEQ ID NO: 29957 - protein, 424 aa, Gloeobacter violaceus PCC 7421
MIATIPASTEAFAGRIRTLPNGLTLIVQQIPTAAAVTCDIWVRTGARTEPLQLSGVSHFLEHMIFKGTEKVGPGVFDSEIESRGGVTNAATSQDYTHYFITVANEHYEASLPYLAELVNAAAIPPAEYERERLVVLEEIRRSNDSPDRRAFEILTRTMYPEHPYSRPVLGTAESLLAMTADQMRTYHRERYRPANTTVVIVGGVPEEQMLAAAEALFAPLGEGPTGEVPTVPHPAAPTPGVSTHTLARLEQPRLMLAWLGAAIEQIEDAIALDVLATVLSEGRTSRLVRSLREEKGWARSVNAYFMPQKHPGLFIVSAQADAEWLEPIEAEVRAQVRALVDEPVPDGEFNRALRILRNDFIFSTEAPAQLASLYGYYSTVAKLELALAYPELLQRVQPADLQRVARRYLEPDRAVVLRLVPETP

SEQ ID NO: 29958 - protein, 245 aa, Bradyrhizobium japonicum
MTSEILIAPSILAADFARLGEEIAAIDAAGADWIHCDVMDGHFVPNISFGADVIKAIRPVTKKVFDVHLMIAPVDPYLDAFAKAGADVITVHAEAGPHLDRTLQAVRALGKKAGVSLCPATSEGAIEYVLDRIDLVLVMTVNPGFGGQSFLESQLEKIKRIRTVIGDRPIRLEVDGGITRENAVAVAAAGADTLVAGSAVFRGKSSADYAGNIAAIRVAAEAGRVSKLQDISVQPMRAGESARLR

SEQ ID NO: 29959 - protein, 254 aa, Vitis vinifera
MGRKFFVGGNWKCNGTGEEVKKIVSTLNAGEVPSGDVVEVVVSPPFVFLPLVKSTLRPDFHVAAQNCWVKKGGAFTGEISAEMLVNLGIPWVIIGHSERRLLLNESNEFVGEKVAYALSKGLKVIACVGETLEQRESGSTMEVVAAQTKAIADKVSNWANVVLAYEPVWAIGTGKVATPAQAQEVHSELRNWFQANASPEVAATIRIIYGGSVSGANCKELAAKPDVDGFLVGGASLKPEFIDIIKSAEVKKNC

SEQ ID NO: 29960 - protein, 574 aa, Treponema denticola ATCC 35405
MNKLAEFLPAFMHFSRLENTNLILLLGIILLLGALGGTVFKKLKIPQVVGYIVIGIIIGQSGFQILSAQIITALDPLSSIALALIGFLIGGELKTKVIKKYGTQFVGILIFESIVPFITVSIVISLVAYFVTKNFAASFSIGLILGSISSATAPAATTDVLRENRTKGPLTTTVLGIVAMDDAVALVLYALASSIAASLLGAQTASFGKQILLLLYNIFGSICLGSLIGFLLSLIIRNMMTDSGRILGFSLGCLLLSTGIAYLLALDTILAAMALGFFMVNFAPAKTRSTFTLVENFTPPIYVLFFVLVGAKLNIWNVTPFIGLLALLYVILRTVGKTIGAILGSMLTKAPETVKKYLPFCLLSQAGVAIGLSISAGQDFSDTIGPTILLIVTATTFIVQLVGPIFVKYGVKKSGECGLDVTEEDLITTLSLGDVMLNGKVICSPESPAIISENMPLNEIIDSFSHSPNLNYAVKGDDGRLTGIISLEHLKETLTMTAIYDCVFAMDIMQPADIVCSQKTGLKDLYELYTEKDTYAIPIIGDNGEPLGMAEKDAVDHFLHGKIIELHKNAYGLD

SEQ ID NO: 29961 - protein, 341 aa, Porphyromonas gingivalis W83
MTKRLFLPEWAPQEAVQLTWPHDRTDWAYMLDEVETCFVRIATAILRHERLIVVCPDRKRVFGLLPPELHHRLYCFELPSNDTWARDHGGISLLADGRPMIADFAFNGWGMKFAAHHDNLITRRLHALGLFAEGVTLDNRLAFVLEGGALETDGEGTLLTTDSCLFEPNRNAGLSRTAIIDTLKESLGVSRVLSLRHGALAGDDTDGHIDTLARFVDTRTIVYVRSEDPSDEHYSDLTAMEQELKELRRPDGQPYRLVPLPMAEALYDGADRLPATYANFLIINGAVLVPTYDSHLDAVALSVMQGLFPDREVIGIDCRPLVKQHGSLHCVTMQYPQGFIR

SEQ ID NO: 29962 - protein, 526 aa, Oryza sativa
  misc_feature (104)..(104): Xaa can be any naturally occurring amino acid
  misc_feature (122)..(122): Xaa can be any naturally occurring amino acid
  misc_feature (132)..(132): Xaa can be any naturally occurring amino acid
RGGKSRSESGGQTKKPKTRKVFSPFVAAGDGPGSGLGGPKIHSELRPIPFEDPFGDIYGEGVWRKFSRRASILNRNVVALASFNGEKRFFACTGFFIEWSGSKXMNFDISEALEILVNENKXIDENLRIKVXFLNNQCKEGKLEHCNLHYNIALVSVKYRALRPLNTSFDCKSSRVVAVGRCFNSGTLMATSGRLVPWTGTLDCQFLACSTCKITKAGIGGPLVNLDGNVIGMNFYDTRIGTPFLLWEEICKILASFETKSESSGDIGNASGACFWKMPRDVKNKVNRWSVPKPRWCRPEDAESDDDDKLAFDDTGQLQYSYILGRKVKLLRLTIPISVPIVEAKSTDEPGVDPFAQRKQKKKRVEKQGKNRLENLKKAAKVGALPSHIQLAATSLPITGTKADLPKKSRKEDLENVAGMGSATASGGKFDEKLPGEKPPKHPGKHKKFIPVAEGEGMGNLGKQQNDKILMSLLARNSEQLDVRKANTMYKVKKEKRRRKDREMSSRSDKLKPQKKPFKKLSKKKA

SEQ ID NO: 29963 - protein, 340 aa, Prochlorococcus marinus str. MIT 9312
MTLRVAINGFGRIGRNFMRCWLSRGAYTNIEVVGINVTSDPKTNAHLLKYDSVLGQLDGVDIQYTDDTFVINNKTIKCFSDRNPMNLPWKDWGVDLVIESTGVFNTDVGASKHLEVGAKKVILTAPGKGDGVGTYVVGVNADQYNHKDYDILSNASCTTNCLAPVVKVLDQNFGINKGLMTTIHSYTGDQRILDNSHRDLRRARAAATNIVPTSTGAAKAVALVYPEMKGKLTGIAMRVPTPNVSAVDFVFESSKSVTSEEVNNALKEASLGSMQGIIKYGDEPLVSSDYAGTNESSIVDSDLTMCIGDNLVKVLAWYDNEWGYSQRVVDLAEIVAKKWE

SEQ ID NO: 29964 - protein, 175 aa, Burkholderia sp. 383
MSFNHVPAGKDLPQDFNVIIEIPAQSDPVKYEADKELGLLVVDRFIGTGMRYPVNYGYIPQTLSGDGDPVDVLVITPFPLLAGSIVRSRVLGMLQMTDESGVDAKLVAVPHDKVCPMTANLKSIDDVPEYLKDQIKHFFEQYKALEKGKWVKVEGWAGIEAAHKEITDGAANYKK

SEQ ID NO: 29965 - protein, 479 aa, Burkholderia sp. 383
MEEAKHFIAGEWTLPAQLETIAVVDPSDGQPFASIARGTAPDIERAVAAARDAFAGPWGAASAAERGRVLMRLSARVAGSIEELAAIEARDTGKPLKQARADAAALARYFEFYAGAADKLHGETLPYQAGYTVLTVREPHGVTGHIVPWNYPMQIFGRSVGAALAAGNACVVKPAEDACLSLLRVAELAVEAGLPAGALNIVTGYGHEAGAALARHPGIDHISFTGSPATGKLVTQMAAENHVPVTLELGGKSPQIVFADADLEAALPVLVSAIVQNGGQTCSAGSRVLIERAVYEPLVERLATAFNGLRVGPSRADLDCGPLINAKQQQRVWDFLSDAQHDGIPMAAHGQVVADAPESGFYQAPALLRDVPPSHRLAQEEVFGPVLAAMRFVDEDEAVALANGTPYGLVAGIWTRDGARQMRLARRLRAGQVFINNYGAGGGVELPFGGVGHSGHGREKGFEALYGFTMLKTIAIRHG

SEQ ID NO: 29966 - protein, 236 aa, Microcystis aeruginosa PCC 7806
MTAIDPVIIMKQEVGKAAANLVQSNSVVGLGTGSTTAYAIEYLGARLQSGEISNIVGVPTSFQAQVLARKYGIPLTTLDVIVKMDIAIDGADEVDPQKNLIKGGGAAHTQEKIVDSLADIFVVVVDGNKLVDKLGSTFLLPVEVLPMAMTPVMLKLEALGGKPSLRMGVKKAGPVVTDQGNLVIDVKFDSIDDPADLERTINNMPGVLENGLFVGVADLILVGEIIDGKPVVREIK

SEQ ID NO: 29967 - protein, 372 aa, Gossypium hirsutum
MATPVKPPNGIHYQGKHYYSMWQTTFEIDTKYVPIKPIGRGAYGIVCSSVNRETNEKVAIKKINNAFENRVDALRTLRELKLLRHLRHENVIASKDVMMPTHRRSFKDVYLVYELMDTDLHQIIKSSQVLTNDHCQYFLFQLLRGLKYLHSANILHRDLKPGNLLINANCDLKICDFGLARTSNAKGQFMTEYVVTRWYRAPELLLCCDNYGTSIDVWSVGCIFAELLGRKPIFPGTECLNQLKLIINILGSQKEEDLEFIDNPKARKYIKSLPYSLGSPFSHLYPNAHPLAIDLLQKMLVFDPSKRISVTEALQHPYMAPLYDPNSNPSAQVPLDLDIDEDLGEEMIREKMWKEMLHYHPEAATANGGVCL

SEQ ID NO: 29968 - protein, 304 aa, Zea mays
  misc_feature (174)..(174): Xaa can be any naturally occurring amino acid
  misc_feature (240)..(240): Xaa can be any naturally occurring amino acid
  misc_feature (259)..(259): Xaa can be any naturally occurring amino acid
TFFTPALCLWPDRVHPMPSPSSPPLPPPPGRRRPDAAADPATETTPLHPSFFHDIPLSPPPAGTYIVQVPKDQVLREPPPDRARRYKKLADRPARRRRLRRACCLSCAALLAILLAAAAFAGAVCLVFRPRAPSFSVPSALAIRGLANATATATGAAAPLSPALDAAVRADNGXANGKVGVEYRAGGAVAVSYAGQRLAAGPWPAFRQAPRNVTVVAAAMRGQGLRLSDARRRQLAADRXAGAVPLTLEARVPVRLRFXQGAADVDRPRQGPLRGGRRQAGRGCHRGQQGLQGQGQAAMVVVVR

SEQ ID NO: 29969 - protein, 443 aa, Acidobacteria bacterium Ellin345
MAINRHVVKSTFVSALGGLLFGFDTAVIAGTTHQLTEVFKLTPNALGITVSSALLGTVLGAITAGYPGQRIGRRDSLRIMAIFYMLSALGCALAWNWSSLLVFRVIGGLGIGGSSVLAPMYIAELSPPKWRGRLVGFFQVNIVIGILVAYLSNFVIGRMNFGAMEWRWMLGIAAAPAVLFFVMLFFIPRSPRWLAMKGRTAEALRVMRLTGTDNPEEELNGIVRSIHLERSTKSESLLQRKYLLPIFLAVSAGAFNQLTGINACLYYLNDIFAAAGASKYSAGMQSVLIGCTNLFFTLVAMTMIDKLGRKKLLLVGTTGVCIFLAIIGQIFHSGGHGGSLIWLLIGFMGFFAISQGAVIWVYISEVFPTRVRAQGQALGTSTLWITNALISWMFPVLAAKSSATPFFFFAAMMFIDVLIIAMIYPETSGVSLEQLEQKLGVVE

SEQ ID NO: 29970 - protein, 733 aa, Vitis vinifera
MSTQKKRNFQIEAFKHRVVVDPKYAEKTWKILEHAIHEIYNHNASGLSFEELYRNAYNMVLHKFGEKLYSGLVTTMTHHLEVISKSIEAAQGGLFLEELNRKWADHNKALQMIRDILMYMDRTFIPSTHKTPVHELGLNLWRDNIIHSAKIQTRLQDTLLDLVLRERTGEVINRGLMRNVIKMLMDLGSSVYQDDFEKHFLEVSADFYRAESQQFIECCDCGEYLKKAERRLNEEMERVSHYLDAKSEAKITSVVEKEMVESHMQRLVHMENSGLINMLVDDKYEDLGRMYSLFRRVPNGLFIIRDVMTSHIRSTGKQLVTDPERLKDPVDFVQRLLDEKDKNDKIINLAFNNDKTFQNALNSSFEYFINLNSRSPEFISLFVDDKLRKGLKGVSEEDVEIVLDKVMMLFRYLQEKDVFEKYYKQHLAKRLLSGKTVSDDAERSLIVKLKTECGYQFTSKLEGMFTDMKTSEDTMQGFYASSFAETGDGPTLAVQVLTTGSWPTQPSATCNLPAEILGVCEKFRGYYLGTHTGRRLSWQTNMGTADLKATFGRGQKHELNVSTHQMCALMLFNNADRLSYKEIEQATEIPASDLKRCLQSMACVKGKNILRKEPMSKDIAEDDAFFVNDKFSSKFYKVKIGTVVAQRESEPENQETRQRVEEDRKPQIEAAIVRIMKSRRVLDHNNIVAEVTKQLQSRFLPSPVLIKKRIESLIEREFLERDKVDRKLYRYLA

SEQ ID NO: 29971 - protein, 483 aa, Pseudomonas sp. ND6
MTVQLVIDNQKQSASDGKTFERIDPLSSHAVSVGAACSVEDALRAAQSSERAFQTWSGTGPTERRRILLAAADALEAKMADFCSAMAEEIGASQLWAQFNVGASANLLREAAAMTTQIKGETIPTDKPGALSMTLRQPVGTVLSIVPWNGPVILGARAIAYPLACGNTVIFKGSESSPRTHALLAEAFYEAGLPAGVLNFLISAPEDAAAVTEALVAHDTVRRVNFTGSTKVGRMIAQTCASHLKRCLLELGGKAPFIVLDDADIEGAVNAAVFGAFLYQGQICMSTERFVVDEAVADAFVARFAERVNALETGLPAKSPGCVIGPMIGQGSVQRINHLLDDAVNKGAKIVTGGLAETALMGPTLVDCVTREMAIYDEETFGPVTTIVRVKGAEQALAVANDTAYGLSSSIFSRDVTKALGLASRLDAGCVHINGATVQNEPQAPYGGMKKSGYGRFDGNAVIEEFTEVKWVTVEPSGQPYPF

SEQ ID NO: 29972 - protein, 358 aa, Synechococcus sp. WH 7803
MAQLLVTGGAGFIGSHTCVVLLEAGHDLIVLDDFSNSSPIALTRVAELAGLTSSERSSQRLRPVRGDIRDARCLEQVFSDAAAHLRPIEAVVHFAGLKAVGESVQNPLHYWDVNVGGTVSLLKAMQEFGCRTLVFSSSATLYGYPEAVPIKEGAPIQPINPYGHTKAAVERLLNDLAASAPEQWRIGCLRYFNPVGAHPSGRIGEDPLGRPNNLFPFVSQVAVGRRPEIAVFGGDWPTTDGTCIRDYIHVMDLAEGHRAALDTLLQESPQVLTLNLGSGHGASVLEVIQAFETACGRPIPHSIQQRRAGDAAITVADPAAAKERLGWSTRRNLHDICRDGWAWQSANPSGYGPDPANA

SEQ ID NO: 29973 - protein, 377 aa, Pseudomonas sp. ND6
MSHDNVQKMRIQAAVLRESGAALKVEDVLLEAPRPTEVRVRVVASGVCHTDMVVRDQLFPTPMPIILGHEGAGVVDAVGSAVTTVKPGDHVVMTYMSCGLCLPCETGHPAHCTHMHPLNFGGGRLDGSASSCSCESHAPIHDHFFGQSSFSTYAIANERNVVKVAKEAPLELLGPLGCGIQTGAGSVLNALKVEAGSSFVAFGAGAVGLAAVMAARVAGATTIIAVDVTPSRLELALELGATHVINSRDENPVERIQQITAGGANYSLECSGRAEVLRQAIDALATLGTCGIVGATKFGTEVAFNINEVMIPGKRIMGIVQGDVVANAFIPKLVDLYLQGRFPFDKLCKFYEFDQVNEAMADSERGVTIKPILRMPQ

SEQ ID NO: 29974 - protein, 601 aa, Synechococcus sp. WH 5701
MALLVQKFGGTSVGSVERIQAVAQRIAASRERGHDLVIVVSAMGHTTDELTALARALCPEPPQREMDMLLATGEQVSIALLAMALHSIGVPAVSMTGPQVGIVTESAHGRARILEVRTERLRKRLEEGQVVVVAGFQGTSSGSAGTPEITTLGRGGSDTSAVALAAALGADACEIYTDVPGVLTTDPRQVSDAQLMEEVSCNEMLELASLGAAVLHPRAVEIARNYGVPLVVRSSWSDAPGTRLTSGRPRPIGSEGLELGRPVDGADLENQQAVLALTRVPDHPGVAALLFEALSAAGLNVDLIVQATHVGASNDIAFTLSESQLEGAREVCRSLLQELAVEESALSTQAGLAKLSISGAGIMGRPGIAARLFDTLARYGINLRMIATSEVKVSCLVEGSQGARALRAAAEVFELQEHQLRQNPLPCDVSDPAVRGVALDRNQAQVVVRQVPDRPGTAAAVCRALADAGISLDTIVQSERTHGSGPQLSRDMSFTLRRDDLNRARGALQPVLAPWPEARFEEGLAIARVSAVGSGMPCTPGTAARMFRALAEAGVNIEMIATSEIRTSCVVAEADGVKALQAVHACFQLGDSTSYTLEATA

SEQ ID NO: 29975 - protein, 449 aa, Pseudomonas sp. ND6
MSNAMRTIDVSALIDGARFNAFHARVLVWCALIIIFDGYDLVIYGVVLPSLMTEWGLSSLQAGALGSCALVGMMLGALFFGSISDRIGRRKTIVICVLLFSGVTALNGFASSPEIFALCRFIAGLGIGGVMPNVVALMNEYAPKKSRSTLVAIMFSGYSLGGMLSAGLGMLFIPQWGWQAVFYVALIPLLMLPLLLRQLPESMDFLLRSGQIEQAKSVLALTTPSYLPEADDQLVHAVSRGATASIGELFRDGRLISTLALWVAFFCCLLMVYALSSWLPKIMSSAGYGLNSSLAFLLVLNGGAILGAIAGGWLGDRVGIARVLLLFFACGALSLSLLAIKAPLAVLYLLIAIAGACTIGTQILANACAVQYYPPHVRSTGLGWAMGIGRTGAIIGPVLGGVLHGSSLPLQASFLFFAIPGVIGAAAILVFLKRRKEIPPVQISPQTVS

SEQ ID NO: 29976 - protein, 630 aa, Listeria monocytogenes str. 4b H7858
MKQLKVENLTKTYGGKSLFENISLTITEGERIGLIGVNGTGKSTLLQIISGSESGDKGTVTKAKDYTIGYLAQDPEFNEEDTVLSAVFDGDTAALRAMRKYEEVLLAMSLDAENTKLHDAYTAASQEMDASAAWDMNTEAKTILERLGITDLTAKISELSGGQRKRVGLAQVLIETPDLLILDEPTNHLDFQSIRWLEEYLNRFKGAVLLVTHDRYFLDRVTNHMVELDRGSAYRYVGNYEKFMESKAIRMENEVRESEKNKNLYRKELAWMRRGPQGRATKQNARQDRFHDLEKKVKTKTDDSELAIDFVTSRLGKDVFELKNLEKRFDEKQVLQDFSLIIQPGERLGITGNNGTGKSTLLNMLAGKLAPDAGEVVTGQTVQIGYYTQQNEEMDPDMRMIAYLQEAGEQVTTSGGEVISVSAMLERFLFPPNSHGKKIGSLSGGEKRRLFLLRILMERPNVLLLDEPTNDLDTQTLTVLEDYLESFNGTVITVSHDRYFLDKVVNKLLVFRAIGEVEIFYGEYSDYLKELEAKAKPAKSMKKMANTSVEKAAPEKKEKVKLTYQEQLEWDGIEDAISELEQTIESLNETLEQTGADFTKAAEISELITAKETELEQMMERWEFLSQYAE

SEQ ID NO: 29977 - protein, 250 aa, Coccidioides immitis RS
MASSSKPATSLLYACIAHRTTILAEHSSPGTSSTSASSLASIILPKISHQSAQKLTYTHDRLFIHYIADSPLASASSSEPDSHAPLSYLVVATAELGRRIPFAFLLEIKRKFLSAYSPESIDFGSLPAYGCAAFNNDLRALLQQYNTAPPSDSLASARKEIDNVRDIMTENIERVLERGERIDLLVDKTDRLGSSARDFRVRSRDLRRRMWWKNVKLMALLAVVVLFLIYLFVGIGCGLPAWGRCVGKKE

SEQ ID NO: 29978 - protein, 301 aa, Mycobacterium tuberculosis H37Rv
MARQRFRDQVVLITGASSGIGEATAKAFAREGAVVALAARREGALRRVAREIEAAGGRAMVAPLDVSSSESVRAMVADVVGEFGRIDVVFNNAGVSLVGPVDAETFLDDTREMLEIDYLGTVRVVREVLPIMKQQRSGRIMNMSSVVGRKAFARFAGYSSAMHAIAGFSDALRQELRGSGIAVSVIHPALTQTPLLANVDPADMPPPFRSLTPIPVHWVAAAVLDGVARRRARVVVPFQPRLLMVGDAFSPRYGDRVVRLLESKIFGRLIGSYRGSVYRHQPTESAKAQAAQPERGYSSAR

SEQ ID NO: 29979 - protein, 163 aa, Synechococcus sp. WH 5701
MTVFEGRFTDISGLRIGIVVGRFNDLVTAKLLSACLDALSRHGIDTSPSSEQLDLAWVPGSFEIPLVAQRLAASGRYQVLITLGAVIKGDTPHFDYVCAEVSKGVAAVSRDTGVPVIFGVLTTDTMQQALERAGIKSNLGWSYALQALEMGSLMATLPPVAAG

SEQ ID NO: 29980 - protein, 204 aa, Cyanidium caldarium
GGIAEMSGAEPDVRRITDRLDECGNSTKAFTKGFAVGSAALAGYLLFSSFMEEMSAQLPGKMEFRTVDLAKPEVFTAGLLGAAVVFLFASLAMTAVGRAAQQVVGEVRRQFREHPGIMSGTEKPEYERCVALVATAALRQMVLPGLLPVLAPILIGVVFREIGTLTAQPLLGLECAAGLLMVATITGVLMALFMNNAGGAWDNA

SEQ ID NO: 29981 - protein, 2284 aa, Coccidioides immitis RS
MPLFTSPSDAKPPQTPTSPQRTSRSDSLFPSAPSAGGAVAYVQNEQQPAQSAQSPIAPAVIPPACAQITEDAGRSILLELEDGAIYHGLSFGAERSVAGELVFQTGMVGYPESITDPSYRGQILVVTFPLVGNYGVPSRETMDELAKDIPKHFESSQIHIAGLVVASYCGEDYSHFLAESSLGKWLKEQDVPAIYGVDTRALTKRIREEGSMLGRMMLQKSTSGKDLVNGVPTTADGEDSEMWRENFEEIAWVDPNKRNLVDEVSIKEPRLYSPPKAGLLHPSGRPVRVLCVDVGMKYNQLRCLLARGVEVLVVPWNYDFHSLAKDYDGLFVSNGPGDPAMVSSTVANLAKALEECRTPIFGICLGHQLLARAAGAGTTKMKFGNRGHNIPCTNLLSGRCYITSQNHGFAVDSSTLPEGWEELFVNANDGSNEGIRHVSKPYFSVQFHPESTPGPRDTEFLFDVFINTVKKSIESPSGLNEPVSFPGGTIEENRAAHPRVSVKKVLILGSGGLSIGQAGEFDYSGSQAIKALKQEGIYTILINPNIATIQTSKGLADKVYFLPVNADFVRKVIKHERPDAIYVTFGGQTALQVGIQLKDEFEELGVKVLGTPIETIITTEDRELFARSMESIGEKCAKSASASTLEEAMEVVKGIGFPVIVRAAYALGGLGSGFADNAEQLRDLCAKAFAASPQVLIEKSMKGWKEIEYEVVRDAQDNCITVCNMENFDPLGIHTGDSIVVAPSQTLSDEDYNMLRTTAVNVIRHLGVVGECNIQYALNPFSKEYCIIEVNARLSRSSALASKATGYPLAFIAAKLGLGIPLNEISNSVTKVTCACFEPSLDYVVVKIPRWDLKKFTRVSTQLGSSMKSVGEVMSIGRTFEEAIQKAIRAVDYTNLGFNATNALMSIKTELQTPSDQRLFAIANAMHSGYTVDDIWELTKIDKWFLRKLEGLSKFGKLISTFSASTVPVSLVRQAKQLGFSDRQLSKFLSSNELAIRRLRVEAGIMPVVKQIDTVAAEFPAYTNYLYLTYNGSESDISFNDNGVMVLGSGVYRIGSSVEFDWCSVRAIRTLREQGHKTVMVNYNPETVSTDYDEADRLYFENITLETVLDIYQLESSSGVIISMGGQTPNNIALPLHRLNVNILGTSPEMIDAAENRYKFSRLLDRIGVDQPAWKELTSIEEATAFCDKVKYPVLVRPSYVLSGAAMNTVYSQDDLANYLNQAAEVSRDHPVVITKYIENAKEIEMDAVAKNGVMVGHFISEHVENAGVHSGDATLILPPQDLDPETVRRIEEATRKIGNALNVTGPFNIQFIAKDNEIKVIECNVRASRSFPFVSKVMNVDLIEMATKAMIGKPFVEYPPVNIPKNYVGIKVPQFSFSRLSGADPVLGVEMASTGEVACFGRDRYEAYLKALISTGFKLPNKNILVSIGSYKEKMEMLPSIRKLHQMGYNLFATAGTADFIREHGIPVKYLELLAGEEEDLKSEYSLTQHLANNLIDLYINLPSSNKFRRPANYMSKGYRTRRMAVDYQTPLVTNVKNAKILIEAISRQFEMAVQPIDFQTSHRTVVLPGLINVAAFVPGVANPDSSDFQSVTKASISAGFSMIRVMPVGVDSFLTDARALKIAQHNSQKGTWCDYNLSVAATTSNADQIGQVAADVGSLYIPFNHLAGNINKVGTVTSHFAAWPPTKPIITDAKATDLASVLLLASLHSRDIHVMSVTSKEDINLIALSKEKGLRVTCDVAIYSLFLSTEDYPQCTHLPSKEDQEALWEHLSTIDIFCIGGLPYELAGKEAKPEVGIADALPLLLTAVWEGRLTLDDVTSRLYDNPKRIFELHDQPDASVEIEVDRPYVFQSEGVWSPFNGKTLRGSVQRVTFQGKTSCLDGELVGDAARGTDMSAHRLAPPASPSIKEPPRSPRRDVSVGRRLSFSTTPVARSSRLRPSDAAITSPGNELGPPLYTQLLSVPTASPSLMELLAQSSFKQKHILSVNQFNRADLHLLFTVAQEMRLGVQRHGVLDILKGRVLSTLFYEPSTRTSASFDAAMQRLGGRTVAVATEHSSTQKGESLQDTVRTLACYADAIVLRHPLESSAATAARFSPVPIINGGNGSMEHPTQAFLDLFTIREELGTVSGITVTFIGDLRYGRTVHSLIKLLQFYEVRVQLVAPKDLALPEDVRQHLVTSGQLVLETEELTPEVVARSDVLYCTRVQKERFEDLKEYERLKNSFVVDNSVLKHAKSQMVVMHPLPRNAEIGEEVDFDQRASYFRQTRYGLYCRMALLALVMAP

SEQ ID NO: 29982 - protein, 169 aa, Clostridium perfringens SM101
MFKNLKYDIENVMKNDPAARTKLEVLLLYQSIHVLIFYRIAHGLYKIKLFFLARLISQLGRFFTGIEIHPGAKIGKGIFIDHGMGVVIGETAEIGDNVTIYHGVTLGGTGKDKGKRHPTIGNDVIIGCGAKILGPISIGDGAKIGANSVVLKNVPKGKTAVGIPAVIKN

SEQ ID NO: 29983 - protein, 292 aa, Prochlorococcus marinus str. MIT 9312
MTNPASSLGNKNKFFIFGCGFSGSFFAKTIRQLGYTALTTSRSENKDPHSFVFNSENNIVPNEKIFDGVTHILSCIPPDKNGNDPVLGSLKNKLKSLSLEWAGYLSTTGVYGHTKGDWVSETDQPNPFQNRSHKRLNCEKEWIESGLPVQIFRLPGIYGPGRSTFEAIRNKKIRVISKKNQVFSRIHVADITNAIIYLLENKNSLNFHQIINITDDEPCSQIEVIQYCYDLLGLKMPKPILFEDAKKKLSPIAQSFWMENRKVSNKLLCETLGYKLIYKNYKIGLKNCLLNS

SEQ ID NO: 29984 - protein, 194 aa, Zea mays
METISVQRSSSGKQVSGMRPFKNPRRRSSRGSLSRSGGSLALPNNPASSWGSSPAYPTPPANYSQPPLLPLPRVNSSTLPLQRVKSSHPRVNSSTLYCGQTRATSETQQKKVDYVQSVPRLTRTGSVPVWSNNPCDYPKGFDGYPGPAILLLSPPPSSLPMPKFSIKPKLRCNAEAAGKTELATDNIRRVLQLR

SEQ ID NO: 29985 - protein, 395 aa, Gloeobacter violaceus PCC 7421
MSRLATRVASLTPSLTLAIAAKAKALAAGGVDVCGLSAGEPDFDTPAPIKAAAKAALDRGETKYGPVAGQPRLRERIARKLERENGLPYTPEQILVTNGGKQGLYNAIMALIEPGDAVLIPSPYWLSYPEMVSLAGGTSVLLPTTEATGFKITPEQLEAAITPRTRLLILNSPSNPTGMVYSRPELEAITEVVLRHDLMVLSDEIYEKLVYDGARHHSIGGLGREMFARTITSGGFSKAFAMTGWRLGYLAGPTDLIGAAGAIQSHSTSNVAAYSQAGALAALEDPQVALEVERMVRVFAERRTAMYDAVAAIPGLRCARAQGAFYLLPDISATGLNSTAFCEQLLDQFHVAAVPGIAFGSDSHVRLSYATDLDTIYKGVERLGQFVRQCLAVRA

SEQ ID NO: 29986 - protein, 2194 aa, Medicago sativa
MSNSLSLTFTALNNPQINAISNPNARLRPLARFTRCSATCVERKRWLGTKLRSGGGPERIQLWESGGLGRLPKLRVAVKSSFSAVPDKPMGLYDPAFDKDSCGVGFVAELNGQSSRKTVTDALEMLVRMTHRGACGCEANTGDGAGILVALPHGFYQEVVDFQLPPQGNYAVGMFFLPKSDSRRMESKNIFTKVAESLGHKVLGWRSVPTDNTGLGKSAQLTEPVIEQVFLTPSSDSKVDLEKQMYILRKLSMVSITSALNLQSDGITDFYICSLSSRTVIYKGQLTPAQLGEYYYADLGNERFTSYMALIHSRFSTNTFPSWDRAQPFRVLGHNGEINTLRGNVNWIKAREGLLKCKELGLSENDLKKFLPIVDANSSDSGCFDGVLEFLLHSGKSLPEAVMMMIPEAWQNDKNMDPQRKAFYEYYSALMEPWDGPALISFTDGHYLGATLDRNGLRPGRFYVTHSGRVIMASEVGVVDIPPEDVCRKGRLNPGMMLLVDFEKQIVVNDDALKEQYSLARPYGDWLEKQKIELKDIIDSVHESDIVPPTISGVPPLSNDDVDMENMGIQGLLAPLKAFGYSVESLEILLLPMAKDGVEALGSMGNDTPLAVMSNREKLTFEYFKQMFAQVTNPPIDPIREKIVTSMRCMVGPEGDLTETTEEQCHRLSLKGPLLSTKEMEAIKKMNYRGWRSKVIDITYSKERGTKGLEEALDRICTEAHNAISEGYTTLVLSDRAFSKKRVAVSSLLAVGAVHQHLVKTLERTRVALMVESAEPREVHHFCTLVGFGADAICPYLAIEAIWRLQVDGKIPPKASGDFNSKDELVKKYFKASTYGMMKVLAKMGISTLASYKGAQIFEALGLSSEVIEKCFAGTPSRVEGATFEMLAQDALHLHELAFPSRIFSPGSAEAVALPNPGDYHWRKGGEVHLNDPLAIAKLQEAARTNSVDAYKQYSKTIHELNKACNLRGLLKFKDAASKVPISEVEPAGEIVKRFCTGAMSYGSISLEAHTALATAMNTIGGKSNTGEGGEQPSRMEPLADGSRNPKRSAIKQVASGRFGVSSYYLTNADELQIKMAQGAKPGEGGELPGHKVIGDIAITRNSTAGVGLISPPPHHDIYSIEDLAQLIHDLKNANPAARISVKLVSEAGVGVIASGVVKGHAEHVLISGHDGGTGASRWTGIKSAGLPWELGLAETHQTLVANDLRGRTTLQTDGQLKTGRDVAIAALLGAEEYGFSTAPLITLGCIMMRKCHKNTCPVGIATQDPVLREKFAGEPEHVINFFFMVAEEMREIMSQLGFRTVNEMVGRSDMLEVDKEVVKGNAKLENIDLSLLLRPAAELRPEAAQYCVQKQDHGLDMALDNKLISLSNAALEKGLPVYIETPICNTNRAVGTMLSHEVTKRYNLAGLPADTIHIQFTGSAGQSFGAFLCPGITLELEGDSNDYIGKGLSGGKVVVYPPKGSNFDPKDNILIGNVALYGATRGEAYFNGMAAERFCVRNSGAQAVVEGVGDHGCEYMTGGTVVVLGKTGRNFAAGMSGGIAYVLDVDGTFQSRCNLELVDLDKVEEEEDIITLRMLIQQHQRHTNSLLAKEVLVDFENLLPKFVKVFPREYKRVLASMKSDAASKDAVERAAEDVDEQDDEAQAVEKDAFEELKKLATASLNEKPSEAPKRPSQVTDAVKHRGFVAYEREGVQYRDPNVRLNDWNEVMMETKPGPLLKTQSARCMDCGTPFCHQENSGCPLGNKIPEFNELVYQNRWQEALERLLETNNFPEFTGRVCPAPCEGSCVLGIIENPVSIKNIECAIIDKAFEEGWMIPRPPVKRTGKRVAIVGSGPSGLAAADQLNKMGHIVTVFERADRIGGLMMYGVPNMKTDKVDIVQRRVNLMAEEGINFVVNANIGLDPLYSLERLREENDAIVLAVGATKPRDLPVPGRELSGVHFAMEFLHANTKSLLDSNLQDGNYISAKGKKVVVIGGGDTGTDCIGTSIRHGCTAVVNLELLPQPPPTRAPGNPWPQWPRIFRVDYGHQEAETKFGKDPRTYEVLTKRFVGDENGVVKGLEVVRVCWEKDETGKFQFKEIEGSEEIIEADLVLLAMGFLGPEATIAEKLGVERDNRSNFKADYGRFSTSVDGVFAAGDCRRGQSLVVWAISEGRQRAAQVDSYLTNEDHGIDGNQDEFVKRQQDLNKKHSKHTVMT

SEQ ID NO: 29987 - protein, 85 aa, Triticum aestivum
  misc_feature (21)..(21): Xaa can be any naturally occurring amino acid
  misc_feature (39)..(39): Xaa can be any naturally occurring amino acid
PTPIEQWNMANMAEGTEVWIXRDDLSCMQLRGNKVPKLXLVLTDAAPHGADCAMTGGGIHSNHWRATVAAGKHVNIECYPILRTS

SEQ ID NO: 29988 - protein, 303 aa, Acidobacteria bacterium Ellin345
MALDIAVVGEINLDLILYGLPQEMPLERELLATNFRQTLGSSSAILAHNLSTLGTRVGFTTCVGPDPMGQIALEYLRSAGVDLSHLISSQTTTGVTLLLPHDRDRHILTFPGTMFELKYDHLDLPFLKSASHFHMSSLYLHRGLLPDAGRLFREMKAAGLTTSLDTNDDPDDTWLLLDEIFPHVDIFLPNRQEACRIAQTNDVSEAINRLAERVPMLVVKLGADGALLRKGKEEIRAAGEKVTVVDTVGAGDSFDSGFLHQFLRGAHLQDCLKFGNRTAAYSTTAAGGVEAFRDEKRRKEFLG

SEQ ID NO: 29989 - protein, 480 aa, Synechococcus sp. WH 7803
MPAAPIRSICCIGAGYVGGPTMAVIADRCADIQVTVVDINQARIDAWNDPDLSKLPVYEPGLDAVVGRARSRNLRFSTAVDEAIAAADMVFISVNTPTKTKGLGAGQASDLRWVEACARQVAKSAQGHTIVVEKSTLPVRTAEAVKAILSAAQQSDHGEPRSFAVLSNPEFLAEGTAVRDLESPDRVLIGGEHPEAIDALASVYGHWVPQERILRTNLWSSELSKLTANAFLAQRISSINSVAALCEATGADVREVARAIGTDSRIGPKFLNAGPGFGGSCFQKDILNLVYLCRHFGLPEVADYWESVVNLNSWQQHRIARTVVQKLFGTVTGKRLAILGFAFKADTNDTREAPAIRIARDLLEEGAQLAIHDPKVESEQIARDLGLIASEAPDAESGPTRASLSGEGTWWPSASVADALDGADGVLILTEWNEYRQLDWSDLAQRMRQPAWVFDARSVVSREAIHAAGLQLWRVGDGDA

SEQ ID NO: 29990 - protein, 343 aa, Synechococcus sp. WH 7803
MTTDARPILITGAAGFIGAALAQRLLQRGDRVVGIDSLNSYYDPSLKQARLQQIEAVAAPGAWSFCHQALEAADALQELFAREKPRVVVNLAAQAGVRYSLENPAAYIQSNLVGFGNILEGCRHHGVENLVYASSSSVYGGNRNLPFHEQQPVNHPVSLYAASKKANELMAHTYSHLYGLPATGLRFFTVYGPWGRPDMAPMLFAKAILAGEPIKVFNHGKMQRDFTYIDDIVEGVLRCCDKPATANPNFDALAPDPSTAAAPHRVFNIGNSQPTELLRFIEVMEQALGRQAIKDFQPMQPGDVVATAADTSALESWVGFKPSTPIEEGIAQFAHWYRSFYGH

SEQ ID NO: 29991 - protein, 202 aa, Physcomitrella patens subsp. patens
KRGSVIVIDNYDSFTYNLCQYLGDLGCKIEVYRNDEITVEELKAKKPRGVLISPGPGTPQDSGISLQIVRELGPTIPLFGVCMGLQCMGEAFGGKIVRAPNGVMHGKTSPVFHDEKGEPGLLDGLPSPFTACRYHSLVIEEATFPADQLEVTAWTEDGLVMGVRHKVYKHIQGVQFHPESIRTQNGMQIVGNFLKILDRKEA

SEQ ID NO: 29992 - protein, 205 aa, Oryza sativa
  misc_feature (191)..(191): Xaa can be any naturally occurring amino acid
LNVAIRHNKSISRLSSLSFHTSSLVNSAAANTQQQQQSGPGHFGFYRQVELFYDRAAKILEEKLVADMTKTRLPDEEKLKKVRGILKIIKPCNHVLEIRFPIRRDNGELHMIEAYRAQHSQHRTPCKGGIRYSLDVNLDEVKALAALMTYKCACVDVPFGGGKAGVKINPKDWSEAELERITRRLTVELAXKGFIGPGIDVPAPD

SEQ ID NO: 29993 - protein, 175 aa, Triticum aestivum
  misc_feature (132)..(132): Xaa can be any naturally occurring amino acid
  misc_feature (134)..(134): Xaa can be any naturally occurring amino acid
MAPTVMASSGTSVAPFQGLNSTDGLPVSRRSNGASLGTVSNGGRIRCMQVWPIEGIKKFETLSYLRPIRTEALLKQVEYLIRSKWVPCLEFSKVGFIFREHNASPGYYDGRYWTMWKLPMFGCTDATQVINXCXEVKNEYPDAYVRIIGFDNMRQVQCVSFIAFKPPGCKESGKA

SEQ ID NO: 29994 - protein, 150 aa, Brassica napus
  misc_feature (148)..(148): Xaa can be any naturally occurring amino acid
FVLINEDESEYDTEMSETDEVAQPMVVSKREVDDQMKSMMKDFEGDADKNSWVNFQQRVDKAPEQVVRYCRSSEAKPLWPMASGRVSKSEVPNCKSCGGPRCFEFQAMPQLLFFFGGSNERESLDWATIVVYTCENSCDSSLSYNEEXVW

SEQ ID NO: 29995 - protein, 494 aa, Sinorhizobium meliloti 1021
MQNLPKLSMYIDGQWVAPASGEYIETVDPFTARPWALVPRGNAEDADRAVRAAHRAFSQGPWGKMHPTERGRIIQRFAALIEEHADALADIEVRDNGRLLAEMTHQIRYIPRWYHYYAGFADKIEGTLHPCDKPALSFSRHEPLGVCVGIVPWNAPLLLFSLKAAPALAAGNTLVMKPAEFTSATALKLMELVEKAGFPTGVINVVTGYGPEVGEPLVTHPLTRHVGFTGSTKTGAHLYSLAAKDVKRVSLELGGKSPNIVFGDADLDNAVRGVVGGIFGAVGQTCIAGSRLLVHRSIHDEFLEKLAVFTKTARIGDPRKVETQIGPIANSMQFEKVLGYIDIARREGAELILGGGRPDLEECGTGYFIEPTIFAGVSNDMRIAREEVFGPVLSAIVFDEPEEALAIANDSEFGLGAGVWTSDMRLALKMSERLEAGSVWVNTYRDISYTTPFGGYKKSGIGRENGVAGIYEYLQTKAVWLSTAEEIANPFVIG

SEQ ID NO: 29996 - protein, 412 aa, Gloeobacter violaceus PCC 7421
MNNVLDLDFVRRQFPALMGEWTFLDNAGGSQILGRVVERIADFLLTTNVQIGASYAISEAATARLDLARARMAAYLNAEYPEEIVHGSSTTQLLSNLAAAMAPSLQPGDEIVVTDCDHESNIGPWVRLAHQRGLALKIWKINPETWTLEPEDLEMLLGERTRLVCFTYASNVVGTIQPVAQIVRLAHRYGARVCIDAVAYAPHRAIDVRATGVDFLTFSTYKTYGPHAAVLYGKRDWLLELASLNHYFIGKDDIPYKLQPGNANFELAWGMSGLVDYCEELAALHAQIPADTVHGRVEQAFEPIARHEEYLGARLLAYLTSKPNVRILGLRGADRERRVPTVSFWIPGRHASEIPTRIDPLKIGIRWGDFYARRLIDSLGLTPAGGIVRVSMVHYNTPAEIDRLIVGLESIL

SEQ ID NO: 29997 - protein, 736 aa, Physcomitrella patens subsp. patens
MAAAMTTAMAVNQAVALNKQVLPVSSSSSLLRADASSFFGTQKMNLSKESQSVSIEYLGVQEKSRVVATAVTETDAEYPSEKPLTPLLDTINYPIHMKNLTVRELKQLVDELRAETIHTVSKTGGHLGSSLGVVELTVALHHVFNTPEDKILWDVGHQTYPHKILTGRRGKMRTLRQTAGISGFVKRAESEYDPFGAGHSSTSISAGLGMAVGRDLKGRTNNVIAVIGDGAMTAGQAYEAMNNAGYLDCNMIVILNDNKQVSLPTATLDGPAPPVGALSSALSKLQSSRPLRELREVAKGVTKQLGGSAHVLAAKVDEYARGMISGSGSTLFEELGLYYIGPVNGHNLEDLVTILREVKNTATTGPVLIHLVTEKGRGYPYAERAADKYHGVVKFDPATGKQHKVKTATQAYTTYFAEALIAEAELDKSIVGIHAAMGGGTGMNMFAKRFPERCFDVGIAEQHAVTFAAGLACEGLRPFCSIYSSFLQRGYDQVVHDVDLQKLPVRFAMDRAGLVGADGPTHCGAFDVTYMACLPNMVVMAPADEAELFNMVATAAVIDDSPSCFRYPRGNGIGVQLPANNKGTPIEVGKGRILLEGTDVALLGYGTMVQNCLAAHSLLADVGISATVADGRFCKPLDRGLIRQLAENHQVLITVEEGAVGGFGSHVAQFMALDGLLDGKLKWRPLVLPDRYIEHGAPNDQFAEAGLTAGHIAATALNVLGKTRQALQIMSLAPRS

SEQ ID NO: 29998 - protein, 291 aa, Pirellula sp.
MSVPNVDPSHQSNASANEATRPSPAAEGLDKSGERVREMFRQIAPRYDVMNHLLSLNIDKWWRRKAVQTLKIKGDDPILDLCCGTGDLAIAIADSAGSDVQVIGSDFCHAMLEIARVKESKRTRDTAGGSGRHTIPFLEADSMALPFDDDAFQCVTVAFGLRNIADTDQGLSEMARVCKPGGQVLVLEFSQPTLPVLKQAYNFYFRHVLPRIGQWMARNDKSAYEYLPESVGKFPCGDALAGRMRDVGLQHVTFRPLTLGVATIYVGEKPGGKTDHAEMAAHREREALVAT

SEQ ID NO: 29999 - protein, 1193 aa, Oryza sativa
  misc_feature (27)..(27): Xaa can be any naturally occurring amino acid
  misc_feature (37)..(37): Xaa can be any naturally occurring amino acid
QCRGLVVVLITGCHRFLSPTAVAPRRXPPAAVGTRRXLVAGLRNPSLLVAGLRLAPLVTGLRPPSPLVVGLRTSSTLVAGASAWVVGRRRLGRSVSVSPIRIWIGSHWAQHMRLHMRGQRLWDVLSGELPFPPCPIAPTMPSLASQATDDDRAKAKEQFDDAMENYQSQFALYKAWLDEDARASAILVASMEIHLTGEVVTLTSAHLMWTHLRDRYAPTSDALYLAMCCQRQRSHMDLRRIYDFFTRLRSEYESTRAQLLARHPRVTIMEALTEIRSEDIRLREAVVPSGRGHLHFTYYDKDGHVESFCFRKKDLRRGNSSKGTSGSSQKSAGGSDSQEILMLLRRLTASAATGSVGSVALPSAQFGSAVLGSSSSTEGPSSAPVPTTVHTVDGTPLAVVGRGTLSTSSFSVPAVSYVPKLAMQLMSAGQLTDHGCRVILDSDSCCVQDRHTGLLVGTGPRRRDSQRLWDLDWLRLPFAAPASLLASAASSMVSFAQWHHRLGHLCGSRLSALVRRGLLGSVLGDVSLDQCQGCKLGKQIQLPYHSSESVSKRPFDLVHSDVWGPAPFVSKGGHRYYIIFIDDFSRHTWIYFMTHRSEVLAIYKSFARIIRTHFDSPIRVFRADSAGEYLSIELRVFLSEQGTLSQFSCPGAHAQNGVAERKHRHLLETARALMIASSVPPHFWAEAVSTANYLTNIHPSSALQGGIPIEHLCEDRYGYVATVLAEPRSYRDAVVHQEWQHAMAEELAALERTGTWDLVPLPSHACPITSSAHHWNISQLDVKNAFLNGELHEEVYMRPPQGYSVPEGMVCRLRRSLYGLKQAPRAWFQRFSSVVLEAGFSASAHDPALFVHTSPHSRTILLLYVDDMLITGEDAEFITFVKARLSEQFLMTDLGPLRYFLGIEISPTPEGFHLSSQGYSDATWASDSSDRRSLFAFCVFLGGSLIAWKTKKQTTVSRSSAEAELRTMALLTAEVTWLRWLLEDFGVFVTSPTSLLSDNTSAISIARDPIKHELTKHIGVDASYTRTQGIGGVGSVAAEMLTRCGIGRLLLYDYDTVELANMNRLFFRPDQVGMTKTDAAVQTLSGINPDVTLESYSLNITTVKGFETFLGSLKARSSDGRNTGVDLVLSCVDNYEARMVVNRHAMNLARHGWSLVSQKMLFLVIYSCWFLVKQHVLHVLLHWLLHPEWMSAH

SEQ ID NO: 30000 - protein, 154 aa, Prototheca wickerhamii
SAKRSVVSVSALAVGDKLPSDIKLSYFDVEGNMQETTVGSLTKGKKVVFVVVPGAFTPTCSLKHVPGFIDNADKLKAKGVDTIGCVSVNDAFVMDAWAKQLGADGKILMLADGSGTFTKAVGAELDLSDKGLGQRSRVYSMLVEDGVVKVVNNG

SEQ ID NO: 30001 - protein, 387 aa, Prochlorococcus marinus str. MIT 9312
MAIQQKLSLMIPGPTPVPEKVLQALSKHPIGHRSKEFQDLVESTTKNLQWLHQTQNDVLTITGSGTAAMEAGIINTLSKGDKVICGENGKFGERWVKVAKEFGLEVIKIDSEWGTPLDPEEFKKVLEEDNQKEIKGVILTHSETSTGVINDLETISSYIREHNTALSIVDCVTSLGACNVPVDEWKLDIVASGSQKGYMIPPGLSFIAMSQKAWEAAEKSNLPKFYLNLKSYRKSLLSNSNPYTPAVNLVFALDEALTMMREEGLDNIFNRHNKHKLAMSNAVKALNLKLFADEKYLSPSITAIETGEMDAEEFRKTIKNNFDILLAGGQDHLKGKIFRVGHLGYVNDRDIITVVSAISNTLLELGKITAQQAGEALVVVSKYLDGN

SEQ ID NO: 30002 - protein, 528 aa, Prochlorococcus marinus str. MIT 9312
MSQTSLKKERDPSILILDFGSQYSELIARRIRETNVFSLVVSNCISIEEINDINPKGIILSGGPNSVYEKNAPKCDEKIFNLGIPILGICYGMQLMVKELGGSVTSATKKAEYGRAPINIDQESELLSDVEDKSIMWMSHGDSINCLPDGFNKIAHTENTLHAAISNDRKKLFGVQFHPEVIHSEFGITVIKNFVYGISSCVADWTTETYIEETIPRIRDQVGNKKVLLALSGGVDSSTLAFLLNKAIGNQLTCMFIDQGFMRKGEPEFLMNFFDKKFHIKVEYINARERFISKLKGITDPEQKRKIIGEEFIRVFEEESNRLGPFQYLAQGTLYPDVIESAGTNIDPKTGERIAVKIKSHHNVGGLPKDLQFKLVEPLRKLFKDEVRKLGAALGLPDEIIKRHPFPGPGLAIRILGEVNNEKLDCLRDADWIVRDEIKKAGLYNDIWQAFAVLLPVKTVGVMGDKRTYAWPIVLRCVSSEDGMTADWSKIPFPILERISNRIVNEVVSVNRVVYDITSKPPGTIEWE

SEQ ID NO: 30003 - protein, 254 aa, Desulfotalea psychrophila LSv54
MNKPGKMDRFSRLKALIGEKRVERLAARSVTIVGIGAVGGHAMEGLARSGIGHLRLVDFDRIDPSNINRQLLALDSTVGRLKVELAQERIYQINPQCKVEILPLFANQESIDKILDPKPDLLIDAIDALNPKTCLLEAAFRHKIPTISSMGAALRTDPTKITYGDIFDTRGCPLAKQLRKRLRNRGIGEGIFCVYSHEAVNFNYGNEGADEPNDKSLGRSRNILGSTPTIPAIFGLTIANQAIFALAEKEISFS

SEQ ID NO: 30004 - protein, 195 aa, Prototheca wickerhamii
TLHQNLRPQLPMGFSTMPAVSAPCLRAFTHGPRYMPGRPPRSSRNHLQSPRGTAEVSSPPSSANRVHPLSVFDFRVYMSQRAALVDAALDVAAPLQYPERLHSAMRYSLLGGGKRVRPALCLAACELVGGCLEVAMPAACAVEMIHTMSLIHDDLPAMDDDDVRRGQPANHRAFGEDIAILAGDALLALAFEHVA

SEQ ID NO: 30005 - protein, 342 aa, Bacillus anthracis str. Ames
MTRVAINGFGRIGRMVFRQAIKESAFEIVAINASYPSETLAHLIKYDTVHGKFDGTVEAFEDHLLVDGKMIRLLNNRDPKELPWTDLGVEVVIEATGKFNSKEKAILHVEAGAKKVILTAPGKNEDVTIVVGVNEDQLDITKHTVISNASCTTNCLAPVVKVLDEQFGIENGLMTTVHAYTNDQKNIDNPHKDLRRARACGQSIIPTTTGAAKALAKVLPHLNGKLHGMALRVPTPNVSLVDLVVDVKRDVTVEAINDAFKTVANGALKGIVEFSEEPLVSIDFNTNTHSAIIDGLSTMVMGDRKVKVLAWYDNEWGYSRRVVDLVTLVVDELAKQENVQHI

SEQ ID NO: 30006 - protein, 503 aa, Mycobacterium sp. JLS
MLRRRALTEDAARPEAVARRHEAGGRTARENIADLVDEGSFVEYGRFAIAAQRARRDLDDLIARTPADGLIAGTARIGGAACAVLSYDYTVLAGTQGALGHRKKDRLFDLIERMRLPTVFFAEGGGGRPGDTDFPVASSLDVRAFKLWAGLSGLVPRIAVVKGRCFAGNAVIAGCADLIVATSDTSIGMGGPAMIAGGGLGDVPPDAVGPITTQEPNGVVDIVVDDEAQAVAVARTLIGYFGGPAAPGEAPDQSALRTAVPERARRAYDVAPIIRTLADDGSATFLRERFAREMVTALIRIEGRPVGVLANDTRFMAGAITAAASDKAARFLQLCDAFDIPVLSLVDCPGYMVGPAAEAEALVRRGSRLLVAGAALQVPLIAVVLRRGYGLGAQAMTGGGLHEPLLTVAWPGAHLGPMGLEGAVRLGLRKELEAIADDAEREEAVRRATAAAEDNAKALNAAAVFEIDDVIDPAETRSLVAATLAAASAAPRERHPHRFVDTW

SEQ ID NO: 30007 - protein, 853 aa, Ipomoea trifida
MRNAAEDHRYPLWFFLISQIFIGNLAVALAVDSITPTQPLAGNRTLVSSDGLFELGFFTPNGSDQSYVGIWYKEIEPKTVVWVGNRDGASRGSAGILKIGEDGNIHLVDGGGNFIWSPTNQSAARNTVAQLLDSGNFVLRREDDENPENYLWQSFDYPTDTLLPGMKLGWDSKTGLNRYISAWKSLNDPGEGPISFKLDINGLPEIFLRNRDKIVYRSGPWNGVRFSGVPEMKPTATITFSFVMTKNERYYSFELHNKTLYSRLLVTRNGNLERYAWIPTSKIWSKFWYAPKDQCDSYKECGTFGFCDTNMSPVCQCLVGFRPKSPQAWDLRDGSDGCVRYHELECRKDGFLTMNFMKLPDTSSSFVDTTMNLDECMKMCKNNCSCTAYTNSNISNGGSGCVIWTTELLDAAVRGGRRWPSCLHPRSASDVAQGGDSGDASGRTKRIIIACGIAVGVGILLFALSALFILKRRQSKRALGKNTELRGFRDRSQDLLMNAAVIPSKREYSGETMTDEFELPLFDFSTIVVATDNFADVNKLGQGGFGCVYKGMVEGEEIAVKRLSKNSGQGVEEFKNELRLIARLQHRNLVRLLGCCVDMEEKILIYEYMENKSLDSTLFNKQRSSLLNWQTRFNIICGIARGLLYLHQDSRFRIIHRDLKASNILLDKEMNPKISDFGMARIFGGDETDANNTKRVVGTYGYMSPEYAMDGLFSVKSDVFSFGVLVLEIVTGKKNRGFYNQNNQQNLLGHAWRLWRERRGSELLDSAIGESYSLCEVMRCIQVGLLCVQEQAEDRPNMATVVLMLGSESATLPQPKHPGFCLGSRPADMDSSTSNCDESCTVNQVTVTMLDGR

SEQ ID NO: 30008 - protein, 350 aa, Debaryomyces hansenii CBS767
MSLPVETLRDSQPFIKTSLVEVTKDLPNKPPCRVFLKNEYEQPCGSFKLRGISNLIYRLIQKAKKEKIDKTLYVFASSGGNAGLAAAYLARYFRIGCTVVLPTTSKPEIIEKLQSYGAKTIMHGKNINEADGYLKNMMRNIDLNIYPIYCHPFDNPLIWEGHSSLVDEVYQEQLSYNDSQKVKGIVCSVGGGGLYNGIMKGLEQNKTNKDTSLMLVETNQAPTLLETIKAGEVFTLDSVNSLATSLACSYLSEQSLDNYYNSKFKTYVDSIDDLDAIQGLIDFYSNSGVVVEPACGTALSLVYNRMDILTKHYTNLSPDDIIIVVACGGSCTNLEGVENFKKMLNTTCKL

SEQ ID NO: 30009 - protein, 299 aa, Bacillus cereus ATCC 14579
MKTINVFHYDAFTNKPNKGNPAGIVLEADGLTEEEMQIIAEKVGYNETTFVLSSEVGDIRMRYFTPGFEMDLCGHGTVGTIYALREKGLLEEKSNLTIETKAGILPIQIVVNENGETFIKMRQTAPQFKDFAGSKEELAHSIGLEVNDLDVSLPIVYGSTGNWTVIVPIKNLDACERMKPNNAAFPSVLKEIPNASIHPICLETYDELAQMHGRHFSSAYAGTIEDPVTGTASGVMGAYYAEYLEKDFEHELDLIVEQGQEINKDGRVTVYVTKGIENEKLQIDIAGTAVYVKEFEVLI

SEQ ID NO: 30010 - protein, 253 aa, Debaryomyces hansenii CBS767
MPPKKSKNDSKVLKTDSKLLKKFKFPDNFNNLLINYSKQFFKPQPETLISDQIIIVEKFFSNELCNELIKSFESSPDLKMETTPLIKSKDYAARFNDRGFSVDFDASRNLWSYLQKILLRDVEYEDDDDNDVKLIFNDAIALNSQLRIYRYRKGHHFGQHYDESVICPLTEDKNNQKGITKWTLLIYLTGDDEFKGGGTIFYPDYSSAKHLNVHPSKGMALLHKHGDDCLRHEAELVEDGVKWVLRSDVVYPS

SEQ ID NO: 30011 - protein, 229 aa, Physcomitrella patens subsp. patens
MAEAAPSSHAGASWSPYDNNGGTCVAIAGADYCVIAADTRMSTGFSILTRDYSKIHQITEKCVLASSGFQADVRSLQKNLDARHQIYQHQHNKQMSCPAMAQLLSNTLYYKRFFPYYAFNVLGGLDNEGKGCVYTYDAVGSYERSGYSSQGSGQTLIMPVLDNQLKSASPLVLPPRESSTPLTENEAVDLIKDTFASAAERDIYTGDGVEIVIINKDGIRRETMPLKRD

SEQ ID NO: 30012 - protein, 482 aa, Malva canariensis
  misc_feature (9)..(9): Xaa can be any naturally occurring amino acid
SGVSTLDKXNLGRISQIIGPVLDVAFPPGKMPNIYNALIVKGRDTAGQQINVTCEVQQLLGNNRVRAVAMSATDGLTRGMEVIDTGAPLSVPVGGATLGRIFNVLGEPVDNLGPVDTRTTSPIHKSAPAFIQLDTKLSIFETGIKVVDLLAPYRRGGKIGLFGGAGVGKTVLIMELINNIAKAHGGVSVFGGVGERTREGNDLYMEMKESGVINEENLGESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLLEQAFYLVGNIDEATAKGTNLE

SEQ ID NO: 30013 - protein, 674 aa, Saccharomyces cerevisiae
MTNKSSLKNNRKGVASNTLSGAEQANIGSSAMPDTNSTGPFSSVSSLDTPVVRKSTSPTGSQTKSIMNASGTSGAVVSNTPEPGLKRIPTVTFSDPKLGSLRSDVEQTPPNQVARQSSEKKATSVHIAAEGANQGRNLKDINTKVPKDGEASASSFSTPTSILSNADMGNNISSLLAKKLSFTGGTDSILNSDNSSDSPRKEHPHFYVEDPLHTPSVRSRSNSTSPRPSVVVNTFNPINIEREGSISKTGEPTLLESVLEEAMSPNAVSNPLKRENIMTNMDPRLPQDDGKLHVLFGATGSLSVFKLKHMIRKLEEIYGRDKICIQVILTNSATKFFAMKYMRKNKKQHNSIDTSFNSTNSNAGNITGNKKKVASLEKFSIQKTSSNSAASQTNNKQEEEKQMASTTGFPSTLGGSRTYSNSSNVVSQHPQIELPAHIQFWTDQDEWDVWRQRTDPVLHIELRRWADILVVAPLTANTLAKIALGLCDNLLTSVIRAWNPTFPIFLAPSMGSGTFNSIMTKKHFRIIQEEMPWVTVFKPSEKVMGINGDIGLSGMMDANEIVGKIVVKLGGYPDVSAGKEEEEDEDNDEEDDNKKNDTGGKDEDNDDDDDDDDDDDDDDDDDDDDDDDDDDDDDDDDDDDDDDDDDDDDDEDDEDEDEDDEGKKKEDKGGLQRS

SEQ ID NO: 30014 - protein, 364 aa, Methanocaldococcus jannaschii DSM 2661
MKLHEYEAKNIFKKYGIPVPESFLVSKEDDLNSINVDKEVVLKAQVLVGGRGKAGGILFASNKEEFIKKAEELFNKEVKGEKVEKILVEEKLPIEKEYYVSIIIDRDAKKPLIIFSTEGGVDIEEVAEKNPEKIIKYHIDVRKPFLPYIARWIVKEAKLPSNEIGKVADVIYKLYKIFKELDATMVEINPLVITKDGNVYAADAVLHLDDDAAFRHNYEEFEEYKNKEKLPFAYVELDGDVAVIGNGAGLTLASMDIINNLGRKPACFLDIGGGADAETVKLALRKVLENKNVKGIFINILGGITRCDEVAKGIVEVLKEHPNVKFAVRMMGTNEEIGRKILEEHGIPYETSMEEAGRKLIEQL

SEQ ID NO: 30015 - protein, 185 aa, Zea mays
  misc_feature (16)..(16): Xaa can be any naturally occurring amino acid
  misc_feature (41)..(41): Xaa can be any naturally occurring amino acid
  misc_feature (46)..(46): Xaa can be any naturally occurring amino acid
  misc_feature (61)..(61): Xaa can be any naturally occurring amino acid
  misc_feature (69)..(69): Xaa can be any naturally occurring amino acid
  misc_feature (83)..(83): Xaa can be any naturally occurring amino acid
  misc_feature (135)..(135): Xaa can be any naturally occurring amino acid
  misc_feature (149)..(149): Xaa can be any naturally occurring amino acid
  misc_feature (164)..(164): Xaa can be any naturally occurring amino acid
KCTRHREAISFARRIXAAPEAPVRQSLRRDAFRLRRGTGPXHCSPXRRVVDAGAAHSMTTXRGSFHLTXGKSEGNKDMNELRXGKGANLVDMASITLSVPAEFTVSTEASHQYQDAVCTLPAGLWPEIYYRLQWXEEYMGATLVDTQKXLMLFVRSGSRHVHAXMMDTVLNLLLNDRTGQRTGGQ

SEQ ID NO: 30016 - protein, 424 aa, Gibberella zeae PH-1
MAANLEAPGAPAERITSTASTIADYAYPYGHLGHLTQKQEEAFVQFKKVLEERGLLTPAHDDPLILRYLRARRWNVEDAYTQFKETEDWRKANDLNVLYDTIDLSAYDFSRRLYPQWTGRRDRRGIPLYVFEVKTLDSKTVHEYEKVGASSTFSQAKSDGKTPNGLLRLFALYENLTRFNMPFCTQLLDRDHPEVPITLSTNIVDISGVGLKQFWNLKQHMQAASQLATAHYPETLDRIFVIGAPAFFSTVWGWVKRWFDPITVSKIFILGSHEVKTVLEQYIEPRNIPKKYGGELDYNFGELGNPDPNWQGVVEFENGHKTFPSGPLLWEEDGNDRLVCVAKGSKDGKPRNERICTIPKTFGLSPVVEIGGHAPVDAAPVNGVADGTAGAEGAQTDDSTLSGEVNEKLKIQEDKPAVPQTTAA

SEQ ID NO: 30017 - protein, 305 aa, Methanocaldococcus jannaschii DSM 2661
MILVTGGAGFIGSHIVDKLIENNYDVIILDNLTTGNKNNINPKAEFVNADIRDKDLDEKINFKDVEVVIHQAAQINVRNSVENPVYDGDINVLGTINILEMMRKYDIDKIVFASSGGAVYGEPNYLPVDENHPINPLSPYGLSKYVGEEYIKLYNRLYGIEYAILRYSNVYGERQDPKGEAGVISIFIDKMLKNQSPIIFGDGNQTRDFVYVGDVAKANLMALNWKNEIVNIGTGKETSVNELFDIIKHEIGFRGEAIYDKPREGEVYRIYLDIKKAESLGWKPEIDLKEGIKRVVNWMKNNNRT

SEQ ID NO: 30018 - protein, 547 aa, Clostridium perfringens SM101
MAYKALYREWRPQTFNDVVGQEHITTTLKNQIINERTAHAYLFCGTRGTGKTSTAKVMAKALNCLDLKDGEPCNQCEMCKKINEGLAIDITELDAASNNGVDNIRDIIDDVQYPPQEARFKVYIMDEVHMLSIGAVNAFLKTLEEPPKNVVFILATTDPQKLPITILSRCQRFDFKRISRKDITGRLRKIVTEQGIFCDDKSLDLVARVSDGAMRDSLSILDQAISIGDGKVDYDELVSMLGLVTNDNLFKIVDSIIKRDIESAMEIIEELVLTGKDMTLFIKDLIVHYRNLLMIKVTSNPEEVLDTAEENIEKLKVQGAKLKVEEIMRCIRIVQECDEEAKLSKQARVYLELAVIKMCKIEYDTSKEVMLARINKLEQAIRSGNIQVNTNLEEVKSQVSNEASNNKTLNNKQQNVIKSSNNYEVVNENSTLTPEYLRKVWKDILETFKSRGKYMVYIALAKGISKVSCNKGVVEFRYTYEYRHNKERLEKHDFSKIVNDIFSEVLKEPVRVVYSVEQGTEEEKAEEADLEARLSGIMGDGLEIVEE

SEQ ID NO: 30019 - protein, 447 aa, Yersinia pestis CO92
MNGLVSLESFLESLQRRDANQPEYLQAVREVFTSLWPFLEQNPHYREQSLLERLVEPERVIQFRVAWTDDKGHVQVNRAWRVQFSSAIGPYKGGMRFHPSVNLSILKFLGFEQTFKNALTTLPMGGGKGGSDFNPKGKSQAEVMRFCQALMTELYRHLGPDTDVPAGDIGVGGREVAFMAGMMKKLSNNTACVFTGKGLSFGGSLIRPEATGYGLVYFTDAMLKRHGLGFEGRKVSVSGAGNVAQYTIEKAMELGAKVVTASDSGGTVVDEVGFTPEKLAHLAEIKNKRYGTIEDYARERNLVYLAGQQPWSVPVDIALPCATQNELDLPAALQLIANGVKAVAEGANMPTTIQATDAFLEAGVLFAPGKAANAGGVATSGLEMAQNAARMSWKSEKVDVRLHHIMLDIHQSCVEYGGEGKQTHYVHGANIAGFVKVADAMLAQGVL

SEQ ID NO: 30020 - protein, 391 aa, Zea mays
MQGPGRGARWSLRLLSGCPRRNLEDTHLRSSLTPAACIPLPMAAGLGARPSATFEAGRFRPLAAPLRPVRSGKFVVPKRCFTVSSRLAWVEDELMEIKKSQEQSSVKSKKRPPLRRGKVSPQLPVPGHIPRPSYVGSKGLPELCKGQLHDAQGIAGMRAACKLAARVLDFAGTLVKPSITTNEIDEAVHNMIIEAGAYPSPLGYHGFPKSICTSVNECVCHGVPDSTQLQNGDIINIDVNVFLNGYHGGTSRTFACGQVDDSIKHFLNAAEECLEKGISICRDGVNYRKIGKKISKLAYFYGYYVVERFVGHGIGTMYHSEPLILHHANENSGRMVEGQTFTIEPILTMEKTECVTWEDGWTTVTADGSWAAQFEHTILVTRDGAEIMTKV

SEQ ID NO: 30021 - protein, 551 aa, Gloeobacter violaceus PCC 7421
MTSSPTAAARTEGEAAPTVPTQVESGTAQRPGLAREMVAILDFGSQYSELIARRIRETKVYSEVLSYQTPIAEIRRLAPKGIILSGGPNSVYEAYAPQCDPALWELGIPILGVCYGMQLMVQQLGGAVERAERAEYGKASLFINDPTDLFTNVEDGTTMWMSHADSVLRMPEGFELLAHTENTPCAAIAHHSRHLYGVQFHPEVVHSRGGMALLRNFVYHICGCEPEWTTAAFIEEAIREVRARVGDKRVLLALSGGVDSSTLAFLLHRAIGDNLTCMFIDQGFMRKNEPERLVKLFKEQFHIPVAYVDAAERFIVRLEGVSDPEQKRKIIGAEFIRVFESESQRLGPFDYLAQGTLYPDIIESAGENIDPKTGERVAVKIKSHHNVGGLPENLRFKLVEPLKRLFKDEVRQVGRALGLPEEIVQRQPFPGPGLAIRVLGELTKDKVDILREADFILRQEVNRSGRYNDYWQSFAVLLPVKTVGVMGDRRTYAYALALRFVTSEDGMTADWARVPYDLLEQIANRIVNEVPGINRVVLDITSKPPGTIEWE

SEQ ID NO: 30022 - protein, 152 aa, Prochlorococcus marinus str. MIT 9312
MTKERTFIAIKPDGVQRGYVSEIIGRFEKKGFKLVGLKQLIPSKDLAQNHYGVHRERPFFGDLVDFISSGPVVAMVWEGEGVILSARKLIGATKPLEAEPGTIRGDLAIDIGRNIIHGSDGEDTAKFEIDLWFNEEELCEWYTSDSKWRSEN

SEQ ID NO: 30023 - protein, 274 aa, Triticum aestivum
  misc_feature (16)..(16): Xaa can be any naturally occurring amino acid
  misc_feature (209)..(209): Xaa can be any naturally occurring amino acid
  misc_feature (261)..(261): Xaa can be any naturally occurring amino acid
AGRAGLSCANGPDFLXISSWDNKVRIYEIATNGQSQGRHAYEHSQPVLSCDFSKDGTKIVSAGADKNIKVCDLASQQDIVVGTHDQPVRTARFFDSGNGPMVVSGSWDKTVKYWDLRQQGPAATVACQERVYTMDVRDNLCVVGTADRYINVIDLKNPTKFYKTLQSPLKWQTRVVSCFTDSAGFAIGSIEGRCAIQYVEAKDSSANFXSFKCHRDPPANGVTNVHAVNDISFHPVHGTFSTAGSDGTFHFWDKDAKHRLXGYPNVGGSINSTT

SEQ ID NO: 30024 - protein, 235 aa, Brassica napus
  misc_feature (210)..(210): Xaa can be any naturally occurring amino acid
MGSLSTILRHPDEIYPLLKLKLAIIKAQNQIPLDDPHLALCYSLLQKVSRSFSLVIQQLGTELRDAVCVFYLILRALDTVEDDTSIPMEIKVPILLAFHRHIYDRDWHFICGTEEYKVLMDQFHHVSAAFLELEEGYQEAIEDITKRMGAGMAKFISKEVETVDDYDEYCHYAAGLVGLGLSKLLLTSGLETLTPDWQQISNSTGLFLQXKTNIIKDYLEDINEIPKPRMFWPRE

SEQ ID NO: 30025 - protein, 323 aa, Zea mays
IRLELEPPALACGCTVVVKLSELTPLTSLAAADLALQAGIPAGALNVVMGNAPEIGDALLQSTQVRKITFTGSTAVGKKLMAESANTVKKVSLELGGNAPCIVFDDADIDVAVKGSLAAKFRNSGQTCVCANRILVQEGIYEKFASAFIKAVQSLKVGNGLEESTSQGPLINEAAVQKVEKFINDATSKGANVMLGGRRHSLGMSFYEPTVVGNVSNDMLLFREEVFGPVAPLIPFKTEEEAVHMANDTNAGLAAYIFTKSIPRSWRVSESLEYGLVGVNEGIISTEVAPFGGVKQSGLGREGSKYGVDEYLELKYICMGNLG

SEQ ID NO: 30026 - protein, 270 aa, Oryza sativa Japonica Group
MAAAETSGTVAAPGRWSLHGKMALVTGGTRGIGRAVVEELAALGAAVHTCSRNEAELGERLKEWEARGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGILANKEFEGSVKSRTPLRRVGEPAEISSLVAFLCMPGSTYITGQTIAVDGGMTVNGLYPS

SEQ ID NO: 30027 - protein, 96 aa, Zea mays
VTTRARPSHKCAGLLAVKPLVRTFVMIKPGGVQRGLIGEIMSRFEKKGFYLRASVLVNLDRSVAEKHYTDLAFKPFFQGLLGYLISGPVAAMDWEG

SEQ ID NO: 30028 - protein, 227 aa, Candida albicans
NHHDDHHKDKHHKGKHHKDDKHHKDKDGKPKKPEHPPHEPPHEPPHESPHEPPHEPPHEPPHEPPHEPPHEPPHEPPHEPPHHPPHESPHEPPHEPPHEPPHEPPHEPPHKPPHEPPHEPPHEPPHEPPHKPPHEPPHHPPHEPPHEPPHHPPHEPPHKPPHKPPHEPPHHPPHEPPHKPPHHPPHEPPHPPPHPPPHDPHDPNHHHGKYHEERRIFTEAKPADEIY

SEQ ID NO: 30029 - protein, 304 aa, Oryza sativa
  misc_feature (49)..(49): Xaa can be any naturally occurring amino acid
EIKKEKLLANLERWGRNSGSTTRRAGGGTGAEAAGGDEAWCRETVPRVXELVSPRLPQRDACALLAVSPWCHRALVANPKLWEVLDLHEMNKAGDRRISAISLPRYCHLKIINLEFAQDIDDRHFVRLKEMGCTSLQELELLNINACQKVSDKGIETITSLCPNLRALSIYWIVGLTDLTIRHIVQNCKHIVDLNLSGCKNISDQGMQLVADNYEGLKKLNITRCIKLTDDGLQEVLQKCSSLESLNLYALSGNIGKSNDVYMRTRVSIIYHPTSHPAVLATRFIRDRIFNYLTFLTFVGPRWN

SEQ ID NO: 30030 - protein, 477 aa, Methanococcoides burtonii DSM 6242
MNLPDHKTKIVCTIGPASSSEEMLRELIFAGMNVARINFSHGSFEDHSKVIRLIKKLCDELNVIVSVMADLPGPKIRVGEIKDSPINLQKGDKVKLTTKRIVGSKDLIPVDFDKLPYCIAKKSDVYFNDGFIQMRCSGICSNEAECEVIVGGQLSSHKGVNLPGIDLLLDPVTEKDLKILDFALDEGVNCFSVSFIEQGSDIQKIRDHATKKGRSVFLVAKIERGHSVGNIDDIMEATDALMIARGDLGVEIPIEEVPIVQKELIHKANLRGMPVITATHMLESMTDNVRPTRAEATDVANAILDGTDAIMLSGETAVGKYPLEAVHTMVRIARKTEAWRDSTGNGMGNIRNAIGETEMGISDVISLQVYDAIRKLSIELVVTPTHSGATPRRISRFKPDNWIIAMSHVELTCEQLAYSYGVYPISVSDSSEDLEKKMLGALLSRGIGKSGNTIVLTQGSSGGTNLLKIIELDQLVE

SEQ ID NO: 30031 - protein, 585 aa, Bacillus anthracis str. Ames
MRKTKIVCTIGPASESIEKLEQLIEAGMNVARLNFSHGSHEEHGARIKNIREASKKTGKTVGILLDTKGPEIRTHDFVDGQAELVTGAEVVLSTEQVLGTAEKFSVSYAGLYDDVDPGSRILIDDGLIELEVIEKADGNIRTKVLNSGTVKNKKGVNVPNVSIKLPGITEKDVKDIIFGIEQKVDFIAASFVRKAADVLEIRELLEEHNAQYIQIVPKIENQEGIDNIDSILEVSDGLMVARGDMGVEIPPEEVPLVQKRLIKKCNVLGKPVITATQMLDSMQRNPRPTRAEASDVANAIFDGTDAIMLSGETAAGQYPVEAVTMMANIAVRVEKSLQYEDMFKKRIKEFTPTITDAISQSVAHTALALDVAAIVAPTESGYTAKMISKYRPKSPIVAVTSDEQVGRRLALVWGVQAFMAEKRAASTDEMLDTAIQTGMDAGLIGLGDTVVITAGVPVAETGTTNLMKIHVVGEEVAKGQGIGRKAAKGKVVVAKTAAEAVANVNEGDILVTTSTDKDMIPAIEKAAALVVEEGGLTSHAAVVGVSIGIPVIVGVNGVTATLKNGQEVTVDAARGIVYNGHAEVL

SEQ ID NO: 30032 - protein, 192 aa, Zea mays
MALTRIGLAGLAVMGQNLALNIAEKGFPISVYNRTTSKVDETVQRAKAEGNLPVYGFHDPASFVNSIQKPRVVIMLVKAGAPVDQTIATLAAHLEQGDCIIDGGNERYENTERREKAMEERGLLYLGMGVSGGGEGARNGPSLMPGGSFDAYKYVEDIVLKVAAQVPDSGPCVTYIGKGGSGNFFQMGHNGI

SEQ ID NO: 30033 - protein, 213 aa, Candida maltosa
DQSLNILLAGRDTTAGLLSFAVFELGRNPEVWSKLRQEIGDKFGLDSDSRIEDISFELLKLCEYLKAVINETLRLYPSVPRNGRFAAADTTLPHGGGKDGMSPILVRKGQTVMYSVYALQRDEKYYGKDANEFRPERWFEPEVRKLGWAFLPFNGGPRICLGQQFALTEASYVLVRLIQSFETLELSPEAAYPPAKLTHLTMCLFDGAPVRIE

SEQ ID NO: 30034 - protein, 244 aa, Brassica napus
  misc_feature (227)..(227): Xaa can be any naturally occurring amino acid
  misc_feature (238)..(238): Xaa can be any naturally occurring amino acid
ERFMTAEPPEVVEARNDNSHGTNFVDSPEPIYGTQFLPRKFKIAVTVPTDNSVDLLTNDIGLVVVSDENGEPQGFNIYVGGGMGRTHRMESTFARIAEPLGYVPKEDILYAVKAIVVTQREHGRRDDRKYSRMKYLLSSWGIEKFRDVVEQYYGKKFEASRDLPEWEFKSYLGWHEQGDGAWFCGLHVDSGRVGGNMKKTLREVIEKYKLDVRITPNQNIVLCDIRXEWKRPITTVLXQAGLLQ

SEQ ID NO: 30035 - protein, 573 aa, Borrelia burgdorferi B31
MTLSGKRISKGIGIGEVLCIRKNFDKIISREKIDFSQVDSEISKFNKAKSKAIEALRDLERKAMLQFGDDKKGIFEGQVLIVEDDELDELVIELIVKENYSAAYSIYLAFENLVKSVEDYKDPYLKERASDYKDIRNRLISIILGQVSDFSEINKDIILVTEELTPSDTMQFDLNYVKGFLTAVGGETSHAAILARTMGLPALVMTLSDIDALKDGDKIVIDAMSSIVIKNPSSDEINLYEGKILRQVELEKELFSLKDKDAETKDGTKVFLKANIGTPVDITYVNKYGVEGIGLFRTEFLYMRSLQPPTEDEQFETYKRVIETMEKKGVVTIRTLDVGGDKEIPYLNFKKEENPFLGFRALRMYKEYEELIQAQFNAIFRASHYGKIRVMVPMLTIYEEIETIEYFVNNAKINLKSRGLPFDENLEVGCMIEVPSAALISSKLANKLKFFSIGTNDLTQYVLAVDRGNQKISNLYDKYNPAVLKLIKKVLDDGVSSGIDVSVCGELGGDDAGALLLVGLGFRSLSMIPSATLRIKYLLKKYTIMELEELANKVLNSDSKQETLSYFDKFIGD

SEQ ID NO: 30036 - protein, 321 aa, Dianthus caryophyllus
MANIVNFPIIDMEKLNNYNGVERSLVLDQIKDACHNWGFFQVVNHSLSHELMDKVERMTKEHYKKFREQKFKDMVQTKGLVSAESQVNDIDWESTFYLRHRPTSNISEVPDLDDQYRKLMKEFAAQIERLSEQLLDLLCENLGLEKAYLKNAFYGANGPTFGTKVSNYPPCPKPDLIKGLRAHTDAGGIILLFQDDKVSGLQLLKDGHWVDVPPMKHSIVVNLGDQLEVITNGKYKSVMHRVIAQTDGNRMSIASFYNPGSDAVIYPAPTLVEKEEEKCRAYPKFVFEDYMNLYLKLKFQEKEPRFEAMKAMETTGPIPTA

SEQ ID NO: 30037 - protein, 91 aa, Glycine max
FLTGSEPHTALLANPSIHIYVMKQWLTASQSLPKILRSIMLLLKPLVQFCMLLWFLCVKIPSPDIFIVQVSLLGFLPIFLPQHLSLHFWFT

SEQ ID NO: 30038 - protein, 464 aa, Borrelia burgdorferi B31
MDVGIYGLGVMGSNLALNIADNGFNVSVYNRDNEKTEIFVKQNSHKKINGFKDIESFVKSLKTPKKIILMVTSSAIEKVIEQILPFMNKSDIIIDGGNSHYKSTMRLEKELFAKDIYFVGLGISGGERGARFGPALMYGGSKSAYEILEPMLNKIAAKTKNNDICSTYIGENGSGHYVKMIHNGVEYADMQLISEVYFFMKKAFNLDNLKISEVFEKWNEGDLSGYLLEITSKILKYKENNEYLVDKILDIANQKGTGVWTAIDALESGVPVNLIVESVFSRFMSGLKHERIIASDLLKMDTSSFEFELSDWILDLYYALLVSKIVAYAQGFMMLKTASVNYGWDLNLGKISLVWREGCIIRSSFLDKIKLAYDKNPHLINLLFDDYFLDLLKNNHKSLRRIISKASEIGIPLPAFYASLSFLDSYSTNYLPSNLIQAQRDFFGAHSFERLDSKRGEFFHSAWQ

SEQ ID NO: 30039 - protein, 327 aa, x Doritaenopsis sp.
MESGSFPVINMELLQGSQRPAAMALLRDACENWGLYELLNHGISHELMNRVETVNKEHYRRFREQRFKEFASKTLDTVENVEPENLDWESTFFLRHLPTSNISQIPDLDDDCRSTMKEFALELENLAERLLDLLCEDLGLEKGYLKKVFCGGSDGLPTFGTKVSNYPPCPKPELIKGLRAHTDAGGIILLFQDDKVSGLQLLKDGEWIDVPPVRHSIVVNIGDQLEVITNGKYKSVLHRVVAQTDGNRMSIASFYNPGSDAVIFPAPALVEKEAEEKEEKKKEIYPKFVFQDYMNLYIRKKFEAKEPRFEAMKSMEIVMSSQPIPTA

SEQ ID NO: 30040 - protein, 448 aa, Arabidopsis thaliana
  misc_feature (100)..(100): Xaa can be any naturally occurring amino acid
MGSVSPDAQKDDLELEDSLNIDENLSGGNGLLKSGNLLSQKRQQCSLVSNSGKWLQIVKNGPKGSFSRATSFFDNKIPRQLVSVDEKYLRRCLDLINISXQGTLQFTMKDNKTPHFVFSLDDQKEIYVASLSTTSVGSGFDRSSLDYSYLIHLKKGRGSEPQHLVGKLKVSTLFSVSSTNEKTVERQFVLFSSGGNPQLPCHKDIRKNRGLPKKVVDALKSTKRTSRQRSISRFSRTSSIPDFCSWEPFQEHDSDLEPISLLDNDLPPNLETSAVVVREQFPVEEEEEEEVEKVGGWGMKFLKKIPLARTKDASKCSKHSTSIDVVIPLGIHGGPRNRNGGPSSLIQRWKSGGCCDCSGWDLGCPLTVLKGQARKDQSEGQCNLFELFTEGLMQGSPGLRIMNVRDGLYFVQSQAKISVLQSFSIALAYIHSQSQRLRPWSSKKCTEA

SEQ ID NO: 30041 - protein, 470 aa, Streptococcus pyogenes SSI-1
MEESMDAKLKYKAKKIKMVFFDIDDTLRVKDTGYMPESIQRVFKALKAKGILVGIASGRARYGVPQEVQDLHADYCVKLNGAYVKDDAKTIIFQAPIPADVVVAYKKWADDMGIFYGMAGRHEAVLSARNDMISNAIDNVYAQLEVCPDYNEYHDVYQMWTFEDKGDGLQLPAELAEHLRLVRWHDNSSDVVLKGTSKALGVSKVVDHLGLKPENILVFGDELNDLELFDYAGISIAMGVSHPLLQEKADFITKKVEEDGILYALEELGLIDKELQFPQLDLPNHKGPKATIKTNHGDMTLVLFPDHAPKTVANFLGLAKEGYYDGIIFHRIIPEFMIQGGDPTGTGMGGQSIYGESFEDEFSDELYNLRGALSMANAGPNTNGSQFFIVQNSKIPYAKKELERGGWPAPIAASYAAIGGTPHLDRRHTVFGQLVDETSFQVLDLIAGVETGAQDKPKEDVIIETIEVFD

SEQ ID NO: 30042 - protein, 509 aa, Pinus pinaster
MALSSATDSDGSIHSTFASRYVQESLPRFQIPSRSIPKDAAYQIISDELMLDGNPRLNLASFVTTWMEPECDKLIMQAINKNYVDMDEYPVTTELQNRCVNIIANLFNAPLGDGEEAVGVGTVGSSEAIMLAGLAFKRKWQNKRKAEGKPYDKPNIVTGANVQVCWEKFARYFEVELKEVKLKKDYYIMDPVKAVEMVDENTICVAAILGSTYNGEFEDVKLVNDLLIQKNKETGWDTPIHVDAASGGFIAPFLYPELEWDFRLPLVKSINVSGHKYGLVYAGIGWVIWRAKQDLPEELIFHINYLGADQPTFTLNFSKGASQIIAQYYQLIRLGFEGYRNIMGNCAANAKALSDGLVRTGRFNILSKEIGVPLVAFSLKDSSRHDEYEISDHLRRFGWIVPAYTMAPDAQEVKLLRVVVREDFNRSLAERLVHDIEKVLHELDTLPSKIAREVVASLVDGHPELKEVKDLGIDVTQFKSSAVFNEIVNSQKAVKAWKKFVAQKANRVC

SEQ ID NO: 30043 - protein, 328 aa, Oryza sativa Japonica Group
MARSALDEVTDAGAFDRSPSTFRSSISRDSSARFPAVPGRYHLYVSYACPWASRCLAYLKLKGLDHAIGFTSVKPIFERTRETDDHLGWVFPATGDEEPGADPDPFNGAKTIRELYEIASPNYIGKPTVPVLWDKQLKTVVNNESSEIIRMLNTEFNEIAKNPDLDLYPAHLQTSVNEINELVYDAINNGVYKCGFAKKQGPYDEAVTRLYEALDKCEEILSRQRYICGNQLTEADVRLFVTLIRFDEFLQVYAVHFKCNKRLLREYPNLFNYTKDIYQIPGISSTVNMEHIRKHYYGSHPSINPYGIIPAGPNIDYNAPHDRERFSA

SEQ ID NO: 30044 - protein, 349 aa, Prochlorococcus marinus str. MIT 9312
MSLSNTSANKNRPNSVPSERLWLRSELMGTQVITTDTGRRLGVVGEVVVDIDRREVVALGLRDNPLTRFLPGLPKWMPLESIKQVGDVILVDSLDSLSESFSPERYGKVINCQVITESGQLLGRVLGFSFDIETGDLISLVMGAVGVPLLGEGVLSTWEIPVEEIVSSGTDRIIVYEGAEEKLNQLSSGLLEKLGVGGSSWDEREANGYSANLVPVENQLLSGLESEKQNNLVEEYEEVVEQDDYEDDYEDEDELEYVEIKGSSEEINNRKKLYMDNDYSDQIENQNSFNQIDEEKNIDFMQKKQSTTNLASKRPIQNAKETLDIEPLDAQNLVKDNKKSEKFEIDDPW

SEQ ID NO: 30045 - protein, 217 aa, Clostridium perfringens SM101
MVKIAPSILSADFSILGEQVKRVEKGGAEFLHIDVMDGHFVPNISFGFPIMKAIRNLSNLVFDVHLMIEEPGRYVDEFISAGADLITVHYESDRHIDRTINYIKSKGCKAGIALNPGTPVSMLKNLIPSLDMVLIMSVNPGFGGQSFIPYSLDKIKEVKEIAKACGKEDLLIQVDGGVGENNIKEIVEAGANVLVAGSAVFKEDKIEENIKALREAL

SEQ ID NO: 30046 - protein, 402 aa, Bacillus anthracis str. Ames
MHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYEGRPTGMNPVKDEVAKYTNKNRIEGSLADVVQGADVFIGVSAEGALTEEMVRTMNDDAIIFAMANPVPEIMPELAKAAGAAVVGTGRSDFANQVNNVLAFPGIFRGALDVHATQINEEMKMAAVQAIAELVAEDELNADYIIPAPFDARVAPQVAAYVAKAAMETGVARRQVDPNEVAEKTKQLALIGKE

SEQ ID NO: 30047 - protein, 479 aa, Klebsiella pneumoniae
MTAPVQHPMYIDGQFEPGRGDAWIDVINPATEALLSRIPDGSAEDARRAILAAERAQPGWEALPAIERARWLRKIAAGIRERAEEIAALIVAEGGKIQQLAAVEVSFTADYLDYMAEWARRYEGEIVQSDRTGENILVFKRALGVTTGILPWNFPFFLIARKLAPALITGNTIVIKPSEFTPNNAIAFAQIVHDIGLPKGVFNLVLGRGETVGQELASNPKVAMVSMTGSVAAGEKIMAAAAKNITKVCLELGGKAPAIVMDDADLELAVKAVVDSRVINSGQVCNCVERVYVQKGIYDRFVNRLGEALKAVQFGDPASRDDIAMGPLINAAALARVEQKVAKAVAQGARVALGGKAVTGRGYFYPPTLLLDVRQEMDIVHEETFGPVLPVVAFDTLEEALAMANDSDYGLTSSIYTRDLNVAMKAIKGLKFGETYINRENFEAMQGFHAGWRKSGVGGADGRHGLNEYLQTQVVYLQA

SEQ ID NO: 30048 - protein, 263 aa, Bifidobacterium breve
MSTYRKSRAFAPQRFFECEGRGLQWLGAAHAQGGPRVVQVYDWGKDYLDIERVNSSSPTAKAALEFGAALARMHDAGAEYFGSAPEGYDGTCYFGPLQDPVKMDTGEWTDPISYFADGRLRPMVELGVKRGELDQRDVDLTEKVIEALPDIMGRAAEDKPARIHGDLWSGNVMWTADSGQTEAVLIDPAAHGGHREEDLAMLHLFGMSYLTQITEGYQSVHPLKAGWQDRITLWQLYPIAGHCVFFGGGYVSEYRSMCRSLLK

SEQ ID NO: 30049 - protein, 350 aa, Bacteroides thetaiotaomicron VPI-5482
MLAYTYIEHGKFELREKPEPKITDARDAIVRVTLGSICTSDLHIKHGSVPRAVPGITVGHEMVGVVEEVGAEVTSVRPGDRVTVNVETFCGECFFCHHGYVNNCTDPNGGWALGCRIDGGQAEYVRVPYADQGLNRIPDTVSDEQALFVGDVLATGFWATRISEITEKDTILLIGAGPTGICTLLCSMLKNPKRIIVCEKSPERIQFVREHYPDVLITTPENCKEFVLQNSDHSGADVVLEVAGTEDSFRMAWDCARPNAIVTIVALYDKPLLFPLPEMYGKNLTFKTGGVDGCDCAEILSLIEEGKIDTTPLITHRCSLNEIEEAYRIFENKLDGVIKVAIVCQTESNK

SEQ ID NO: 30050 - protein, 399 aa, Robiginitalea biformata HTCC2501
MPTLSKKGQAMPASPIRKLVPYAEAAKKSGVEVIHLNIGQPDIKTPSQALEAVRNFRTEVLEYSRSEGSESYRAKLADYYGKQGIAVTREQILVTTGGSEALSFVMSCVADLGDEIIIPEPFYANYNGFATATGVTVVPVASGISDNFALPPISDFESYIGPRTRAILLCNPGNPTGYLYSPEEIRSLAELVRRHDLFLIADEVYREFAYDGKKHYSILQEPGLEDNAVVVDSVSKRYSMCGARIGCIITRNEQLMQAALKFAQARLSPPTFAQVASEAALDTPPSYFEAVNAEYTRRRDVLLEELGKIPGILVARPQGAFYCMVELPIRDADHFAQWLLEEFRLEGATVMLAPAAGFYATPGLGENQVRIAYVLEENQLRKAVRILAAALEKYQADGH

SEQ ID NO: 30051 - protein, 460 aa, Arabidopsis thaliana
  misc_feature (44)..(44): Xaa can be any naturally occurring amino acid
  misc_feature (63)..(63): Xaa can be any naturally occurring amino acid
MMMRAVIRRAASNGSSPSLFAKSLQSSRVAASSPSLLSGSETGXHICIVEIMLIAFITLLCQXRELGHLEVGEFSFFNPAKMAETGDTVEAVVPHMGESITDGTLATFLKKPGERVQADEAIAQIETDKVTIDIASPASGVIQEFLVNEGDTVEPGTKVAIISKSEDTASQVTPSQKIPETTDTKPSPPAEDKQKPRVESAPVAEKPKAPSSPPPPKQSAKEPQLPPKERERRVPMTRLRKRVATRLKDSQNTFALLTTFNEVDMTNLMKLRSQYKDAFYEKHGVKLGLMSGFIKAAVSALQHQPVVNAVIDGDDIIYRDYVDISIAVGTSKGLVVPVIRGADKMNFAEIEKTINSLAKKANEGTISIDEMAGGSFTVSNGGVYGSLISTPIINPPQSAILGMHSIVSRPMVVGGSVVPRPMMYVALTYDHRLIDGREAVYFLRRVKDVVEDPQRLLLDI

SEQ ID NO: 30052 - protein, 336 aa, Robiginitalea biformata HTCC2501
MKKITIGINGFGRIGRTLYRLLEPVPHLDVVLVNDLADSRTLAHLLRYDSIHGPLPHPVSVTDNGFQMNQTETTLTNFGEPGRIPWGEHGVDLVVEATGRFKNREALEAHLARGAKKVILSAPPEDADIPMVVYNINDHLLTPETAIFSCASCTTHSAAPLISVLDELCGIQQAYITTVHSYTSDQSLHDRPHRDLRRARAAGQSIVPTTTGAAKALTRIFPHLSDVIGGCGIRVPVPNGSLTDITAQVRNPASIAEINATFKRISENELKNILFYTEDPIVSIDINNSYYSCTFDSQMTSVVGNLVKVIGWYDNETGYSSRVRDTIELLLERNFI

SEQ ID NO: 30053 - protein, 577 aa, Saccharomyces cerevisiae
MKGDRSRQNMAVTKKAKLKKNDEPKKVLKTAATEKGEGSKRYSLWNFWISTLFLKLLLIPDYFSTDFDVHRNWLAITNKLPISEWYYEHTSQWTLDYPPFFAYFEWFLSQFVPKSVRDDGCLDIVEIGKFGLPTIVFQRLTVIFSEILLFVILQIYINTTKLSERSQSFVVASSIVLSPGFLIIDHIHFQYNGFLFAILIGSIVAAKNKRYILCAVLYTTAICFKHIFLYLAPCYFVFLLRAYVLNVNNFKFKSYKDFLFLIRWANLLKLATVVVGIFTICFLPFAHQMPQVLSRLFPFSRGLTHAYWAPNFWALYSFMDKILTTVMLKLPYVHTFATKFIKPPLIPQNIKEINERLAANNNGSKGLVQDVFFVILPQIPPKLTFILTIFYQVLAVLPLLFDPSFKRFVGSLTLCGLASFLFGWHVHEKAIMLVIIPFTFLVGFDRRLLVPFMLVASAGYVSLYPLLYKGQDFFIKTLYTYVWCIIYFAAFRKTTKISSSVERRIFFLDRLALTYIFSLLPIVTVLQILDEVKWRYSFLQKFEFLGLMIYSVYCSLGIISSWFALSWLYNFDELLWQ

SEQ ID NO: 30054 - protein, 117 aa, Triticum aestivum
  misc_feature (17)..(17): Xaa can be any naturally occurring amino acid
  misc_feature (79)..(79): Xaa can be any naturally occurring amino acid
  misc_feature (104)..(104): Xaa can be any naturally occurring amino acid
MAAALKGMVDEQFQQLXSLEEGGTASGFVAEVATLFIEDADRIIADIAALLDQPVVDFDKVDAHVHQLKGSSSSPRISXQGLMAPWLLFRSEFLVMCATSSQTXMQLEQQIEACSPK

SEQ ID NO: 30055 - protein, 515 aa, Ostreococcus tauri
MPMTVVSQKIDVASNNVEPRARARSASVVEAVRGSGDDYDLDSGVPANSEFVPTAYDETGSTGDVYAGPARLSGDLRRHTILVYVADETGMINRVAGVFARRGYNIESLAVGLNIDKAIFTISVICSEEDVVKLMKQVNKLAKVRKVENVTNKECVERGLMLIKVKCEPEHRSQVLEVNRIFRASVVDVAEHSLTMAVTGDPGKNRAFQSALTKFGVLQVARTGKLALKREPVYSEQRSRRVRLMEAMKKAKDAVSGLNVKERSAKYESVLASRIVRAVAGMEHDDDGDLDVGDVYSTLENDSIGVWDVPVLSSSFSGLGMGTDKVDIDKPDENAKFTPRTLSILVDNRPGVLDSVTGVFARRGYNVQSLGVGPEKSFDISRISTVVPGTSQDIAMLMKQILKVPYVISAQDITNTPFVERELMLIKVVCPRANRAEVIDLCAMFRAKVCDISEDTVTIEVSGRQRKINAIQALLEPYGILEVARSGRVALARDSGVDSKLLGVIADESAFDNFE

SEQ ID NO: 30056 - protein, 390 aa, Trichodesmium erythraeum IMS101
MKLAARVGKVPLSLTLAISAKARAMKADGKDVCSFSAGEPDFDTPEHIKVAAQKALDSGYTKYGPAAGEPKLREAIAHKLSQENGLNYKAENIIVTNGGKHSLFNLMLALIEPGDEVIIPAPYWLSYPEMVKLAGGEPIILTTDPETGYKVTPEQLRQSITDKTKLFVLNSPSNPTGMVYQPAEIKALAEVLVEKDILVVSDEIYEKIIYDDAEHLSIGAVNSEIFKNTIISNGFAKAYSMTGWRIGYLAAPVELINATVKIQGHSTSNVCTFAQYGAIAALESSQDCVEQMRQAFAKRRKIIYDLLKTLPGISCNQPEGAFYMFVNISKISSSSLEFCNALLEDQNVAVIPGIAFGADDHIRISYATDLETIEKGMDRLERFIRSQSSG

SEQ ID NO: 30057 - protein, 511 aa, Streptomyces coelicolor A3(2)
MSTPEPVLAGPGILLVLDGWGSADAADDNALSLARTPVLDELVAQHPSTLAEASGEAVGLLPGTVGNSEIGHMVIGAGRPLPYDSLLVQQAIDSGALRSHPRLDAVLNEVAATSGALHLIGLCSDGQIHAHVEHLSELLAAAATHQVERVFIHAITDGRDVADHTGEAYLTRVAELAAAAGTGQIATVIGRGYAMDKAGDLDLTERAVALVADGRGSPADSAHSAVHSSERGDEWVPASVLTEAGDARVADGDAVLWFNFRSDRIQQFADRLHEHLTASGRTVNMVSLAQYDTRTAIPALVKRADASGGLADELQEAGLRSVRIAETEKFEHVTYYINGRDATVRDGEEHVRITGEGKADYVAHPHMNLDRVTDAVVEAAGRVDVDLVIANLANIDVVGHTGNLAATVTACEATDAAVDQILQAARNSGRWVVAVGDHGNAERMTKQAPDGSVRPYGGHTTNPVPLVIVPNRTDTPAPTLPGTATLADVAPTILHLLGHKPGPAMTGRPLL

SEQ ID NO: 30058 - protein, 306 aa, Oryza sativa Japonica Group
MYENCKVIDLGVTNCRVVESVGEHVEGFAAGDPVVPTFLGQCTECVDCASERSNVCSTYRFAVRPGMPRDGTARFRDRHGAPIHHFLGVSSFSEYTVVDANQVVRVDPAVPPATASLLSCGATTGVGAAWKLAKVEPGSSVAIFGLGAVGLAVAEGARICGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKELELDKFITHEVPLKDINTAFDLLLQGKSLRCTIWMDK

SEQ ID NO: 30059 - protein, 328 aa, Oryza sativa Japonica Group
MKPKYSKFTQQELPAWKPLYTPGIVIGAFSLIGIIFIPIGLVSIAASQEVVELVDKYDGECVTANDKVGFIQDTKTDKACTRTITVPKPMKGPIQVYYQLENFYQNHRRYVKSRSDKQLRSKEFSSVIKTCDPEAISEGGAPIVPCGLIAWSLFNDTFTFSVNKKTVQVNKKNIAWSSDRTIKFGSDVFPENFQKGGLIGGGQLNEKLPLSEQEDLIVWMRTAALPTFRKLYGRIETDIMASDEITVVIQNNYNTYSFGGTKALVLSTTSWIGGKNNFIGFAYVAIGTISFLIALAFVGLNMVKPRYGKIARWIGFQGKLWSIDHGAT

SEQ ID NO: 30060 - protein, 637 aa, Saccharomyces cerevisiae
MGVRSAAKEMHERDHNSDSSSLVTSLMKSWRISSASSSKKPSLYKMNTTESTSLPSGYASSADRDRRTSDGNFEAMAKQQASTRRTSNSYSPLRYVNPTLSTASNESPRPALLLRQHHQRHHHHQQPRHSSSGSVGNNCSNSTEPNKKGDRYFKDLDEDWSAVIDDYNMPIPILTNGGFGTPVAPTRTLSRKSTSSSINSISNMGTSAVRNSSSSFTYPQLPQLQKEKTNDSKKTQLEIENERDVQELNSIIQRISKFDNILKDKTIINQQDLRQISWNGIPKIHRPVVWKLLIGYLPVNTKRQEGFLQRKRKEYRDSLKHTFSDQHSRDIPTWHQIEIDIPRTNPHIPLYQFKSVQNSLQRILYLWAIRHPASGYVQGINDLVTPFFETFLTEYLPPSQIDDVEIKDPSTYMVDEQITDLEADTFWCLTKLLEQITDNYIHGQPGILRQVKNLSQLVKRIDADLYNHFQNEHVEFIQFAFRWMNCLLMREFQMGTVIRMWDTYLSETSQEVTSSYSMSSNDIKPPVTPTEPRVASFVTPTKDFQSPTTALSNMTPNNAVEDSGKMRQSSLNEFHVFVCAAFLIKWSDQLMEMDFQETITFLQNPPTKDWTETDIEMLLSEAFIWQSLYKDATSHWL

SEQ ID NO: 30061 - protein, 274 aa, Nicotiana langsdorffii x Nicotiana sanderae
MRMAAITKMLFISFLFLSSVFLARSGEVDDESEFSYDEKSENGPANWGNIRPDWKECSGKLQSPIDIFDLRAEVVSNLRILQKDYKPSNATLLNRGHDIMLRLDDGGYLKINETQYQLKQLHWHTPSEHTINGERFNLEAHLVHESNNGKFVVIGIVYEIGLWPDPFLSMIENDLKVPANKKGIERGIGIIDPNQIKLDGKKYFRYIGSLTTPPCTEGVVWIIDRKVKTVTRRQIKLLQEAVHDGFETNARPTQPENERYINSTYHSFGIEKQQ

SEQ ID NO: 30062 - protein, 478 aa, Oryza sativa
MSSSPIEGRPASRPAPSSPIELVAALAVGHRPPPSSPIELAAAAVVAHRARRRRRRPSSSLPPSGIDRRRRIEPTVGHRPPPSRIGRCRRASTSTAAHRPPPSRIDRRRHASTSAVANRARRRRRASSAAVTHRTLRRRRPSRLPSPSRVTHPAAVVVHPAVAATAAAAGVGHRARRCRHRRASRRLPSHRAAAPLAAISLLSPIFPLVKQERIEIPFHQWYHFNEEVQYHECKITIHESAMAGRGGGGELRLLGTWSSPWVIRVRVALGMKGLSYEYTEEDLSSKSDHLLRSNPVHEKVPVLIHGGRPVCESLVVLEYIDETWGATGTPQLLPADPYDRATARFWTNYVNDTFFPSWKVLFRSTAAEQRAEAFKNVVPRVEALERAFGECSKGKAFFGGDDAGLVDVALGSHLVWIKVVDEVAGANLLDEAKFPGLAAWAERFLAVDAVRQVMPDAGDVLKQYKGFLAKWTAGAGSS

SEQ ID NO: 30063 - protein, 176 aa, Borrelia garinii PBi
MKNKTEYYDQFIAKVPDFPKKGVLFYDITSVLLKPEVYTSLINEAYSFYNLKKIDCIAVVESRGYLIGAPLSLKMQLPLVLIRKEGKLPREVFGEEYELEYGFGKIEVHKDDVRMYSNILLIDDILATGGTLKSSAILLERAGGRVKDIFCFIELCGINGRRILEDYDVNSLVRYN

SEQ ID NO: 30064 - protein, 172 aa, Trichodesmium erythraeum IMS101
MNIPNSITFSRLLGIPIILYTLKTPTNQNLWISLVIFLMASATDFLDGYLARKLNQVTDLGKFLDPLVDKLLILAPLLALIELGKVPAWGVFLILSRELTIAGWRVNQSKVSGANIWGKLKTVSQIIAVALLIAPLPKTWATSTIIIFWVSVALTIISGIVYLLPTQETSNT

SEQ ID NO: 30065 - protein, 253 aa, Synechococcus sp. WH 5701
MIRRILKPILADLRIIRERDPAARGTLEILLCYPGFQALVLHRLSHRLWTLNVPLLPRLCSQVGRLFTGIEIHPGATIGHGVFIDHGMGVVIGETAEIGDRCLLFQGVTLGGTGKEHGKRHPTLAENVVVGAGAKVLGAITVGTNTRIGAGSVVLRDVGPDSTVVGVPGRVIHQSGVRIDPLAHSQLPDAEAKVIRNLMERIDTLESELSRLQTCLREVAAGRPLQEVCGGRAQSLKDREILEFLGDRPSGGT

SEQ ID NO: 30066 - protein, 180 aa, Zea mays
LKLQVGLLGMARSFQKELDQIAEKADTSTPAGLSYVLTETTLALLRHPDCCISAYSSVDVKRSIDNGEKRFNQLSIEERGKFDEETLVNVNSIKRNKGGSQRSSGFSNEYIVITILVAAEGVHKVPVINSSNDLKTALQKMGAIPSRKILAVEVLWTPQNENDTLSERELLEDYPLLRPL

SEQ ID NO: 30067 - protein, 1115 aa, Physcomitrella patens subsp. patens
MTVIAAPPEEDDDMLVPPQDFNDVIEPMEVVGQGEGVVTVENQLVDDPQTGKFTWPIENLSKINLRKHYSETFTVGGYKWRVLLFPKGNNVDHLSIYLDVADSAQLPYGWSRFAHFTLAVVNQIDPKLTVKKDTQHQFNVRESDWGFTSFMPLHDLNDPSRGFVVNDTLIVEADVNVRKVVDYWAYDSKKETGFVGLKNQGATCYMNSLLQTLYHLPYFRKAVYHMPTTENDVPSNSIPLALQSLFYKIQYSDTSVATKDLTKSFGWDTYDSFMQHDVQELNRVLCEKLEDKMKGTAVEGTIQQLFEGHHMNYIECINVDYKSTRKESFYDLQLDVKGCKDVYESFDKYVEVERLEGENKYHAEQFGLQDAKKGVLFIDFPPVLQLQLKRFEYDFMRDTMVKINDRYEFPLQLDLDRENGKYLSPDADRSVRNLYTLHSVLVHSGGVHGGHYYAFIRPTLSDQWFKFDDERVTKEELKRALEEQYGGDEELPQTNPCFNNTPFKFTKYSNAYMLVYIREADKDKVVCNVDEKDIAEHLQIRLKKEQEEKERKRKEKAEAHLYTIIKVGRDEDLQNQIGKDIHFDLVDHEKVRSFRIQKQTPFTQFKEEIAKQLGVPVECQRFWLWAKRQNHTYRPNRPLTDQEEAQTVGHLKEASNKAHNAELKLFLEVQRLPGADSVPIPPPIKTKEDVLLFFKLYNPEKEELRYVGRSYVKASGRPADILERLNEMAGFPPNEEIQLYEEIKFEPNVMCEHIDKKSTFRASQLEDGDIICYQRALTRGEEDVCRYPDVPSFLEYVRNRQNVHFRRLEKPKDDEFCLELSKQHTYDDVVERVAEKIGLEDASKIRLTSHNCYSQQPKPQPIKYRGVERLSDMLVHYNQTSDILYFETLDLPLPELQGLKTLKVAFHNAKTEELSVHNIRLPKQSTVGDVVNELKGKVELSSPRAELRILEVFYHKIYKIFPLNEKIENINDQYWTLRAEEVPDEEKELGPQDRLIHVYHFTRDASQNHMVQNFGEPFFLVVRESETLVEVKGRIQKKLLISDEEFSKWKFAFLSLGRPEYLQDGDVVAARFQKRDTYGAWEHYLGLEHTDSAPKRSHTTNQNRHNFEKPVKIYN

SEQ ID NO: 30068 - protein, 314 aa, Clostridium perfringens SM101
MNNKIRKAIIPAAGLGTRFLPATKAQPKEMLPIVDKPTIQYIIEEAIASGIEEILVITGRSKKAIEDHFDRNVELEMELEKSGKTELLDLVRDISDMVDIHYIRQKEPRGLGHAIHCAKTFVGDEPFAILLGDDVVYNEEKPCLKQLIECYNEYRTSVLGVQTVPEENVSKYGIVNGKHIEGRVYKVKGLVEKPSPEEAPSNVAILGRYIVTPRIFDILENTKPGKGGEIQLTDALLELMREEAMYAYDFEGRRYDVGDKLGFLEATVEYALRRPDLRDGFIDYLRELSATENIFTEANGKEKKDKEEELVTEA

SEQ ID NO: 30069 - protein, 467 aa, Thiomicrospira crunogena XCL-2
MINIILCGGSGTRLWPLSRTMLPKQFVRLFDGYSLFQDTVIRNQSVCRHSFVISNTEQYFLAVDQLSQVSSQPSRFLLEPVGRNTAPAIALACLALDEDDLVFVTTSDHLVKDQGAYENAVIKAKSLAEQGNLVTFGIQPTYPETGFGYIEASGNDVLSFKEKPSAKLARSYLEAGNYYWNSGMFCFKAGVFLAELQKHSPEIYEASLRAMRSVKEECASQDDKVIKIDLDAMQSIPEDSIDYAVMEKSDIVKVVPCDMGWSDLGSFDALYDEVKDDSNENAVLSRLDKSPLPICIDSKNNLLVTRDRQLALVDVEDLLVVDTSDAILISKKGSSQKVKQVVSMIKKQSPELAEIHRLAHRPWGTYEVLIDSEQYKVKRIVVKPGSKLSLQKHFHRNEHWIVVSGTASVTVDKETFLVRANESTYIQMGQVHRLENEGKIDLVMIEVQVGEYTGEDDIVRIEDVYGR

SEQ ID NO: 30070 - protein, 481 aa, Fulvimarina pelagi HTCC2506
MAAGDPNATIVPVILCGGSGTRLWPASRRTRPKQFLPLFGNLSPFQATLIRVNAEGFGKPLIIANTDHRFLAAEQAEEIGIDITIVLEPEARDSGPGLAAAALFAAKEVASDALILALAADHRITDVEGFRHTVSGAADVARQGHIVTFGIAPEKPATGYGYIEPGEAMAGAGDIEVRKAKRFVEKPNLATAETYLDAGYLWNSGNFLCRADVLISEYEASDAETVSAVRRSVDAAVKDLDFVRLDPAAFKQAGKRSIDYAVMERSERIAVATAGFDWSDIGDWDALAPILDRDADGNAVHGSCVSIGSKDNVVWSTGAFVAFSGVDNLVISVTEDAVFVADRSKGDLMKSLVEKVKGANPVLTEEHLQSFRPWGNYRSLDKGNRHQVKRIVVKPGGRLSLQHHHHRAEHWIVVRGLALVTIDERQFKLTENESTYIPLGSVHRLENPGKIDLELIEVQTGSYLGEDDIVRHEDIYARADA

SEQ ID NO: 30071 - protein, 642 aa, Clostridium perfringens SM101
MNLITLENISKSYSEKILANNVSLGINEGEKIGLIGVNGTGKSSFLKIVAGVEEPDEGTVTKGNRVRIEYLAQTPDYDDNATVLEQVFKGNSEEMRILREYEELLEKIDKGEVKENDSERLIKLQGKIDALNLWDMESEAKNVLTKLGITNFEEKVGNLSGGQKKRIMLAAALITPCELLILDEPTNHLDNETISWLEEYLNSRKGALLMITHDRYFLDRVTNRILELDRGRLFSYDGNYSVFLEKKMERIAIEKASEEKRQNLMRKELAWVRRGAKARTTKQKARLQRFDELVNQEGFIENENIEISVMGTRLGKKIIEIEHLNKRFGDKKIVDDFNYIVLKSDRIGIVGPNGIGKSTLMGMIEGKVKPDSGEIIKGETVKIACFSQEDTHMHPEMRAIDYIKEAGEYLQTATGERITASQMCEKFLFDGTLQWTMIGMLSGGERRRLHLLRVLMEAPNVLLLDEPTNDLDIETLNRLEDYLDDFGGVVITVSHDRYFLDRVCNKIFSYEGNGKIDIYTGNYGDYLLSKEEEAVNNKEKEVAVDKNKKESSVDKNKNKGKVLKFSFKEQREFETIDEEIMTLEEKIEELDSLMAKHASEYGRLQELIEEKANVEEELAFKYERWEYLNELAAQIEENKKNK

SEQ ID NO: 30072 - protein, 401 aa, Spirodela polyrrhiza
MDYVYGPGRNHLFVPGPVNIPEPVIRAMNRNNEDYRSPAVPALTKTLLEDVKKIFKTTSGTPFLIPTTGTGAWESALTNTLSPGDRIVSFLIGQFSLLWIDQQQRLNFNVDVVESDWGLGANLDVLAEKLAADHSHSIKAICIVHNETATGVTNNLATVRKLLDDYRHPALLLVDGVSSICALDFRMDEWGVDVALTGSQKALSLPTGMGIVCASPKALEASKTAKSVRVFFDWNDYLKFYKMGTYWPYTPSIQLLYGLRAALDLIFEEGLENVIRRHSRLGTATRLAVEAWGLKNCTQKEEWFSDTVTAVVVPGYIDSSEIVRRAWKRFNLSLGLGLNKVAGKVFRIGHLGNVNELQLLGCLSGVEMVLRDVGYPAKLGSGVAAAAAYLLNNTPLIPSRI

SEQ ID NO: 30073 - protein, 320 aa, Vibrio fischeri ES114
MKKTKITIIGECMIELSGNAFSTQTQSFGGDTLNTAVYLSRLLPHVSPYYLTALGQDQYSSLMLKAWEKENIDCSLVLRDQERLPGLYSINIDDKGERSFHYWRDNSAAKYMCQHLLFVPNIAKIMDADIIYLSGISLAILPTHDREILFDVLATLKKHGATIITDSNYRPRLWKNNLDAKFWLDNLYRLSDMALVTGDDEELLLDKPNMPEKEVADRLHALGVGHVVVKLGAKGAMWSTLEGKSGYVDGESVDKLVDTTAAGDSFNAAYIAAYSQGASMAESCAWGNRLASQVIQHKGAIIPMDYLQTLITDMGQINEK

SEQ ID NO: 30074 - protein, 307 aa, Fulvimarina pelagi HTCC2506
MHATGDQGLPFVLQSTNRLTGKAGQARHGVPSVESPRCRKAGRQGDLIMQLQGNVAIVSGASSGIGRQIALSYAREGANVAIGDIDMDGAKKVVAEIEDAGSKGLAVEMNVTDESAVNAGVDQVVERFGKIDTMVSNAGIQIVHPIEDFPYDQFKKMIDIHLGGAFLLTKACVRHMYPRKSGSLIYMGSVHSHEPSALKTAYVSAKHGILGLSRVMAKEGAKHGVRSNVICPGFVKTPLVEKQIPEQAESLGISEEEVVSKIMLGETVDTEFTTLQDVADVAVFLAAFKTNALTGQSITASHGWYMA

SEQ ID NO: 30075 - protein, 417 aa, Prochlorococcus marinus str. MIT 9312
METIQNFPEITKKDFPLLNKNLTNNEQIIYLDHAATTQKPIQVLKKIDEYYRNFNANVHRGAHQLSAKATEEFENARYLISKYIKANSTKEIIFTRNATEAINLAARSWGESSLKENDEILLSIMEHHSNIVPWQMVAAKNKCKLKFIGIDKNGKLDIDDFKSKLTSRTKLVSIVHISNTLGCCNPIKEITKLAKQKGSLVLIDACQSLAHQKLDVIDLDIDFLAGSGHKLCGPTGIGFLWSRQEILEKIPPLFGGGEMIQDVFEETSTWAELPHKFEAGTPAIAEAIGLAEAINYINNIGLNNIHKYEKNITKYLFKKLNQIEDIEIIGPSPEIDPDRASLATFYIKNIHANDIAEILDSKGICIRSGHHCCQPLHRYIGIKSTARISMNFTTNKEEIDIFLEKLKETINFLKMYS

SEQ ID NO: 30076 - protein, 174 aa, Arabidopsis thaliana
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGNTPGYYDGRYWTMWKLPLFGCTDSAQVLKEVEECKKEYPGAFIRIIGFDNTRQVQCISFIAYKPPSFTEA

SEQ ID NO: 30077 - protein, 236 aa, Glycine max
MANGGDELKLLGMWASPYVVRVQLALHLKGVSYEYVEEDLASKSELFLRSNPVHKTVPILIHNGKPVCESQVILQYIDEAFAGVGPPLLPADPYERAVARFWAAYVEDKLLAPWGKVFRVKTDEERAEWTRQTAAALGPLEDGLRECSKGKGFFGGDCVGYVDVLLGSMVPWVRATERLSGDKLIDAGKAPLLAAWMERISELDAAKAVFQDVDRVVEYAGAIQARLSAAAAASTQ

SEQ ID NO: 30078 - protein, 182 aa, Robiginitalea biformata HTCC2501
MSAKKGKIQEQIDARMLEERKVFLWGQVDDDSAKHVIDRLLYLDLQNNKEIQLYINSPGGYVTSGFSIYDTITSLKSPVSTICSGLAASMGSILLSAGKKGRRFVQPHARVMIHQPSGGARGQASNIEIQAKEILKTREIGAQILAENCGQPFEKIMKDFNRDYWMDAKESVEYGIVDDILD

SEQ ID NO: 30079 - protein, 642 aa, Trichodesmium erythraeum IMS101
MSMFTLQSVKKDFGIKEILKDASFSLDPKDKVGLIGTNGSGKSTLLKMIAGLEPTDSGEILVNQNVRIIYLPQQPDLNENNTVLEQVFANSGKQTALIKEYQELSEKLAHYPEDSQLMARFSQVTQKMNYTNAWELETKAKIILSKLGIQDFEVKVGNLSGGYRKRIALGTALLSEPDVLLMDEPTNHLDAMSVEWLQSYLKTFSGAILLITHDRYFLDRVTNKILEIDRGDIYTYSGNYSYYLEKKALAEESIVSSQKKHKGLLRRELEWLKRGPKARSTKQKARIQRIEEMQGREFKESLGKVDISTAGRRIGKKVIELENISKSYNGRTIIKDFTYEFIPEDRVGIIGSNGMGKSTLMDIITGRVKPDYGKVEIGTTIHIGYFDQYSENLLDAGAENQRVIDYIKDVAEYVQTADGTQISASQMLERFMFPGNQQYAPIYKLSGGEKRRLFLLKVLMSAPNVLILDEPTNDLDVQTLAVLEEYLEEFNGCVIVVSHDRYFLDRTVDRIFAFEGVGNLRQYPGNYSLYLDYKEAEATAKKFSEVEEKLKESQPKQQKSERVSRDQRGQRKLSSKEKREYENLEKKIAQLETEKAEAENELYNSPPTEVSEVQKLHEKVEGLGQEIDIATERWLELAEIDS

SEQ ID NO: 30080 - protein, 327 aa, Erwinia chrysanthemi
MTTKNIAIIGECMIELSRKARISIRGFGGDTLNTAVYISRQVKPDALDVHYVTALGTDSFSSEMMASWQKEGVKTDLIQRLDNKLPGLYFIETDATGERTFYYWRNDAAARYWLESPDADTISQQLAQFDYIYLSGISLAILNQASRARLLTVLRACRANGGKVIFDNNYRPRLWQSKEETRQAYSDMLACTDIAFLTLDDEDMLWGELPVDEVLKRTHGAGVMEVVIKRGADACLVSIQGEALLEVPAIKLPKEKVVDTTAAGDSFSAGYLSVRLNGGSAQDAAKRGHLTASTVIQYRGAIIRWKRCLPEQRYSAEETKNAASVPY

SEQ ID NO: 30081 - protein, 139 aa, Trichodesmium erythraeum IMS101
MTRAIMETEKGTINLELFDNDAPNTVKNFVELSEKGFYDGLNFHRVIPNFMIQGGCPKGTGTGGPGYKIKCEINSNKHLAGTLSMAHAGKDTGGSQFFICHAPQPHLDGVHTTFGKTEDMEVVNAIGQGDKIISVKIEK

SEQ ID NO: 30082 - protein, 458 aa, Bacillus cereus ATCC 14579
MKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGIIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIIFLAIVTISFYAFGIGKRAPLDVQNNKEISSK

SEQ ID NO: 30083 - protein, 111 aa, Triticum aestivum
PTRPATRPVDFGYLYEGLGGERGKRKRREEEADASDSMELDAYAPRPSKLRAVVCQSDPSKPEAFGCATYDGVISEHVSLRTWKVPHTLRSSALMVSWKPVPMEQRVRDTC

SEQ ID NO: 30084 - protein, 485 aa, Leuconostoc mesenteroides
VSEIKTLVTFFGGTGDLAKRKLYPSVFNLYKKGYLQKHFAIVGTARQALNDDEFKQLVRDSIKDFTDDQAQAEAFIEHFSYRAHDVTDAASYAVLKEAIEEAADKFDIDGNRIFYMSVAPRFFGTIAKYLKSEGLLADTGYNRLMIEKPFGTSYDTAAELQNDLENAFDDNQLFRIDHYLGKEMVQNIAALRFGNPIFDAAWNKDYIKNVQVTLSEVLGVEERAGYYDTAGALLDMIQNHTMQIVGWLAMEKPESFTDKDIRAAKNAAFNALKIYDEAEVNKYFVRAQYGAGDSADFKPYLEELDVPADSKNNTFIAGELQFDLPRWEGVPFYVRSGKRLAAKQTRVDIVFKAGTFNFGSEQEACEAVLSIIIDPKGAIELKLNAKSVEDAFNTRTIDLGWTVSDEDKKNTPEPYERMIHDTMNGDGSNFADWNGVSIAWKFVDAISAVYTADKAPLETYKSGSMGPEASDKLLAANGDAWVFKG

SEQ ID NO: 30085 - protein, 485 aa, Leuconostoc mesenteroides
VSEIKTLVTFFGGTGDLAKRKLYPSVFNLYKKGYLQKHFAIVGTARQALNDDEFKQLVRDSIKDFTDDQAQAEAFIEHFSYRAHDVTDAASYAVLKEAIEEAADKFDIDGNRIFYMSVAPRFFGTIAKYLKSEGLLADTGYNRLMIEKPFGTSYDTAAELQNDLENAFDDNQLFRINHYLGKEMVQNIAALRFGNPIFDAAWNKDYIKNVQVTLSEVLGVEERAGYYDTAGALLDMIQNHTMQIVGWLAMEKPESFTDKDIRAAKNAAFNALKIYDEAEVNKYFVRAQYGAGDSADFKPYLEELDVPADSKNNTFIAGELQFDLPRWEGVPFYVRSGKRLAAKQTRVDIVFKAGTFNFGSEQEAQEAVLSIIIDPKGAIELKLNAKSVEDAFNTRTIDLGWTVSDEDKKNTPEPYERMIHDTMNGDGSNFADWNGVSIAWKFVDAISAVYTADKAPLETYKSGSMGPEASDKLLAANGDAWVFKG

SEQ ID NO: 30086 - protein, 408 aa, Synechococcus sp. WH 5701
MPPLGLAELVIAGLMADGLFRRLGLPGLVGMLLVGVALGTSGLGLIDPRLLALSGDLRQMALIVILLRVGFGLDLATLRRVGPRVLLLAWIPASCEGLMITAVAQPLLQLSWLEAALLGSVLAAVSPAVVVPLMLRLIEENRGTAKAIPSMVMAAASLDDIAVIVVNGVLLGLLVNDRGALSARLLGLPLGLALGALAGGLLGWGLIRWFERFRPNANRQTLLVLALALLLLRLQEGINHLVPFTGLVAAIALGVVFLELRQDLAHPISAKLSSIWVFAELVLFVLVGAQLNVGVAWSHGLAGLAVLALGLLARSLGTLACLARSTLTAGERLFVMVAYTPKATVQAAIGAVPLLTMQAAGLPSGPGEVILAVAVLSIVVTAPAGAWLSARVADRVLLPSPGQPTAPG

SEQ ID NO: 30087 - protein, 678 aa, Hordeum vulgare subsp. vulgare
MDIVAPDRTRIAPEIDRDEALEGDRESDPALASTREWQLEDMPRWQDELTVRGLVAALLIGFIYTVIVMKIALTTGLVPTLNVSAALLSFLALRGWTRLLERFGVVSRPFTRQENTIVQTCGVACYTIAFAGGFGSTLLGLNKKTYELAGDSPGNVPGSWKEPGIGWMTGFLLACSFGGLLTLIPLRQVLVVDYKLVYPSGTATAILINGFHTDQGDKNSRKQIRGFLKYFGGSFLWSFFQWFYTGGDACGFVQFPTFGLKAWKQTFYFDFSMTYVGAGMICPHIVNISTLLGAIISWGIMWPLISKNKGDWYPAKVPESSMKSLYGYKAFICIALIMGDGMYHFIKIVGITAMSMYRQFSHKQVNNKAKNADDTVSLEELHRQEIFKRGHIPSWMAYAGYALFSVLAVVTIPVMFKQVKWYYVVIAYVVAPMLGFANSYGTGLTDINMGYNYGKIALFVFAGWAGKENGVIAGLVAGTLVKQLVLISADLMQDFKTSYLTQTSPKSMMIAQVVGTAMGCIVSPLTFMLFYKAFDIGNPDGTWKAPYALIYRNMAILGVEGFSVLPKYCIVISGGFFAFAAILSITRDVMPHKYAKYVPLPMAMAVPFLVGGSFAIDMCLGSLIVFAWTKINKKEAGFMVPAVASALICGDGIWTFPASILALAKIKPPICMKFLPAA

SEQ ID NO: 30088 - protein, 281 aa, Candida albicans SC5314
MDSAYWSYDNIVPSFRLDGKLVILTGGSGGLAAVVSRALLAKGADVALVDMNLERTQQAARDVLQWGEEQMKGKYESPIGQVSAWSCNIGDAEAVDLTFKAINEHHGKISSVLVNTAGYAENFPAEEYPAKNAENLMKVNGLGSFYVSQAFARPLIQNNMTGSIILIGSMSGTIVNDPQPQCMYNMSKTGVIHLARSLACEWAKYNIRVNTLSPGYILTPLTRNVISGHTEMKTEWESKIPMKRMAEPKEFVGSILYLASESASSYTTGHNLVVDGGYECW

SEQ ID NO: 30089 - protein, 575 aa, Oryza sativa Japonica Group
MSGSAATLGMRCGSYGSLASAGGGRKGGGRGWGWRGGGEKERLQLLHRALRLVGRRRAGVLLLLAAASAAVFCSIFAVVKDDNASMIIANNYEVANTIQNSVYPSMTRPLMTSSDQFSASSVNKTELPNRLRLSFANFTHHPCEGFSVAPPLVDPKRTGPRPCDVCYVPVDQAFALMPPQPSPSPVLKNLSYVFEDNITANFSNQGSVFGGHPSLEQRNKSFDISESMTVHCGFVRGKKPGQGSGFDINDDDLLEMEKCRELVVASAIFGNYDMIQHPRNASEFSKANACFYMFVDEETEAYVKNSSSLYRNNKVGLWRLVVVRNLPYEDPRRTGKIPKLLLHRLFPNVRFSVWIDAKLKLVVDPYLLLERFLWRKNATFAISRHYKRFDVFEEAEANKAAGKYDNASIDYQIEFYRNEGLTYYTPAKLPITSDVPEGCVIIREHIPITNLFTCLWFNEVDRFTSRDQISFSTVRDKIRARVGWMPEMFLDCERRNFVIQGYHRELLEQMIASGWKPPPTASEPSRKLRLGSRKAPPSKKSSMKRKRVKKSSSRRRLPKPITRMTDTTTWQKLGA

SEQ ID NO: 30090 - protein, 479 aa, Oryza sativa Indica Group
MSWSGDYEKYMATAAAVAGTAMVVRGVVSELVPDELREMLRSAARGIRARVSSTHTVVIDETEGLSTNQIYDAARTYLAARINTDMQRLRASRVDDAQGIMITMDQGEEMLDVHDGVEYTWRLVSRDTAAAATAHAAPYGIGGGGAANRRGRSRFEVKSFEVSFHKKHKEKALRSYLPFVIDTAKAMNDKHRNLKMHMIEYDAWTAVDLRHPSTFDTLAMDHSLKHSVMYDLERFVKRKDYYRRIGRAWKRGYLLYGPPGTGKSSLIAAMANYLKFDIYDLELTEVKSNSDLRRLLVGMSNRSILVVEDIDCTIDLQQRDEGEIKRAKPTYSGEENEDKVTLSGLLNFVDGLWSTSGEERIIVFTTNYRERLDPALLRPGRMDMHIHMGYCTREAFRVLASNYHNVENHAMYPEIEQLIEEVLTTPAEVAEVLMRNDDVDDALQVLAEFLKAKRNEPGETKAENKNGNQKINKYEQSMV

SEQ ID NO: 30091 - protein, 484 aa, Oryza sativa Indica Group
MASYDKAIESYKKAITTAASVAASVMLVRSVVNELVPYEVRDVLFSGLGYLRSQISSQHTIIIEETEGWSHNHVYNAVRAYLATRINNNMQRLRVSSMDESSEKMVVTMEEGEELVDMHEGTEFKWCLISRSISADPNNGNGSGQREVRSYELSFHRKHKEKALKSYLPFIIATAKAIKDQERILQIYMNEYSDSWSPIDLHHPSTFDTLAMDQKLKQSIIDDLDRFIKRKDYYKRIGKAWKRGYLLYGPPGTGKSSLIAAMANHLKFDIYDLELTGVHSNSELRRLLVGMTSRSILVVEDIDCSIELKQREAGEERTKSNSTEEDKGEDKVTLSGLLNFVDGLWSTSGEERIIVFTTNYKERLDQALMRPGRMDMHIHMGYCTPEAFRILASNYHSIDYHVTYPEIEELIKEVMVTPAEVAEALMRNDDTDVALLGLLELLKSKIKDASETKAESKDANKQTEENKDGKAMENKNDSSTDECT

SEQ ID NO: 30092 - protein, 307 aa, Escherichia coli
ESTSLYKKAGLKPQVYHVDAFTSQPFRGNSAGVVFPADNLSEAQMQLIARELGHSETAFLLHSDDSDVRIRYFTPTVEVPICGHATVAAHYVRAKVLGLGNCTIWQTSLAGKHRVTIEKHNDDYRISLEQGTPGFEPPLEGETRAAIINALHLTEDDILPGLPIQVATTGHSKVMIPLKPEVDIDALSPDLNALTAISKKIGCNGFFPFQIRPGKNETDGRMFSPAIGIVEDPVTGNANGPMGAWLVHHNVLPHDGNVLRVKGHQGRALGRDGMIEVTVTIRDNQPEKVTISGTAVILFHAEWAIEL

SEQ ID NO: 30093 - protein, 80 aa, Zea mays
SFSSGKRDGGDFVAASVSPKGEWIYCVGEDMNMYCFSYQSGKLEHLMKVHEKDVIGITHHPHRNLVATIAEDCMMKIWKP

SEQ ID NO: 30094 - protein, 247 aa, Bacillus cereus ATCC 14579
MKLKDKVAIITGGASGIGESTVRLFIEEGAKVVIADFSERGKELSDELNAHGYNTLFIKTDVTKEADIKQLIHETVSTYGKLDIMYANAGVADDAPANELSYEKWKRTIDINLSGVFLSDKYSIEQFLKQGTGGVIVNAGSIHSFVSLPTPTAYSSAKGGVKLLTQNLCTAYAKYGIRINAVCPGYIDTPLLGSVNPQQKEYLASLHPQGRLGTPEEVAKAVLFLASDDASFVNGTTLLVDGGYTAR

SEQ ID NO: 30095 - protein, 58 aa, Kandelia candel
KKGNLGTIAPIAIGFIVGANVLAGGAFDGASMNPAVSFGPALVSWTWENHWVYWAGPL

SEQ ID NO: 30096 - protein, 553 aa, Daucus carota
MNRNSINILNYMQFTDAYLDKYGVLMTLELYSNNISGPIPSDLGNLTNLVSLDLYMNSFSGPIPDTLGKLTRLRFLRLNNNSLSGPIPMSLTNITTLQVLDLSNNRLSGPVPDNGSFSLFTPISFANNLNLCGPVTGRPCPGSPPFSPPPPFIPPSTVQPPGQNGPTGAIAGGVAAGAALLFAAPAMAFAWWRRRKPREHFFDVPAEEDPEVHLGQLKRFSLRELQVATDTFSTILGRGGFGKVYKGRLADGSLVAVKRLKEERTPGGELQFQTEVEMISMAVHRNLLRLRGFCMTPTERLLVYPYMANGSVASCLRERQPSEPPLDWPTRKRIALGSARGLSYLHDHCDPKIIHRDVKAANILLDEEFEAVVGDFGLARLMDYKDTHVTTAVRGTLGYIAPEYLSTGKSSEKTDVFGYGIMLLELITGQRAFDLARLANDDDVMLLDWVKSLLKEKKLEMLVDPDLENNYIDTEVEQLIQVALLCTQGSPMERPKMSEVVRMLEGDGLAEKWDEWQKVEVIHQDVELAPHRTSEWILDSTDNLHAFELSGPR

SEQ ID NO: 30097 - protein, 454 aa, Colwellia psychrerythraea 34H
MTQHFDYLAIGGGSGGIASANRAAKLGKKAAVIEAKYIGGTCVNVGCVPKKAMWYAGQISDALKYASDYGFAQHLTQDTPQFDWAKLVANREAYIERIHAAYQRGFDANDVTVIDGFAKFVDKNTVEVNGELITADHITIATGGRPTLPNIEGADYGIDSDGFFALTEQPKSVAVVGAGYIAVELAGVFHALGTKAHLLVRKEKPLRGFDNMLSDTLVEQMAKHGPTLHNHSTPERIEKLADGSLVIHLTNGKTIGPVETLVWAIGREPATDNINLAAAGVAMNERGFIETDKYQNTNVDGIYAVGDNTGRAQLTPVAVAAGRRLCERLFNNKPEEHLDYSGIATVVFSHPVIGTVGLTENEAIAQYGEENITVYKSQFTALYQAITEDHRDPTRMKLICAGKEEKVVGLHSIGFGSDELLQGFAVAMKMGATKADFDNTIAIHPTSAEEFVTM

SEQ ID NO: 30098 - protein, 881 aa, Thermotoga sp. RQ2
MAKKYVYFFANGKAEGRADMKDILGGKGANLAEMTNLGIPVPPGFTISAEVCKYYYDHGRTYPEELKEQVEEAMKRLEEVTGKKFGDPNNPLLVSVRSGAAISMPGMMDTVLNLGLNDETVKGLAKLTNNERFAYDAYRRFLQMFGDVVLKIPHEKFEKALEELKKEKGVKLDTELDAEDLKKLVERYKQIYKEEGKEFPQDPWKQLWLAIDAVFGSWMNERAIKYRQIHGIKEGDLLGTAVNIVAMVFGNMGEDSGTGVAFTRDPNTGEKKPYGEFLPNAQGEDVVAGIRTPLKLEELKNRMPEVYNQLLEIMDKLEKHYRDMQDIEFTVERGKLYILQTRNGKRTSQAAIRIAVDMVHEGLITKEEAILRVRPEDVEQVLHPVFDPKEKAQAKVIAKGLPASPGAATGKVVFNAKKAEELGKAGEQVILVRPETSPEDVGGMAAAQGILTSRGGMTSHAAVVARGMGKPAVVGAESIEVHPEEGYFKVGDVVVKEGEWISIDGTTGEVLLGKVTTIKPQGLEGPVAELLQWADEIRRLGVRTNADIPRDAEIARKFGAEGIGLCRTEHMFFEKDRIPKVRRMILAKTKEEREKALDELLPLQKEDFKGLFRVMKGLPVTIRLIDPPLHEFLPQEDEQIKEVAEQMGVSFEELKNVVENLRELNPMLGHRGCRLTITYPEIAVMQTKAIIGAAIELKKEEGIDVIPEIMIPLVGHVNELRYLKKIIKETADALIKEAGVELTYKIGTMIEVPRAAVTAHQIAEEAEFFSFGTNDLTQMTFGFSRDDVGKFLPEYLEKGILEHDPFKTLDYDGVGELVRMGKEKGRSTRPDLKVGVCGEHGGDPRSILFFDKIGLDYVSCSPYRVPVARLAAAQAALKNKK

SEQ ID NO: 30099 - protein, 446 aa, Ostreococcus tauri
MTDDFTSERKSSIVTIGLSIHSCPVEIREKMAVPAEAWNEAVAELCSYPHIEEAGILSTCNRMEIYVVALSYERGLKEVEEWMVKYSGVDLESLRNHLFVLKDRESTAHLLKVSGGLDSVVMGEGQILAQVKNVFAMGEGVPSFGRHLTGLFKAAITAGKRVRSETSIASGAVSVSSAAAELVQLKLPSQSFEGVKVLIVGAGTMSKLLVKHLASKRCTEMTIVNRTRPRAEALAEEFPEVNMRIELMDQFLPLASEHDVIFTASSAVDPIISKKDLAAFPVCGEVVGGKRRLVDIAVPRNVDANCTEDPNTVVYNVDDLKELAELNKAKREQAALEAQALLQEEQRNFEAWRDSLETVPTIKRLRQKAEDLRQAELDKAMSKLGDGLTNKQKKAVEELSRGIVNKLLHGPMAALRSDGSDPTAVAMTLVNMHALERMFDLRNVKE

SEQ ID NO: 30100 - protein, 201 aa, Oryza sativa
  misc_feature (145)..(145): Xaa can be any naturally occurring amino acid
  misc_feature (179)..(179): Xaa can be any naturally occurring amino acid
  misc_feature (187)..(187): Xaa can be any naturally occurring amino acid
RSMAASYWKSSQYEQWLFDRQELLSVRLRDIASWPSNNNSPPITEDDYMKIMIFYSNIIQNIGEHYKVRQQVIGTAIVYMKRFYARYPLKSIDPWLLCPTCLFLAAKVEEFSTLNHQKVCFAATAIYKKYAHLLGGPSEYPYQIXHILECEFYLLEVMDCCLIVYHPYRSLDLYTRKFXIDQQLFEXTWRIINDSFETDAA

SEQ ID NO: 30101 - protein, 352 aa, Borrelia burgdorferi B31
MLYSFYKVFCLKDYVFKKARIFVKENKLKANIVFPESSDSRVLKAAIVILQKNLADSIILIGKKDTVINSLKEFSNCNDILGRIEVVDPNSFPDIEMYLDEYWSLQKLKGVTKQSLKTQVLDEITFAMLMVRFGYAKSCVCGAVSTSAKVLSNALRIIPKLEGVKIISSFMIMDTLCTARNVDFCFGHNGILFFADCSVVVNPNSLELAEIALQSAKSFKDILNAKPKVALLSFSTKGSSSAKETEKVKNALNIVRNKESDLLIDGELQLDSAIIKDVAEKKCRESLVAGSANVLIFPNLDAGNIGYKLVERFAFAKAYGPFLQGFSKPISDLSRGCSVDEIVFASALMISI

SEQ ID NO: 30102 - protein, 428 aa, Triticum aestivum
  misc_feature (179)..(179): Xaa can be any naturally occurring amino acid
  misc_feature (198)..(198): Xaa can be any naturally occurring amino acid
  misc_feature (247)..(247): Xaa can be any naturally occurring amino acid
MAMSRAAAAVGQRRCGPLLPAARSMASWFGHVEPAAKDPILGVSEAFLADPSPDKVNVGVGAYRDDDGKPVVLQCVREAERRIAGSTNMEYLPMGGSVKMIEESLKLAYGEDSEFIKDKRIAAVQALSGTGACRLFADFQKRFLPDSQIYIPTPTWSNHHNIWRDAQVPQRTFAYYHPXKSRGLDFAGLMDDIKNAPXGSFFLLHACAHNPTGVDPSEEQWREISHQFKVKNHFPFFDMAYQGFASXGDPERDAKAIRIFLEDGHQIGCAQSYAKNMGLYGQRAGCLSILCDDEIQAVDVKSQLQQIARPMYSNPPLHGALIVSTILGDPALKSLWLKEVKGMADRIIGMRKALKESLEKLGSPLSWEHITNQIGMFCYSGMTPEQVDRLTNEFHIYMTRNGRISMAGVTTGNVAYLANAIHEVTKPI

SEQ ID NO: 30103 - protein, 183 aa, Saccharomyces cerevisiae
MGNSISKVLGKLFGSKEMKILMLGLDKAGKTTILYKLKLNKIKTSTPTVGFNVETVTYKNVKFNMWDVGGQQRLRPLWRHYFPATTALIFVIDSSARNRMEEAKEELYSIIGEKEMENVVLLVWANKQDLKDAMKPQEVSDFLELEKNLKNQPWCVIGSNALSGQGLVEGLSWISNNTNVPKK

SEQ ID NO: 30104 - protein, 549 aa, Oryza sativa
DPSSSLITPPIPSSSAAKHLASSAMATATASSLSLLFAHPHSSNPRPFAGGPHLRRPLRAAPHRARCASDAATTATRHRRPAEENIREEAARLRGPGNDFSAWYVPFPPTPEDDPDERYSLDEVVYRSSSGGLLDVCHDMEALARFPGSYWRDLFDSRVGRTAWPYGSGVWSKKEFVLPEIDSDHIVSLFEGNSNLFWAERLGREHLGGMTDLWVKHCGISHTGSFKDLGMTVLVSQVNRLRRAPLSRPINGVGCASTGDTSAALSAYCAAAGIPAIVFLPADRISLQQLIQPIANGATVLSLDTDFDGCMRLIREVTAELPIYLANSLNSLRLEGQKTAAIEILQQFDWQVPDWVIVPGGNLGNIYAFYKGFEMCRVLGLVDRVPRLVCAQAANANPLYRFYKSGWTDFQPRVAETTFASAIQIGDPVSVDRAVVALKATDGIVEEATEEELMDAMSLADRTGMFACPHTGVALAALFKLRDQRIIGPNDRTVVVSTAHGLKFTQSKIDYHDRNIKDMLCQYANPPINVKADFASVMDVLQNKLNGKI

SEQ ID NO: 30105 - protein, 134 aa, Sinapis alba
DGWKAYEENPFHPIDRPDGVIQMGLAENQLCGDLMRKWVLEHPEASICTAEGVNQFSDIAIFQDYHGLPAFRAVAKFMEKTRNNKVKFDPDRIVMSGGATGAHETVAFCLANPGDGFLVPTPYYPGFDRDLRWR

SEQ ID NO: 30106 - protein, 258 aa, Saccharomyces cerevisiae
MAAGVPKIDALESLGNPLEDAKRAAAYRAVDENLKFDDHKIIGIGSGSTVVYVAERIGQYLHDPKFYEVASKFICIPTGFQSRNLILDNKLQLGSIEQYPRIDIAFDGADEVDENLQLIKGGGACLFQEKLVSTSAKTFIVVADSRKKSPKHLGKNWRQGVPIEIVPSSYVRVKNDLLEQLHAEKVDIRQGGSAKAGPVVTDNNNFIIDADFGEISDPRKLHREIKLLVGVVETGLFIDNASKAYFGNSDGSVEVTEK

SEQ ID NO: 30107 - protein, 137 aa, Kineococcus radiotolerans SRS30216
MSALDAAGPVLDAQGRVLDRIVLRGVRAVGHHGVLDAERAQGQPFALDVALHLDTREAAAGDDLTATVHYGELAQDLVAVLTGEPVALLETLAGRLAETALARSPRIAAVDVVVHKPQAPIPVLFDDVELVIRRTRP

SEQ ID NO: 30108 - protein, 230 aa, Streptomyces purpurascens
MQAWQVHENGEPSEVMRLEDASATPAKAGLLSARANITPDACCAALQSARCLIGVEICGETEDGRRVIANPALPHGFAEYAVADAAALLPAPDALDDAEAAALHIGYQTGWFGLHRRAGLEAGETLLVHAAAGGVGSAAVQLGKAAGATVIGVVGGPGKAAVARELGCDVVIDRRAEDVVAAVKEATGGRAPNVIYDPVGGEAYTQSAKVVAFEGRIIVVFAGGTIPARP

SEQ ID NO: 30109 - protein, 493 aa, Oryza sativa
  misc_feature (142)..(142): Xaa can be any naturally occurring amino acid
  misc_feature (152)..(152): Xaa can be any naturally occurring amino acid
  misc_feature (204)..(204): Xaa can be any naturally occurring amino acid
MSSSLASRRSSSSSAAKRPAAGEGGGKAAAGAAAAKKRVALGNITNVAAAANNAKFNSATWAAPVKKGSLASGRNVGTNRVSAVKSASTKPASAISRHESAPQKESVLPPKVLRIVPTAAPAPVTVPCSSFVSPMHSGDSVXSVDETMSTCXSMKSPDFEYIDNGDSSSVLGSLQRRANENLRISEDRDVEETKWKKDAPSPMXEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEVLEMEASVLNYLKFEMTAPTAKCFLRRFVRVAQVSDEDPALHLEFLANYVAELSLLEYNLLSYPPSLVAASAIFLAKFILQPAKHPWNSTLAHYTQYKSSELSDCVKALHRLFCVGPGSNLPAIREKYTQHKYKFVAKKPCPPSIPTEFFRDSTC

SEQ ID NO: 30110 - protein, 221 aa, Streptococcus pneumoniae TIGR4
MAGITAAEFIKDGMVVGLGTGSTAYYFVEEIGRRIKEEGLQITAVTTSSVTSKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 30111 - protein, 475 aa, Oryza sativa Indica Group
MAFHVFLIAALLLLPLPAAFSKAVRTQSLLANPLSPDPITQEQQLSLAAPRTNASTLHFRLAHREHFALNATASDLLAHLLARDAARAAALLAAPNNATRPRRRGGFAAPLLSGLPQGSGEYFAQVGVGTPATTALMVLDTGSDVVWLQCAPCRHCYAQSGRVFDPRRSRSYAAVDCVAPICRRLDSAGCDRRRNSCLYQVAYGDGSVTAGDFASETLTFARGARVQRVAIGCGHDNEGLFIAASGLLGLGRGRLSFPTQIARSFGRSFSYCLVDRTSSVRPSSTRSSTVTFGAGAVAAAAGASFTPMGRNPRMATFYYVHLLGFSVGGARVKGVSQSDLRLNPTTGRGGVILDSGTSVTRLARPVYEAVRDAFRAAAVGLRVSPGGFSLFDTCYNLSGRRVVKVPTVSMHLAGGASVALPPENYLIPVDTSGTFCFAMAGTDGGVSIIGNIQQQGFRVVFDGDAQRVGFVPKSC

SEQ ID NO: 30112 - protein, 371 aa, Trifolium pratense
MADGPQYPSVAQKLGRHSYLVSRLSPNLNSRSYSTSGTFAYGGLQNSGLAIGSPLSSIMVPAPSEKGAAGFLVDFLMGGVSAAVSKTAAAPIERVKLLIQNQDEMLKSGRLSEPYKGIGDCFARTMKDEGVIALWRGNTANVIRYFPTQALNFAFKDYFKRLFNFKKDRDGYWKWFAGNLASGGAAGASSLLFVYSLDYARTRLANDAKAAKKGGERQFNGMVDVYRKTLQSDGIAGLYRGFNISCVGIIVYRGLYFGMYDSLKPVVLVGGMQDSFFASFLLGWAITIGAGLASYPIDTVRRRMMMTSGEAVKYKSSLHAFQTIVAKEGTKSLFKGAGANILRAVAGAGVLAGYDKLQLVLFGKKYGSGGG

SEQ ID NO: 30113 - protein, 231 aa, Triticum aestivum
  misc_feature (65)..(65): Xaa can be any naturally occurring amino acid
  misc_feature (77)..(77): Xaa can be any naturally occurring amino acid
  misc_feature (113)..(113): Xaa can be any naturally occurring amino acid
  misc_feature (130)..(130): Xaa can be any naturally occurring amino acid
MGRKFFVGGNWKCNGTVEQVESIVNTLNAGQIASTDVVEVVVSPPYVFLPTVKGKLRPEIQVAAXNCWVKKGGAFTXGEVSAEMLVNLGVPWVILGHSERRSLMGESSEFVGXKGAYALAQGLKVIACVXGETLEQREAGSTMEVVAEQTKAITGKIKDWTNVVVAYEPVWAIGTGKVATPAQAQEVHANLRDWLKTNVSPEVAASTRIIYGASLKPEFIDIINAATVKSA

SEQ ID NO: 30114 - protein, 401 aa, Magnetococcus sp. MC-1
MGILSNRVAKVKPSATLAVTAKAKELKAAGRDVIGLGSGEPDFDTPDHIKQAAIDALNAGYTKYVAVAGTPELRQAIADKYKRETGLDYSAEQTVVTVGGKQAFFNLAQATLNSGDEVIIPAPYWVSYPDMTLLADGTPVIVDTQESHGFKITPAELEAAITPRTKFVVLNSPSNPTGNAYSIAELHALAEVLRKHPHVWVISDDIYEKIIYDGFEFATMVKVAPDLQDRTVILNGVAKAYSMTGWRIGYAVGPLDVIKAMTKIQGQSTSNATSFAMKGALEAITGPQDCVEPMVKAFKERRDYVVARLNAMPGISCLTPEGAFYVYPNVAGLVGKKAPDGSDLKDSVDLASYMLEAEGVAVVPGVAFGLDPYLRLSYATSMEDLIKAMDRIEKIAQQLAG

SEQ ID NO: 30115 - protein, 360 aa, Lolium perenne
MGSTAADMAASADEDVALFALQLASSSVLPMTLKNAIELGLLEILVAAGGKSLTPTEVAAKLPSAVNPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAIAAHYPAIKGVNFDLPHVISEAPQFPGVTHVGGDMFKEVPSGDAILMKWILHDWSDQHCATLLKNCYDALPANGKVVLVECILPVNPEANPSSQGVFHVDMIMLAHNPGGRERYEREFQALARGAGFTGVKSTYIYANAWAIEFTK

SEQ ID NO: 30116 - protein, 536 aa, Prochlorococcus marinus str. MIT 9312
MIRFEGVSKIYSTDIVLKNINWEIKKGEKVGLVGSNGAGKSTQFKILIGEEDQTSGTIIKEGNPKIAHLKQELDCNLNCSVREELESSFKDIQIVAIKLLEIENKMKSLDFKKNSDELETLVNQLAKYQAKFEVLGGYKMQSDVDKILPKLGFSIEDADKLVGNFSGGWQMKVALGKIILQKPDLLLLDEPTNHLDLDTIFWLEEYLSSLKIAIIIISHDRFFLDKLCKKIIFIDRGIAEIYNGNYSFFVEQKSLNEESQNKAYQLQQKEIEMQKKYIDRFRASATRSSQAKSREKQLKKISKIEAPIAKAKSPAFNFPECPRSGKLVLNIKNLSHSYEDKILFLDVNLKISSGDKIAILGPNGSGKSTLLKIIMEKISPEIGEINLGKHNIITSYYEQNQAEALSLEERVIDLICNKSPEWSQKKVRTFLGGFGFQKETVFKYIKQLSGGEKARLALALMIMNPSNFLLLDEPTNHLDLQSKENLELAINNYKGSLLIISHDRYFISKVANRIVEIKDSKLFSYDGNYEYFLEKK

SEQ ID NO: 30117 - protein, 380 aa, Methanococcoides burtonii DSM 6242
MDLEDTLLMMPGPVPVAPRVLRAMSRPMINHRGKEFSAMFDDCTTMLKEIFQTENDLFTISGSGTASMEAALGCTIDKDDKVVTIENGKFGERFKDIAARYGQVVPVECEWGTSVDLDVVEEKLAEGAKAVTMVHNETSAGIRNPALEVGMLAKKYGALFIMDGVTSIGGDDVKVDEWGVDIAVVGSQKCIAAPPGLSMLSVSERAFEAMNKENLPYYLDLKAYQKSAAKSQTPYTPAVPLFFGLQEALKIVMEEGMDARIKRQATGAAAVRAAMDAIGIEMFPQLNATSAYSSTVSAMKSPEGVDSNDIKNGMMDKGIIIAGGQNRLSGKIFRIGSMGNVAPKDLMMTIQHLELVFRNLNVINEMGAGTEAAAKVFDTL

SEQ ID NO: 30118 - protein, 349 aa, Treponema denticola ATCC 35405
MKVAINGFGRIGRLVFQALVNQNLLGKDKFDVVAVVDLSTDAKYFAYQLKYDSVQGKMDAKIGTDGDDVLVVNGHKIKCISGKGLTPAQLPWKELGIDVVIESTGIYTNEKAYEHLEAGAKKVIISAPGKSKDPAKPIKTFVMGVNENEYKASEHHVVSNASCTTNCLAPVVHVLLKEGFGIETGLMTTIHAYTATQKTVDGVSLKDWRGGRAAAVNIIPSTTGAAKAVGEVLPTTKGKLTGMSFRVPTPTGSVVDLTIRTEKDTSIEEIDKAIKKASESYLKGVLAYCDEEIVSTDIIHDPHSSIYDSKATLQNNLPGEKRFFKLVSWYDNEWGYSNRVIDLLKFITK

SEQ ID NO: 30119 - protein, 219 aa, Salmonella enterica subsp. enterica serovar Typhi str. CT18
MTQDELKKAVGWAALQYVQPGTIVGVGTGSTAAHFIDALGTMKGQIEGAVSSSDASTEKLKGLGIHVFDLNEVDSLGIYVDGADEINGHMQMIKGGGAALTREKIIASVAEKFICIADASKQVDILGKFPLPVEVIPMARSAVARQLVKLGGRPEYRQNVVTDNGNVILDVYGMEILDPIALENAINAIPGVVTVGLFANRGADVALIGTPDGVKTIVK

SEQ ID NO: 30120 - protein, 175 aa, Glycine max
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIDFQPPGCEESAKA

SEQ ID NO: 30121 - protein, 321 aa, Thermotoga sp. RQ2
MRFFVLGAGSWGTVFAQILHENGEEVVLWARRKEIVDLINVSHTSPYVEESKITVRATNDLEEIKKEDILVIAIPVQYIREHLLRLPVKPSMVLNLSKGIEIKTGKRVSEIVEEILGCPYAVLSGPSHAEEVAKKLPTAVTLAGENSKELQKRISTEYFRVYTCEDVVGVEIAGALKNVIAIAAGILDGFGGWDNAKAALETRGIYEIARFGMFFGADQKTFMGLAGIGDLMVTCNSRYSRNRRFGELIARGFNPLKLLESSNQVVEGAFTVKAVMKIAKENKIDMPISEEVYRVVYEGKPPLQSMRDLMRRSLKDEFWAS

SEQ ID NO: 30122 - protein, 507 aa, Robiginitalea biformata HTCC2501
MNSKAILMILDGWGISPDPKVSAIEQADTPFVDSLYEKYPHATLLTDGMHVGLPDGQMGNSEVGHMNLGAGRIVYQDLAKINLAVSNNSLKDAPALKEAFRYAVENDKPVHFLGLLSDGGVHSHIDHLKGLIRAADEAGVPASYVHAFTDGRDVDPKSGVGFVRDLMEFARPTRTRLASVVGRYFAMDRDKRWERVKKAYDLLVNGTGTATDNPVAALEASYAAGTTDEFVEPIAVAGTDGKPLAQIRDGDVVVFFNFRTDRGRELTLALSQEAFHEQNMHPLKLHYVTMTNYDDTFKDVHVVYDKENIKDTLGEVLARAGKKQIRIAETEKYPHVTFFFNGGREAPFEGESRILCPSPKVATYDLQPEMSAYDIRDAILPELAKGEADFVCLNFANPDMVGHTGDLQAAIKACETVDACARDVITAGLENGYTTLVIADHGNCDTMVNPDGSPNTAHTTNPVPLILVDPDRKSIKSGVLGDMAPTILEIIGVAQPELMTQKSLLVS

SEQ ID NO: 30123 - protein, 267 aa, Mesorhizobium sp. BNC1
MSVIQRNNVKVLGSGEKAMVFGHGFGCDQNMWRFIWPAFAEEYRIVLFDHVGCGGSDLKAYDAGKYSSLEGYAEDIIEICRALYVTHGVFVGHSVSAMIGAMASVKAPDIFDNLVMIGPSPRYIDDAEYIGGFTEAQIHELLDFLDSNHMGWSQAMAPVIMGNPDRPELGEELTNSFCMTDPEIAKRFARVTFLSDNRADLPRVTARSLVLQCSEDVIAPQAVGEYVHRHLPGSAYVLLQASGHCPNLSAPEETVAAMKTFLETGAG

SEQ ID NO: 30124 - protein, 274 aa, Robiginitalea biformata HTCC2501
MSAIQIKSAEEIELMRESALVVSKTLGMLAAEIKPGVTGLQLDKLAETFIRDQGAEPGFLGMYDFPNTLNISPNAQVVHGIPNDTPFEEGDIISVDCGALKNGFYGDHAYTFPIGEVAPETLKLLEVTKESLYVGIREFRAGNRVGDVAWAIQDHCEKHGYGVVRELVGHGLGRKLHEAPEMPNYGKRGRGKKFVDGMVVAIEPMINRGTRRIRQLRDGWTILTADGQPSAHFEHDVALVDGKPELLSTFAYIYEALGIESDEETAFRAAPLTT

SEQ ID NO: 30125 - protein, 490 aa, Pseudomonas fluorescens Pf-5
MARFELQKLYIDGGYTDAGSDATFDAINPANGEVLAQVQRATKEDVERAVVSAEKGQKIWAAMTAMERSRILRRAVEILRERNDELAALETLDTGKAFSETKYVDIVTGADVLEYYAGLVPAIEGEQIPLRTTSFVYTRREPLGVVAGIGAWNYPIQIALWKSAPALAAGNAMIFKPSEVTSLTTLKLAEIYTEAGLPDGVFNVLTGSGREVGTWLTEHPRIEKVSFTGGTDTGKKVMASASSSSLKDVTMELGGKSPLIIFDDADLDRAADTAMMANFYSSGQVCTNGTRVFVPSHLKAAFEAKIAERVARIRIGNPEDENTNFGPLVSFPHMESVLGYIAKGKEEGARVLCGGERLTDGEFAKGAFVAPTVFTDCTDDMTIVREEIFGPVMAILTYETEEEVIRRANDTDFGLAAGLVTKDLNRAHRVIHQLEAGICWINAWGESDAKMPVGGYKQSGVGRENGISSLNNFTRIKSVQVELGDYASVF

SEQ ID NO: 30126 - protein, 307 aa, Ostreococcus tauri
MPFDVQAAGTALLEAHSASVALAKAKIRELALPVPLERLDDVALVVVIICTLFSVAIALTLTRALGRTASALRLSTSSRADAIVLMGPKGSGKTCAWQSLAYGEQKFGTCTSVEINELTEDVKGKDARGREVTKRKVRVIDVPGHPKLRREAMLWLKQAKAVVFVVDSVTVANERKEVAQFLFSILSDENFQRRRLPLMLACNKGEKLTAHPPDFIRKRLEREIEAVRRAAEGELPSMAINSKQRRANAAAQKKRDKYRTLGQRPGEAFTFDAFARATACPPTTFDRLSAVKNQVEPLRDFIVRLRH

SEQ ID NO: 30127 - protein, 755 aa, Ostreococcus tauri
MMTNPPSRLHARNRTRSRAAVMPPVVVGVDGGTGGVRAGVFDLNGTPLGFSERSYATTFPEPGRAEQNPKDWIDGLGLAVRDALASANVDASDVLGMCVDTTCCSVVALDANGEALMPCVLWMDVRASEETREVLATSDDALRVNCDGRGPVSAEWMIPKALWMKKNRREVYDGASMICEYQDFINLKLTGRFCGSRNNVGVRWHFDAGEPPRTMLEKLEMSELLLKWPREILDMGSVIGGLTPVAAANCGLLEGTPVIQGGADAFVGMVGLGVIEPGQMALITGSSHLHLGVTDEEFHAAGIFGTYRAALVESAPFVVEGGQTSTGSVVRWFKDLCGGGDEFYDEMNREASALPPGCEGVTVLDHFQGNRTPHVDPLSRGAISGLTLKHSRAHVYRAILESVCCGTRLIFETMERGGYAPKEVVIAGGTTRSELWLQIGADVTGLPHVVTECTDAPALGCAILAAVGAGAFKSIRDAVNAMVRKSRVIMPNVEAHAAYSRYVYPAYLRMYPSLRDVLGCKRAPERTTKRRAIVCPSLLAADQGALASEVNRMLDEGADWLHVDIMDGHFVPNLTIGPPVVADLSRRVGPRDVFFDCHLSVNNPATLVPALAKAGASSVTFHIEVVNGERAAELCRTIRSLGMRVAVACKPSTSCESSGVYDLCEAGLVDMVLCLSVEPGFGGQKFKPSVLDKVRSLRSRFPDIDIQMDGGVNPTTAVECAAAGANVLVAGSAIFSAPDPAHVISLLRSAIENAH

SEQ ID NO: 30128 - protein, 134 aa, Glycine max
  misc_feature (6)..(6): Xaa can be any naturally occurring amino acid
  misc_feature (58)..(58): Xaa can be any naturally occurring amino acid
QNCWVXKGGAYTGEVSAEMLVNLGIPWVIIGHSERRQLLNESNEFVGDKVAYALQQGXTPAQAQEVHADLRKWVHDNVSAEVAASVRIIYGGSVNGGNCKELAAQPDVDGFLVGGASLKAEFVDIINDATVKKN

SEQ ID NO: 30129 - protein, 314 aa, Oryza sativa Japonica Group
MPAGQPHAHEPDGGGASHRRPQSPPSLPAEVVPAFAPPESEDEESWVWSQIKAEARRDADAEPALASFLYATVLSHPSLPRSISFHLANKLCSSTLLSTLLYDLFLASFTAHPSLRAAVVADLLAARSRDPACVGFSQCLLNFKGFLAIQAHRVSHVLWAQQRRPLALALQSRVADVFAVDIHPAAVVGKGILLDHATGVVIGETAVVGDNVSILHHVTLGGTGKAVGDRHPKIGDGVLIGAGATILGNVKIGAGAKIGAGSVVLIDVPARNTAVGNPARLIGRKNGEVEKDEDMPGESMDHTSFIRQWSDYTI

SEQ ID NO: 30130 - protein, 127 aa, Triticum aestivum
MAASAATATATAAAVGAGEVISVHSLEQWTMQIEEANAAKKLVVIDFTASWCGPCRIMAPIFADLAKKFPAAVFLKVDVDELKPIAEQFSVEAMPTFLFMKEGDVKDRVVGAIKEELTTKVGLHAAQ

SEQ ID NO: 30131 - protein, 461 aa, Pseudomonas fluorescens Pf-5
MTTIATAFNTLPLSPAMLANLDSLGYAQMTPIQAQSLPVILKGMDLIAQAKTGSGKTAAFGIGLLNPINPRYFGCQALVICPTRELADQVAKEVRRLARAEDNIKVLTLCGGVSFGPQIASLEHGAHIIVGTPGRIQQHLRKGSLVLDGLNTLVLDEADRMLDMGFYDAIEDIIEKTPSRRQTLLFSATYPVGIKQLASKFMRDPQTVKAEAFHDDTQIEQRFYEISPEERMSAVTKVLHHFRPASCVAFCFTKQQVQETVDHLTAKGISAVGLHGDLEQRDRDQVLAMFANRSTSVLVATDVAARGLDIDALDMVINVELARDSEIHIHRVGRTGRAGEKGIAVSLVAPSEAHRAQAIEQLQKAPLNWDQVDNLKSQGGAPLQPPMSTLCIAGGRKDKVRPGDILGALTGDAGIPGAQVGKIAIFDFQSYVAVERTVVMQALQRLNNGKIKGRSLRVRVL

SEQ ID NO: 30132 - protein, 548 aa, Saccharomyces cerevisiae
MGSSHHHHHHSSENLYFQGHMTKSHSEEVIVPEFNSSAKELPRPLAEKCPSIIKKFISAYDAKPDFVARSPGRVNLIGEHIDYCDFSVLPLAIDFDMLCAVKVLNEKNPSITLINADPKFAQRKFDLPLDGSYVTIDPSVSDWSNYFKCGLHVAHSFLKKLAPERFASAPLAGLQVFCEGDVPTGSGLSSSAAFICAVALAVVKANMGPGYHMSKQNLMRITVVAEHYVGVNNGGMDQAASVCGEEDHALYVEFKPQLKATPFKFPQLKNHEISFVIANTLVVSNKFETAPTNYNLRVVEVTTAANVLAATYGVVLLSGKEGSSTNKGNLRDFMNVYYARYHNISTPWNGDIESGIERLTKMLVLVEESLANKKQGFSVDDVAQSLNCSREEFTRDYLTTSPVRFQVLKLYQRAKHVYSESLRVLKAVKLMTTASFTADEDFFKQFGALMNESQASCDKLYECSCPEIDKICSIALSNGSYGSRLTGAGWGGCTVHLVPGGPNGNIEKVKEALANEFYKVKYPKITDAELENAIIVSKPALGSCLYEL

SEQ ID NO: 30133 - protein, 1118 aa, Ostreococcus tauri
MGCASSATAEGTSKDGTAVVRSPERASTSANDASKTKQSQSKSPSVSYQVRLRGGPLTQDEYNARLTGVHGANAIDVAFKGESGEARSYTLRYALCSQRGYYPEAPNKRNQDAWVCARNFRGKKDELLFGVFDGHGEFGTECAEFACERLPMEIATRGFGNVSAYEAAFRATNAGLRASDVDDSLSGTTAVIAHIKGRDMYVMNCGDSRATMAMATRNVKGEVTGVDTVDLSSDQTPFRADECERVKREGARVLTLDQLEGFKDPAVQCWGTEQDDDGDPPRLWAKNGMYPGTAFTRSIGDAVAERIGVISTPEIEHVRLSEDTKAVIIASDGVFEFIPSTSVVKAATSTKDPQQSAIALVVESYKLWLQYETRTDDITVIVILIEDFLEEKQQEIAPVTPLKSVQSVGALFNFPDRMDPLSSPFPSSARPRRRVMPTFTMQTRRSYRVVHPYGVPSDITLQDGSPLEEQMGDLSIAISSDRSPLISIIRQSFLFYDAPEHLLEQVAKVMYKKRFENGDVIVTQNDKNCVRALYVVQSGTLTGRDNVQWVENEGDDNAKKKQTEKLRAYGRDGDRMCFNEQCMAHAQMPHETVTATSDGVLWVLDFAAYVTITREANERSVDMLTRVLRGVDALKPVSLSDLRRVAAKIVLNRANSLVKTAKDQLIANQGQILTAMHVMNKGEVACTVRSNARDESEPPRVVLKLTVGQYFGERALLSAAGAPCATNIQSLSDDVQVWKVTREDISSVTGSEVIMRTSSALERTASSERLLAPRTSAGLDIPHERRLSFGDDDRATREALYMTLLGHMRETKGMHKEATVQISLARTESLSRVEGVLRERKIITALTAGSTLPPSFIPTPGIPSRDASFISIPYPFVPRCALEAVIACGGGSNIEVVRYYIASLVVVLEYMHSMDIVFRGMDPETMVIDERGMLRLTDFRFAKRLSVTDKTPGRTYTVCGAAAYMAPEVVRGLGHDERADWFSLGVFIAHLLRGAPPFGMTVGHKTYEAICMCDLASAFPASIDKKIPEAEILARCLLVVDPDSRLHSTSSVKQCDLLCDVDWDALANQPPPKAVETLTRSAYRGRGVPPIRDATEPQNVVERTAWVDTFMALDSIAP

SEQ ID NO: 30134 - protein, 465 aa, Oryza sativa
MAASPAAGAAAATVSSFVSPSSFSSVKASKPDRLRPARRAAAVNVRCVSSPPATETSFKTKVPRNANMAKLQAGYLFPEIARRRAAHLLKFPDAKIISLGIGDTTEPIPDVITNAMAKDGAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 30135 - protein, 319 aa, Triticum aestivum
  misc_feature (66)..(66): Xaa can be any naturally occurring amino acid
  misc_feature (85)..(85): Xaa can be any naturally occurring amino acid
  misc_feature (265)..(265): Xaa can be any naturally occurring amino acid
MSMSSPVHARKALHLVAMKAKLQSFLGLRLLLVAALAAFLLLFSARTLFSSSSSPGQRSAASQAAXSGAGDDGSCSKLPAPGGRXAWVHYATSNTTPQQTAAEIGVSLRVLQRRSPCNFLVFGLGLDSPMWAALNHGGRTVFLEEDASWIASVRSKHPGLESYHVVYDTRLTEADELIALRDHPGCTAQPDLAAAAEASCRLALRGLPAAFHEVEWDLVMVDAPTGWVPEAPGRMGRIYTAGMVARARRPGDGATRRVVHDVDRXVEDRSSRAFLCDAYLAEQVGRIRHFVIPSHREKPGTPSCLQIKSFFYHPVFLTD

SEQ ID NO: 30136 - protein, 510 aa, Oryza sativa Japonica Group
MEASTILWLLYVSLASCLLYKVFVSTKNGHPKIAARRPPGPTPVLLLGNVFDLRGELHLALARLAEEHGPVMSLKLGTATAVVASSAAAARDALQRYDHVLAARAVCDAARALGTHERSIVWLPGSSALWKRLRAVCTNHLFSARGLDATRAVREAKVRELVEHLRGHAAGAGEEEAAAVDVGRVVFSAVINLVSNVLFSEDVADLSSDRAQELEMLVRDTVEEATKPNLSDLFPVLAALDLQGRRRRTAVHIRKFHDFFDEIISRRQNAGGEGERKEDFLDVLLQLHSADQLSLDTIKTFLGDLFTAGTDTNSITVEWAMAELLRHPAAMSRARAELRDALGAKPHPDESDIGRLPYLSAVVMETMRLHPPSPLLMPHEAVADGAAVGGYAVPRGTKVIVNVWSIMRDPASWPRPEEFEPERFVAAGGSFRGGEMLEFMPFGAGRRACPGTPMATRVVTLVLASLLHAFEWRLPGGMRPCDVDVRGRFGTSLNMVTPLKAVPVPVPARP

SEQ ID NO: 30137 - protein, 301 aa, Staphylococcus aureus subsp. aureus Mu50
MITYDLIGNTPLVLLEHYSDDKVKIYAKLEQWNPGGSVKDRLGKYLVEKAIQEGRVRAGQTIVEATAGNTGIGLAIAANRHHLKCKIFAPYGFSEEKINIMIALGADVSRTSQSEGMHGAQLAARSYAEKYGAVYMNQFESEHNPDTYFHTLGPELTSALQQIDYFVAGIGSGGTFTGTARYLKQHHVQCYAVEPEGSVLNGGPAHAHDTEGIGSEKWPIFLERRLVDGIFTIKDQDAFRNVKSLAINEGLLVGSSSGAALQGALNLKAQLSEGTIVVVFPDGSDRYMSKQIFNYEENDYE

SEQ ID NO: 30138 - protein, 125 aa, Oryza sativa Japonica Group
MAALASKLAQMQAKACDAARFAAKHGCAYHRALMEKNQKYVADPPTIERCQELSKQLFYTRLASLPGRYEAFWKEADQVKNLWRNRKDLNVEHAGVAALFGIELYAWFCVGEIVGRGFTFTGYHV

SEQ ID NO: 30139 - protein, 590 aa, Oryza sativa Japonica Group
MGSYAYKYCMCFTRKFRSPAADPPPDVRAAFLAAGGGDGGLRRFLAQAQGETPAEVDRILALLSGGGGGGGGGGIAARLVGPRPGPAPSLDDFFGFLFNADLNPPIATQVHQDMSAPFSHYYIYTGHNSYLTGNQLNSDSSDIPIIKALQRGVRVIELDMWPNSAKNNIDILHGGTLTAPVQIIKCLKSIKEYAFCASPYPLVITLEDHLTPDLQAKVAEMLVKTFGNLLYIPSSDPINEFPSPESLMKKIIISTKPPEEYKKFLKSKDNQNINGGLANLAEEGSLRRIDSNAEESDGKDELDDQDEDSSDEDDPKFQQETACEYRELITIHAGKPKGHLKDALKVDPDKVRRLSLSETQLAKATASHGADVIRFTQKNILRVYPKGTRINSSNYDPMNAWTHGAQMVAFNMQGHDKALRLMQGFFRANGGCGYVKKPDFLLRTGPNGEVFDPNASMPVKKTLKVKVYMGDGWRMDFSKTHFDTFSPPDFYTRVGIAGVRADCVMKKTRTIEDQWVPMWDEEFTFPLTVPELAVLRIEVHEYDMSEKHDFGGQTCLPVSELKQGIRAVPLHDRRGTRYKSVRLLMRFDFL

SEQ ID NO: 30140 - protein, 398 aa, Oryza sativa Indica Group
MALALRCPAAASPSPAKSTFPPSSSPPPSRLPRRPPASCRCYYYGDGGGFRKNYDHIPKQFREENLKDGLMDNYKNVPQFLYGLSPAQIEMFMNDDNPYDRQSQRVTEESISASRSYDEFGMYNLSGMHEGPAGYSMGMGMGTMSMGRAGRGYRRMRSSAPDLPSLLLDSRIIFLGMPIVPAVTELIAAQFLWLDYDDRTKPIYLYINSTGTMDENNGLVASETDAFAIADFINLYLLVEMLVLFTTLLAQFRFSKRSKSKVYTINLSMAYGQAAMLLSLGVKAKLYLPKVHKSGGAAIDMWIKAKELDTNTDYYLELLSKGVGKPKEELAEFLKGPRYFRAQEAIDYGLADTILHSLDGSFKPKDLTAQLAKAQEMRQSGKRPAAGAGRWSTPSVPR

SEQ ID NO: 30141 - protein, 496 aa, Oryza sativa Japonica Group
MGSYAYKYCMCFTRKFRSPAADPPPDVRAAFLAAGGGDGGLRRFLAQAQGETPAEVDRILALLSGGGGGGGGGGIAARLVGPRPGPAPSLDDFFGFLFNADLNPPIATQVHQDMSAPFSHYYIYTGHNSYLTGNQLNSDSSDIPIIKALQRGVRVIELDMWPNSAKNNIDILHGGTLTAPVQIIKCLKSIKEYAFCASPYPLVITLEDHLTPDLQAKVAEMLVKTFGNLLYIPSSDPINEFPSPESLMKKIIISTKPPEEYKKFLKSKDNQNINGGLANLAEEGSLRRIDSNAEESDGKDELDDQDEDSSDEDDPKFQQETACEYRELITIHAGKPKGHLKDALKVDPDKVRRLSLSETQLAKATASHGADVIRFTQKNILRVYPKGTRINSSNYDPMNAWTHGAQMVAFNMQGHDKALRLMQGFFRANGGCGYVKKPDFLLRTGPNGEVFDPNASMPVKKTLKVKVYMGDGWRMDFSKTHFDTFSPPDFYTRVRQ

SEQ ID NO: 30142 - protein, 482 aa, Magnetococcus sp. MC-1
MGKITGFMEFERELPEKRPVAERIKDSKELYKDFPESALRIQAARCMDCGIPFCHSGCTLCNLIPQWNDLVYRERWEDASQALHRTNNFPEFTGRICPALCEASCVVGINGEAVAIREIEKTVAEKGWQEGYIKPLKPLSLTGKRVAVIGSGPAGMACAQQLTRVGHSVTLYEKNESVGGLLRFGIPDFKLEKEVVERRVNQMKEEGLTIKTGVHVGVDLSIEQLRQESDAIVLTGGAEQPRNLPIQGREFKGIHFAMSFLAQQNRRVAGSKIAPDEVIHAAGKRVVVIGGGDTGSDCVGTSNRHGAVSVTQLELLPKPPRDRADETPWPTWPHMLRTSTSHEEGCDRMWSILTKYFEGDEQGNVKRLHCVKLRWIEQEDGSRPQMEEIAGSEFVLEADLVLLAMGFLGPVKTGLLDELGVALDARGNVKVDHQFQTSVAGVFAAGDMATGQSLVLKCIDSGRKAARGVDAYLRGGESILEP

SEQ ID NO: 30143 - protein, 1923 aa, Oryza sativa Indica Group
  misc_feature (1590)..(1590): Xaa can be any naturally occurring amino acid
MDVQLGGGGKVAEPKDLSATDKDRPSSKKNRRRQKKPATSAAISPPVAAMQTLFDTSREFGIFCLPKSAVIPLHNHPGMTVFCKILFGSMHLKSYDWAKSAPDNDNNALETSDATDSVLGKFIAHASFSDILFVLTTGARLAKVNTDAVFDASSETTVLYPENGGNLHCFTARTACAVLDVMGPPYNRADGRDCSYYDESPYLSSSGGDARYSWLKENHSTFEMKGVQMPQRLWTAIMGHYCYITECCSYSVKKCTRIEIHLLTPQGLQNETQDFLFIATERYKFCVLQWDGEKSELLTRAMGDVSDRIGRPTDNGQIGIIDPDCRLIGLHLYDGLFKVIPFDNKGQLKEAFNIRLEELQVLDIKFLYGCVKPTIVVLYQDNKDARHVKTYEVALKDKDFVEGPWSQNNLDNGAGLLIPVPAPLGGVIIIGEETIVYCNANSTFRAIPIKQSIIRAYGRVDPDGSRYLLGDNAGILHLLVLTHERERVTGLKIEYLGETSIASSISYLDNGVVYVGSRFGDSQLVKLNLQADPNGSYVEVLERYVNLGPIVDFCVVDLDRQGQGQVVTCSGAFKDGSLRVVRNGIGINEQASVELQGIKGLWSLKSSFNDPYDMYLVVSFISETRFLAMNMEDELEETEIEGFDAQTQTLFCQNAINDLLIQVPFLITASFIFVAFLRQKVVSVTANSVRLVSCTSRELVDQWNAPEGFSVNVASANASQVLLATGGGHLVYLEIKDSKLVEVKHIQLEHEISCVDLNPIGENPQYSSLAAVGMWTDISVRILSLPDLELIRKENLGGEIVPRSVLLCTLEGVSYLLCALGDGHLFSFLLNASTGELTDRKKVSLGTQPISLRTFSSKGTTHVFASSDRPTVIYSSNKKLLYSNVNLKEVNHMCPFNTAAIPDSLAIAKEGELSIGTIDDIQKLHIRTIPLNEQHVAFAIRNVQDTSVLQLQHNQTSIEESETHFVRLLDHQTFEFLSIYQLDQYEHGCSIISCSFSDDNNVYYCVGTAYVLPEENEPSKGRILVFAVEDGRLQLIVEKETKGAVYSLNAFNGKLLAAINQKIQLYKWMLREDGSHELQSECGHHGHILALYTQTRGDFIVVGDLMKSISLLVYKHEESAIEELARDYNANWMSAVEMLDDEIYIGAENNYNIFTVRKNSDAATDEERGRLEVVGEYHLGEFVNRLRHGSLVMRLPDSEMGQIPTVIFGTINGVIGIIASLPHEQYVFLEKLQSTLVKFIKGVGNLSHEQWRSFHNDKKTSEARNFLDGDLIESFLDLSRNKMEEVAKVSLFLLFLNVVPSLRDKAQVEQLLRYIVEEVPEDSEKKRSFKFPFIACEIFTCEIDIILRTLVEDEELMDLLFSFVRPGHPHSTLLAGYFSKVVICLMLRKTSPLMNYVQEHPDIVVHLVDLIGTTSIMEVLIRLIGADETIYSNYADTLQWLENTDVLEMIVDKFSSSKSAYISYTILTKQDSPEVHANAAEILSAVTRCAPPALAAKICSPSFVGRLFRHALQESRPKSVLVHSLSVCISLLDPKRLASASYQAFRSNLSHGTLVTASPETVDGMLESLGVMPVCCWNTPGIFKLFAKLXQMVPNGMHVAGCLLTCFALHRCLLPGCHCWVLNGRGETAEQELINQSAVKRSIDLFFHRPTSLHDRGRDSDDDDFRDRDYDVAALANNLSQAFRYGMYSNDDIEEAQVIERDDEDVYFDDESAEVVISSLRLGDDQDSSSLFTNSNWFTFDGDRGINDRLAASVPSSSPNSEETSLNTEETDEVQIGEDTSIEPQLESVSLENGPVEEAGDLADVSKQTDSNTEDEKLLCTEEEDLSKEAEESERHVDVRDGQVDIQAEDAAEGSCGDMGTGIAVDESVSPSSEPNNASAGASPDTGDIHTAGSTGSNDSGAELHAKEDSQDGQKTDEPTTTE

SEQ ID NO: 30144 - protein, 595 aa, Zea mays
MAGQAGNPVNHPISPHVISGAFVQQYYHILHEQPDQVHKFYQDSSILGRPDSNGIMAYVTTMRDINEKIMSMDFRNCLTEIETADAQLSHKDGVLIVVTGSLTSDEGVFRRFTQSFFLAPQESGGYFVLTDVFRFISERKPAEINQVATQENEISQNVRPASETCSALPEPIPADGSVISDHVTADSNVTEKQISDLSANGTAIESNDNTQPPVQVPKEDPKKALLVAPPPPTQMDVTKKSYASIVKVMKEGPPTPVVKTTSSVSKQKPAPKPVSTAVEGLEKPSEKPTQAIGTGDGIVAQNNSSRNEQGYSIFIKNLPFHANIEMVEEEFKKFGTIKPGGVQVRHNKVDRFGFGFVEYESQQSMQAAIEASPIRMADKEVGIEAKRANSRVIGLLTLYNGVGGRFQSGRGVYHGDNFRGRGSGYVDNTNYRSSGSFNRQNEGEMYNRRNEGEMYNRRNEGDFYNHRNEGEFYNRRNDGGENYNRRNDGGENYNRRNDGGKNFSRRNDSGTENFNRRNDGGGENFSRRNDGVGENFNVRNDGVGENFNRRNNFRNQNDFPGRGRGSPTPGNSYYQNGNGRFSRVNNGAKQAPVAA

SEQ ID NO: 30145 - protein, 207 aa, Rhizobium tropici
PFTWSDLGSWDAVWKVGSRDESGNVSAGATTLVNTKNSLVMSHSLHVAVQGLEDVAVIASEDAVYVGHLKDSQEVGKLVKLLASEKKTAKLTETHPTSYRPWGGYTSVLNGERFQVKRIFVLPGKKLSLQKHHHRSEHWIVVKGTAEVTVGENVQMLRENESIYIPLGEVHRLANPGKILLELIEVQTGSYLGEDDIIRLVDEFGRS

SEQ ID NO: 30146 - protein, 387 aa, Salmonella enterica subsp. enterica serovar Typhi str. CT18
MSVIKMTDLDLAGKRVFIRADLNVPVKEGKVTSDARIRASLPTIELALKQGAKVMVTSHLGRPTEGEYNEEFSLLPVVNYLKDKLSNPVRLVKDYLDGVDVAEGELVVLENVRFNKGEKKDDEALSKKYAALCDVFVMDAFGTAHRAQASTHGIGKFADVACAGPLLAAELDALGKALKEPARPMVAIVGGSKVSTKLTVLDSLSKIADQLIVGGGIANTFVAAQGHSVGKSLYEADLVDEAKRLLTTCDIPVPTDVRVATEFSETAPATLKSVNDVKEDEQILDIGDASAQQLAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 30147 - protein, 313 aa, Fulvimarina pelagi HTCC2506
MAQKVIFDTDPGQDDAVAILTALASPDEIDVLGIVTVAGNIPLDLTTKNALKLLELGGRNEIPVHPGCSKPFGRTLVTAEHVHGKTGLDGPDLPEPKIVAQSQHGVDFLIDTVRAHEPGTIRLLCLGPLTNVALAFAKAPDIPGRLKDIVMMGGGYFEVGNITPTAEFNIYVDPEAASAVFRSGAALTVLPLDVTHRMRSTKERIEAFRAIGNRSGDAVAAMLSFSERFDVEKYNWEGAPLHDPCVTAFVLRPDIFEGRAVNAMIETGSELCRGMTVVDYWGVTDRPKNVVWMRSGDADAFFAFLTERVGRLP

SEQ ID NO: 30148 - protein, 348 aa, Salmonella enterica subsp. enterica serovar Typhi str. CT18
MTVRIAINGFGRIGRNVVRALYESGRRAEITVVAINELADAAGMAHLLKYDTSHGRFAWEVRHEREQLFVGDDVIRILHERTLADLPWRELGVDVVLDCTGVYGNREHGEAHIAAGAKKVLFSHPGSNDLDATVVFGVNQNQLRAEHRIVSNASCTTNCIIPVIKLLDDAYGIESGTVTTIHSAMNDQQVIDAYHSDLRRTRAASQSIIPVDTKLAAGITRIFPQFNDRFEAIAVRVPTINVTAIDLSVTVKKPVKASEVNQLLQKAAQGAFHGIVDYTESPLVSIDFNHDPHSAIVDGTQTRVSGAHLIKTLVWCDNEWGFANRMLDTTLAMAAVGFRLDASASTKL

SEQ ID NO: 30149 - protein, 345 aa, Burkholderia sp. 383
MIATRILRRPRALIVGCGDVGMRCVAQWRDTRRNLRIFALTSHPARRDELRAAGATPIVGDLDRRATLGRLAGLARTILHLAPPQSDGRDDRRTRALIAATTVPARRPPVPPAPAVGRLRTLRTAIRQAGAPIRAARIVPDGLRAPRLVYASTTGVYGDCGGARIDETHPLRPANPRAFRRVSAERQLRAATVRGVLSARIVRIPGIYAANRLPIARLERGTPALEPADDVYTNHIHADDLAVILRRTAERGKPARAVHASDDSELRMGEYFDRVAQVLGLPRPPRVSRADAERQLEPTLLSFMRESRRLSNARLKAELCVTLRYPTVDDFLQTLAPGSASGERR

SEQ ID NO: 30150 - protein, 321 aa, Bacillus cereus ATCC 14579
MKALCFETFGDANVLHYKEIHDPIISPNEILVRTKAIGLNFADIYRRRGDYHLAGNPPYVLGYEGAGIVEKVGADVTTINLGDRIAFADVPFANAELVAVPSEKVIPLPDSISFETAASVLLQGLTAHYLTHDSYQLKQGDIALVHAAAGGVGQLLIQMIKLQGGTVIGLTSSKEKAKIATLAGADHVFLYTEAWHMKVLEMTNGTGVNVVYESVGSTLGESFNATKIGGTVVFYGMAGGNPAPVDPRMLMDTSKTLTGGDLWNVLTTFEERKKRSTQLFDWIATGKLNISNPTTFSLQDGALAHELLESRKSTGKILLIP

SEQ ID NO: 30151 - protein, 510 aa, Silicibacter pomeroyi DSS-3
MKDILSELETRREAARLGGGQKRIDAQHARGKLTARERIELLLDEDSFEEFDMFVSHRCTDFGMEKQRPAGDGVVTGWGTINGRMVYVFSQDFTVFGGSLSETHAQKICKIMDMAVQNGAPVIGINDSGGARIQEGVASLAGYAEVFQRNIMASGVVPQISVIMGPCAGGAVYSPAMTDFIFMVKDTSYMFVTGPDVVKTVTNEVVTAEELGGASTHTRKSSVADGAFENDVEALAEVRRLVDFLPLNNREKPPVRPFFDEPGRIEASLDTLVPENANTPYDMKELINKIADEGDFYEIQEDFAKNIITGFIRLEGQTVGVVANQPMILAGCLDIDSSRKAARFVRFCDCFEIPILTLVDVPGFLPGTSQEYGGVIKHGAKLLFAYGEATVPKVTVITRKAYGGAYDVMASKHLRGDFNYAWPTAEIAVMGAKGATEIIHRADLGDADKIAAHTKDYEGRFANPFVAAERGFIDEVIQPRSTRKRVSRAFASLRGKSLKNPWKKHDNIPL

SEQ ID NO: 30152 - protein, 152 aa, Glycine max
  misc_feature (47)..(47): Xaa can be any naturally occurring amino acid
  misc_feature (58)..(58): Xaa can be any naturally occurring amino acid
  misc_feature (72)..(72): Xaa can be any naturally occurring amino acid
MGRNAAAAAASLRWSTTLLLLLLGLVVGTKATSYRRNAYATMMYVGXRPGDYEFYVAXGVLLKSLSKLNVEXDLVVIGSVDVPLRWIQAFEEEDGAKVVRVENMDYPYKRQDNFDKRFKLSLNKLYAWSLVDYDRVVMLDADHLFLQNTDEL

SEQ ID NO: 30153 - protein, 290 aa, Mesorhizobium sp. BNC1
MMIARKTNKISFQGEPGANSDTASRDMFPHMEPLPCPTFEDAFNAVETGKADLAMIPIENTIAGRVADIHHLLPESRLHIVGEYFLPIHFQLMVLPGTDISQIKAVYSHIHALGQCRKIIRKHRWKPMVAGDTAGAARVVAEEKVVSNAALAPRLAADLYGLQIVAENVEDTDNNVTRFVVLSKEKAWAQRKSPDQRMVTTFIFRVRNVPAALYKALGGFATNGVNMTKLESYQLGGKFFSSLFYADVEGHPEDRSLALALEELRFFSHEVRVLGVYEGHPFRDTQSEDD

SEQ ID NO: 30154 - protein, 219 aa, Mesorhizobium sp. BNC1
MGLRINDTAPDFTAETTHGTIHFHEWIGDGWAVLFSHPKNFTPVCTTELGAMAGLEGEFKKRNAKIIGISVDPVQDHLRWKDDIEKATGFRVDYPLIGDKDLRVAKLYDMLPAEAGDSSEGRTPADNATVRSVYVIGPDKKMKLILTYPMTTGRNFDEILRAIDSIQLTAKHQVATPANWKQGEDVIITAAVSNEDAVKRFGAFDTILPYLRKTKQPTA

SEQ ID NO: 30155 - protein, 277 aa, Mesorhizobium sp. BNC1
MAQQPAFGYGRAGFQEREDMSQQRTTASGGMETAFGYRNVGEGEKQGLVNEVFHRVAERYDLMNDLMSGGLHRLWKAGMVSWLSPPKQPGFKALDVAGGTGDIAFRIVEASGGQAQVTVLDINGSMLAVGRDRAEKRGLAQNLSFVEANAEELPFPSSAFDAYTIAFGIRNVPQIDKALSEACRVLRPGGRFLCLEFSEVDVPLLDKVYEAWSFNAIPRIGQAVAGDGEPYRYLVESIRKFPNQDNFAVMIKRAGFDRVSWRNYSGGIAALHSGWKI

SEQ ID NO: 30156 - protein, 513 aa, Bacillus cereus ATCC 14579
MFKRITIVGLSVVMFLPSIYEGSKAYADTVNNGTLMQYFEWYAPNDGNHWNRLRTDVENLAEKGITSVWIPPAYKGTTQNDVGYGAYDLYDLGEFNQKGTVRTKYGTKAQLKSAIDALHKKNIDVYGDVVMNHKGGADYTETVTAVEVDPSNRNVEVSGDYEISAWTGFNFPGRGDSYSNFKWKWYHFDGTDWDEGRKLNRIYKFRGIGKAWDWEVSSENGNYDYLMYADLDFDHPDVANEMKKWGTWYANELNLDGFRLDAVKHIDHEYLRDWVNHVRQQTGKEMFTVAEYWQNDIQTLNNYLAKVNYNQSVFDAPLHYNFHYASTGNGNYDMRNILKGTVVANHPTLAVTLVENHDSQPGQSLESVVSPWFKPLAYAFILTRAEGYPSVFYGDYYGTKGNSNYEIPALKDKIDPILTARKNFAYGTQRDYFDHPDVIGWTREGDSVHANSGLATLISDGPGGAKWMDVGKNNAGEVWYDITGNQTNTVTINKDGWGQFQVSGGSVSIYVQQ

SEQ ID NO: 30157 - protein, 493 aa, Arabidopsis thaliana
MGETAAANNHRHHHHHGHQVFDVASHDFVPPQPAFKCFDDDGRLKRTGTVWTASAHIITAVIGSGVLSLAWAIAQLGWIAGPAVMLLFSLVTLYSSTLLSDCYRTGDAVSGKRNYTYMDAVRSILGGFKFKICGLIQYLNLFGIAIGYTIAASISMMAIKRSNCFHKSGGKDPCHMSSNPYMIVFGVAEILLSQVPDFDQIWWISIVAAVMSFTYSAIGLALGIVQVAANGVFKGSLTGISIGTVTQTQKIWRTFQALGDIAFAYSYSVVLIEIQDTVRSPPAESKTMKKATKISIAVTTIFYMLCGSMGYAAFGDAAPGNLLTGFGFYNPFWLLDIANAAIVVHLVGAYQVFAQPIFAFIEKSVAERYPDNDFLSKEFEIRIPGFKSPYKVNVFRMVYRSGFVVTTTVISMLMPFFNDVVGILGALGFWPLTVYFPVEMYIKQRKVEKWSTRWVCLQMLSVACLVISVVAGVGSIAGVMLDLKVYKPFKSTY

SEQ ID NO: 30158 - protein, 699 aa, Ostreococcus tauri
MALNARRPSRDHERTPNKFLPWLSNTPTLDGTLEKRQETEGWWASLFGGGTEQWGLRYFLLYDTHLFWGKGFSTMHGYGTVLSVREVPELGPTSFAVEMMAVPKRNLRRSFNDNVNFLDLISGLCCKPAGFRVMYLRATSPKEMQRWMEGFCRGTSDTPVSTRMPLDFSEEIPPSPRISTDSELSIDTFSGTGTRTRYEEPPPPLSPGGASREFLNTSPETEDVPLFRLDANGESGEFNHSTQQKSPVRTRSVLKSNSMLRNHEQRQSVDGNCSKSVTFDDHVESVVIARSPVKQQGIVPAQETDREFRTRTRLLKAAGSFKISESELQIGAKLGIGSFGVVYRAKWNDTDVAYKVMLQDKMNYETVNAFAEEIRMMRGLRHPNIVLFIGAVIQPNRLGIVSELMKRGNLEFLLHGNSTMGRQLRENGMLRRQMAADCARGMLYLHSLSRPVVHHDLKPANLVVDSNWTLKVSDFGMAQLKSYTYDSVSGAPGGTPEWMSPEALRGDKANERSDVYSFGVILWELMTVSFPWAELSSPVQIVAQVAFLHRRLKVPEWIEKPMADLLHSCWAREPEERPTFEKIVEQLAGEYPQAWSLGQVDKSADEQAANILAMMSTGKGAKNSAFAPRGLKPIRTPTPVTDVPKQTDTLDTEEDSSEDLSKRHGHDYRQRVPPETSPLKTPRAELPSALPTLSNGARD

SEQ ID NO: 30159 - protein, 197 aa, Borrelia burgdorferi B31
MEFMHNLIPTVIENTGNYERVFDIYSRLLRERIIFLSGEINDPKADTVIAQLLFLESEDSSKDIYLYLNSPGGSITAGLAIYDTMQYIKPDVRTICIGQAASMGAFLLAGGAKGKRESLTYSRIMIHQPWGGISGQASDINIQANEILRLKKLIIDIMSNQIGVDKEKLALDMERDYFMTSSDALKYGLIDSILVRE

SEQ ID NO: 30160 - protein, 387 aa, Pseudomonas fluorescens Pf-5
MTVLKMTDLDLQGKRVLIREDLNVPVKDGVVTSDARILASLPTIKLALEKGAAVMVCSHLGRPTEGEFSAENSLKPVADYLSRALGREVPLVADYLGGVEVKAGDIVLFENVRFNKGEKKNADELAQQYAALCDVFVMDAFGTAHRAEGSTHGVAKFAKVAAAGPLLAAELDALGKALGNPAKPMAAIVAGSKVSTKLDVLNSLSQICDQLIVGGGIANTFLAAAGHPVGKSLYEPDLLDTARAIAAKVSVPLPVDVVVAKEFAESAAATVKLIADVADDDMILDIGPQTAAQFAELLKSSRTILWNGPVGVFEFDQFGNGTKVLAQAIADSAAFSIAGGGDTLAAIDKYGVAQQISYISTGGGAFLEFVEGKVLPAVEVLEARAKA

SEQ ID NO: 30161 - protein, 307 aa, Zea mays
MAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNLADHMIGNVYVQFREEEQAAAAYNALQGRFYSGRPIIVEYSPVTDFREATCRQFEENSCNRGGYCNFMHVKQIGRDLRRKLYGRSASRRYHGRSRSRSPPPQRRGHRDRDDYHHRDRDDYRGGGGGGRGRGSRYDRYDDGAGRGGRHGRYDDGAGRGGRHDRYDDGGRRRHGSPSRRARSPVRESSEERRAKIEQWNREREGKQ

SEQ ID NO: 30162 - protein, 204 aa, Kineococcus radiotolerans SRS30216
MSRPRPAGPLSALRRDLEHMVGPEGRSTAQWLPEVAARVALVPRVRAVVLLRLAQQVAPRAVPLAHALQARALRGSGAEISPFATIGEGLCVMHSAGIVVGPDVVVGRGLRIYQNVTLGDGSRPGQPRIGDDVTIGAGACVLGGVTVGDRAVIGANAVVTRDVPADSVATGAPATSRPRRPGSDPRLDELAARAAAGTATAPAV

SEQ ID NO: 30163 - protein, 498 aa, Picea sitchensis
MGQSNSSLSPPPMGLFLENSEVERFDVYPEQDLIVYLPDECLASIFQKLTNEDRNACSLVCSRWHRIESKSRQRLVLMARTELSSLLPALFMRFEHVTVLSLKCSRKFPSIDNKALSLIGKSFTHLKKIKLKGCIEITDEGLESFSLVCGPIKKFSCGSCGFGGKGLNSILKNCNELEDLTAKRLRRLDGQTERIGPGKGKLQRLCLKDIYNGQLFAPLLSGSKCLRTLILSRNSGYWDQMLESSTENLQQLTELQIESMHLGDRGLMAVSKCSKLEVFYMSRVSDCTDRGIYAVANGCRRLRKVHLDSGKSKRIGEQGLLSIATKCPQLQELVLMGIATSVVSLNALASHCPVLERMALCNSDSVGDLEMSCISAKFIALKKLCIKNCPISDDGLVTIAGGCPSLIKLKVKRCKGVTSKSVCQVQTKRGSLIVAVDGGSQTAGEDDQGRSLQLGDDRVIRESTHVLCGSRGHLIKTKLGTAASNLLRGSSSGGHSHV

SEQ ID NO: 30164 - protein, 381 aa, Vitis vinifera
MAMKHRKLFPTQTATNQSVDCLDFCDSTCPYNCYIYPDSLIPPPPPASPRPPTLSTLDQNDSPNISPYVIITVALLAGFFLLVCFNAIIVKYCCGWRRRNRSPPSESDGRDEEFLDENRGPAIDHPIWFITTAGLQQAIINSITVCKYKRGEGLIEGTECSVCLSEFQEDETLRLLPKCNHAFHIPCIDTWLSSHTNCPLCRARIISDIVNPPLESNDQNSRSLGPNEQTQMENSRGTGELQILDDERTSKEGVNSNGDVVLEVNGNSANNHVVDSEIQPVRRSVSMDSSSAATIFFGLAKFHADESKGNWVDETMDGRKFDSGSVPKRDVAYTSTFRQMGSPSIAQCLHKGPISMKRSNSCGGRFFLPRHNRSTNAILPL

SEQ ID NO: 30165 - protein, 576 aa, Thiomicrospira crunogena XCL-2
MRTALHCLALLISFFFVSSSFATPLNSTSQAAVAMPDSYSAEVARKVLLSGGNAVDASVAAAFVLAVTYPEAGNLGGGGFMTLYTDGAASSQKQAYFLDYREKAPKAAFRDMYLNAKKAVIPYKSLVGYQASGVPGTVMGLWAAHQRFGKLPWASLVQPAIVLAEKGFVVPKDLEKVARWYQKWIANKSTVPLNFKRYFGELKTGRLFKQPELAATLKRIAQTGPYDFYFGQTAQLIVKEMQSQDGLITLDDLAHYEVKWRQPVQADWKGHQVISAPPPSSGGVAIVQLLKMKAILENQYQDALLSMDKAGVPPQATRAHFYAELSKRVYADRAQYLGDPDFIKVPTEKLISNAYLRKRAADVLMDEISETQTIKPGLAESTDTTHFSVVDAQGNAVSNTYTLNMPFGSGVVVSKAGFLMNDEMDDFSTKPGVANVFGVVGGKANEIAPEKRMLSSMSPTILVKNGAVEMVVGTPGGSSIITSVFQTIVNVIDRHLSPQRAVDAPRVHHQLLPKDVIMYHPDLSTETKQALRLMGYQLKRNNYLGDVQLIVRQHGKLQAASDVRGRGVSKVFSVQP

SEQ ID NO: 30166 - protein, 384 aa, Oryza sativa Indica Group
MARLILIPLLTVTDFSSSHLSHMATVWVFVLSLIGLVPLAERLSFLTEQIAFYTGPTVGGLLNATFGNVTEVIIALLALREGKIEVVKCSLLGSILSNLLLVLGTSLFLAGIANLRAHQPYDTKQAHVNTALLMLAVLCHSLPLMLRYAVTSGDHAIVSGDAALHLSRACSILMLIAYLAYLFFQLNTHRQLFEPQQVEDDDDDDLVIAQDDEPVLGFSSAMIWLALMTLLTALLSGYVVSTIEAASESWELSVSFISIILLPIVGNAAEHAGAVIFALKNKMDITLGVSLGSATQISMFVVPVSVIVAWTMGIPMDLDFNLLETGSLFLAILVTAFTLQEGESHYLKGLILVLCYAVISVCFFVIRRRSAGGTDGVHHLDVIV

SEQ ID NO: 30167 - protein, 582 aa, Bacillus subtilis subsp. subtilis str. 168
MGYYLTWLTISRKKEICLNNIKKTKEGHLETTLRGKEVLSIPTLNKGVAFSLEERQELGLEGLLPPTVLSLDQQAQRAYEQFQAQPDRLRQNVYLSDLANRNEVLFYKLLKNHLREMLPVVYTPTVGEAIQEYSHEYRRPQGIYLSIDNIDGIEKAFENLHATAGDIDLIVATDSESILGIGDWGVGGINIAIGKLAVYTAAAGIDPSRVIPVVLDVGTNNEKLLNDPLYIGNKHERVQGERYEAFIDAYVKAALKFFPKALLHWEDLGNKNARNIMKKYNHEILTFNDDIQGTGAITLAGVLAAMKKTGASIKDQRVVIFGAGSAGIGIADQIRDTMVLAGLSEEEANKRFYTLDYRGLLTEDIEGILDFQKPYLRNADEVKDWKRDEKGQIPFDEVVRQAKPTILIGTSGVSGAFTEEIVKEMASHVDRPVIMPMSNPTHLAEAVPEDLFKWTDGKVLIATGSPFDNVEYNGVSYEIGQSNNAFAFPGLGLGSIVAEARIITPAMFAATADAIAEMVDLETPGAGLLPSIDKLQEVSIQVAIAVAEAAIKDGVANRQPEDVKQAVLDAMWTPEYKKVIAK

SEQ ID NO: 30168 - protein, 449 aa, Thermotoga sp. RQ2
MYDAVIIGGGPGGYVCAIKLVQLGKKVALVEKDALGGTCTNRGCIPTKAMLTVSHLMDEMKEKASKYGLKVSGVEYDVDTIMKHVQKSVMMSRKGIEYLLNKNGVEVFKGTAVVENKNTVVVQETGEKLEAKNLVLAHGSVPSVFSPFDIDGVWTSDDVFNLKEFPKSLVIIGGGVIGVEFATFFGSFGVDVTIVEIAEHILPYEDSDVAEEVKKALKRKGVKILEKTKVSSLNRVSDGFEVALENGETLKAEKVLLAAGRKPNIPEDVKALGVKIEKGVVTDSRMRTNVENVYAIGDIRSGIMLAHVAMYEGIVAAKNIAGEEEEMDYSAVPSIIFSSPEVASVGVREKDVNSEEVVISKFPVSANGRARTMLENIGFAKVIADKKDRTVLGMSIVSPSATDMIMEGVIAVKFRMKAEDLEKAIHPHPTLTETILGALEGVSGKPIHL

SEQ ID NO: 30169 - protein, 350 aa, Arabidopsis thaliana
MSFSATSSIALGGGSAEASAAKNTSKRPKYSRFTQQELPACKPILTPKWVILTFLVSGVVFIPLGVICLFASQGVIEIVDRYDTDCIPLSSRDNKVRYIQGLEDKRCNRTITVTKTMKNPVYVYYQLENYYQNHRRYVKSRQDGQLRSPKDEHETKSCAPEDTLGGQPIVPCGLVAWSLFNDTYDFTRNNQKLPVNKKDISWKSDRESKFGKNVFPKNFQKGSLIGGKSLDQDIPLSEQEDLIVWMRTAALPTFRKLYGKIDTDLQAGDTIKVLLQNNYNTYSFNGKKKLVLSTTSWLGGRNDFLGIAYLTVGSICLFLAVSFSVLYLAKPRQLGDPSYLSWNRSAGGGR

SEQ ID NO: 30170 - protein, 202 aa, Triticum aestivum
  misc_feature (21)..(21): Xaa can be any naturally occurring amino acid
  misc_feature (30)..(30): Xaa can be any naturally occurring amino acid
RMECSIRAIRTFPKSGIRVMXIPDMLFDSXALRAFSDLFVELFERNDITVVAVVEARGFSCGPPVALATGAKFVPIRTLRKLPGEVISEVYSVEYGADNIDMLVGPVQPNDRVLRVDDVDATGGTLCAAGNLIERVGAKVAECAGVIDLPELTDRDKLGDMAVISVVQADESVGTKLCLLSCSNDVYLVDLYWKQQRYPLQS

SEQ ID NO: 30171 - protein, 337 aa, Bacillus cereus ATCC 14579
MPDEKDKHEGTWLQWPHEYTYGEEYKKEVEPIWVKMASALTEGEKVHIVAYDQEEKERINNLLTDEGLNMEKIDFFIAPTDDVWARDSGPIFVYDSNKNLKILDPAFNGWGKKTPYKNDAQIRKNVSKQSGIERVDWGKFVLEGGAIELDSNGTALLTRSAVTNKNRNPDLSEKEIEKYISDLGVSNFIWLDGVPNLDITDFHIDGFAKFHNKSTIVTMKEDDLAEWGLSNKDMDTLLDAKNASGQKYKYEYLPLSKEKVALENGKTLDYKGSYINYYIGNTVVLVPNYNDPNDKIANDTIQKLYPDRKVVGIDVRELYKNGGMIHCVTQQQPIALK

SEQ ID NO: 30172 - protein, 316 aa, Fusarium oxysporum
MAEQLILKGTLEGHNGWVTSLATSMENPNMLLSASRDKTLIIWNLTRDETQYGYPKRSLHGHSHIVSDCVISSDGAYALSASWDKTLRLWELASGTTTRRFVGHTNDVLSVSFSADNRQIVSGSRDRTIKLWNTLGDCKYTITEKGHTEWASCVRFSPNPQNPVIVSAGWDKLVKVWELSTCKLQTDHIGHTGYINTVTISPDGSLCASGGKDGTTMLWDLNESKHLYSLNANDEIHALVFSPNRYWLCAATASSIIIFDLEKKSKVDELKPEFPAVGKKSREPECVSLAWSADGQTLFAGYTDNIIRAWGVMSRA

SEQ ID NO: 30173 - protein, 723 aa, Thermotoga sp. SG1
MWLLFLVPLVALGFAAANFAAVVKKPEGTDRMKEISSYIRSGADSFLAHETRAIFKVAIVIAILLMIFTTWQTGVAFLLGAVMSASAGIVGMKMATRANVRVAEAARTTKKIGPALKVAYQGGSVMGLSVGGFALLGLVLVYLIFGKWMGQLDNLNIYTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQKIGENLVHQIPKETIQSLITYPIFFALVGLGCSMLGILYVIVKKPSDNPQRELNISLWTSAILTVVLTAFLTYFYLKDAQGLDVVGFRFGPISPWFSAIIGIFAGILVGFWAEYYTSYHYRPTQFLSRSSIEGTGMVISNGLSLGMKSVLPPTLTLVLGILFADYFAGLYGVAISALGMLSFVATSVSVDSYGPIADNAGGISEMCELDPEVRKITDHLDAVGNTTAAIGKGFAIGSAILAALSLFASYMFSQISPSDVGKPPSLILLLNMVDARVIAGALLGAAITYYFSGYLISAVTKAAMKMVDEIRRQAREIPGLLEGKAKPDYNKCIEITSDNALKQMGYPAFIAILTPLVTGFLLGPEFVGGVLIGTVISGAMLAILTANSGGAWDNAKKFLEAGNLEGYGKGSEPHKALVIGDTVGDPLKDTVGPSLDILIKIMSVVSVIAVSIFKHIHLF

SEQ ID NO: 30174 - protein, 395 aa, Robiginitalea biformata HTCC2501
MKQFLSDRINNMATSATLAMAAKARELRQEGKDIIGLSLGEPDFNIPEFIREAAKEAIDQNYSSYSPVDGYGDLKQAISRKFARDNGLQYGIDQIVVSTGAKQSLANVAMVMLNEGDEVILPAPYWVSYSDIVKLAGGVPVEVPTSIDTDFKMTPDQLREAITPRTKMIWYSSPCNPSGSVYSKPELEGLAAVLREHPGIFVVSDEIYEHINFREGHVSMAGLEGMYDRTITVNGVSKAYAMTGWRIGFIGAPAWVAKACTKFQGQITSGANAIAQRATIAALDAPIEKIRYMIDKFHERRDLILELLGEIPGFNLNVPEGAFYVFPDISSYFGKTLGGKTIANASDFALYLLEAAGVATVTGEAFGNPNCIRISYAASEEEIREAVRRMQEALA

SEQ ID NO: 30175 - protein, 359 aa, Pseudomonas fluorescens Pf-5
MPQPRPYKVALNGYGRIGRCVLRALFERGAAAGFEIVAINDLADMASVEYLTRFDSTHGRFPGEVKVDGDCLHINGNCVKVLRSATPEGIDWASLGVDLVLECSGAYHTREDGQRFLDAGAPRVLFSQPMASEADVDATIVYGVNQDCLSGDERLVSNASCTTNCGVPLLRLLDQAIGLEYVSITTIHSAMNDQPVIDAYHHEDLRRTRSAFQSVIPVSTGLARGIERLLPELAGRIQAKAVRVPTVNVSCLDITMQTVSDTDATEVNRILREAATSGPLKGLLAYTELPHASCDFNHDPHSAIVDASQTRVSGPRLVNILAWFDNEWGFANRMLDVAGHYLHTAAPRTDTQLSVSEEQ

SEQ ID NO: 30176 - protein, 355 aa, Fusarium oxysporum
MGACMSSSNEEADQKKKSQAIDKILEEDSKRLRKECKILLLGSGESGKSTIVKQMKIIHLKGYSEDELFNYRPTVFKNLVECAKAVIMAMQQFDIEPQNEENKAHAEFLLEYQAESGPQAQIDPKVGAAVQALWNDPAKDLLMEHQTEFYLMDSAEYFFQEAMRIVSSDYLPNEMDVLRARTKTTGIYETRFQMGQLSIHMFDVGGQRSERKKWIHCFENVTSIIFCVALSEYDQVLLEESSQNRMMESLLLFDSVVNSRWFMRTSIILFLNKVDIFKQKLSRSPLGNYFPDYSGGNDVNKAAKYLLWRFNQVNRAHLNLYPHLTQATDTSNIRLVFAAVKETILNNALKDSGIL

SEQ ID NO: 30177 - protein, 328 aa, Picea sitchensis
MAAMAISSSSATVRIGCKKSAFVSNASSSVRSEFAGLRRMDSMFDMGSSHCLFAQMQRNVQAVGNGCRGVVTMAGTGKFFVGGNWKCNGTKDSISKLVTELNSAKLEDDVDIVVAPPFVYIDQVKSSLTDRIEISAQNAWVGKGGAFTGEISVEQLKDIGCKWVIHGHSERRHVIGEDSQFIGKKSAYALTQGLKVIACIGEKLEEREAGKTFDVCYEQLKAFADNMPSWDDVVIAYEPVWAIGTGKVASPQQAQEVHVAVREWLSKNVSAEVASQTRIIYGGSVNGGNSAELAKQEDIDGFLVGGASLKGPEFASICNSVTAKKVAA

SEQ ID NO: 30178 - protein, 242 aa, Robiginitalea biformata HTCC2501
MAKEILPYDDSGESKKQQVRNMFDTISDKYDGLNRVISLGIDRRWRKRLVGLVVDKNPGSVLDIATGTGDLALSLAQAGVKEVVGLDLAPGMLEVGRRKVRDSGLDGQIEMVLGDSEALEFPDNRFDAVTVAFGVRNFEDLEKGLTEIYRVLRPGGTLAVLETSVPEKQPFRWGYNIYCRHFLPRVGRWFSKDPSAYSYLSRSAAAFPHGERFNNILGKIGFIAMEHRPQTFGAAAIYTATK

SEQ ID NO: 30179 - protein, 312 aa, Saccharomyces cerevisiae
MPATLHDSTKILSLNTGAQIPQIGLGTWQSKENDAYKAVLTALKDGYRHIDTAAIYRNEDQVGQAIKDSGVPREEIFVTTKLWCTQHHEPEVALDQSLKRLGLDYVDLYLMHWPARLDPAYIKNEDILSVPTKKDGSRAVDITNWNFIKTWELMQELPKTGKTKAVGVSNFSINNLKDLLASQGNKLTPAANQVEIHPLLPQDELINFCKSKGIVVEAYSPLGSTDAPLLKEPVILEIAKKNNVQPGHVVISWHVQRGYVVLPKSVNPDRIKTNRKIFTLSTEDFEAINNISKEKGEKRVVHPNWSPFEVFK

SEQ ID NO: 30180 - protein, 445 aa, Chlorobium tepidum TLS
MKITIFGSGYVGLVTGACFAEVGNEVMCVDIDENKINRLLNGEIPIYEPGLDTIVSENLREGRLKFTTSITDGVDFGLYQFIAVGTPPDEDGSADLSHVLSVAESIGRNMEDYRIVINKSTVPVGTADLVRETIRTVLEERGRAIDFDVVSNPEFLKEGDAVDDFMKPDRIIVGVDNPRTKELLRNLYAPFNRSHERFIAMDIRSAELTKYAANAMLATKISFMNEIANIAERAGADVEAVRRGIGSDSRIGFSFIYPGVGYGGSCFPKDVRALERTSRKLGYNSRILQAVEAVNDDQKLSLVSKIRDHFDGDLKGRVIAMWGLAFKPNTDDMREAPSRKVMEELWKAGAIVRAYDPVAMDEARRIYGDRPDLVLVEHPDEALKGADALTIMTEWMVFRSPDFELIRNSLKEPVIFDGRNIYNPDMVEQVGISYYSIGRRPRLVR

SEQ ID NO: 30181 - protein, 487 aa, Staphylococcus aureus subsp. aureus Mu50
MGEFKGFMKYDKQYLGELSLVDRLKHHKAYQQRFTKEDASIQGARCMDCGTPFCQTGQQYGRETIGCPIGNYIPEWNDLVYHQDFKTAYERLSETNNFPDFTGRVCPAPCESACVMKINRESIAIKGIERTIIDEAFENGWVAPKVPSRRRDEKVAIVGSGPAGLTAAEELNLLGYQVTIYERARESGGLLMYGIPNMKLDKDVVRRRIKLMEEAGITFINGVEVGVDIDKATLESEYDAIILCTGAQKGRDLPLEGRMGDGIHFAMDYLTEQTQLLNGEIDDITITAKDKNVIIIGAGDTGADCVATALRENCKSIVQFNKYTKLPEAITFTENASWPLAMPVFKMDYAHQEYEAKFGKEPRAYGVQTMRYDVDDKGHIRGLYTQILEQGENGMVMKEGPERFWPADLVLLSIGFEGTEPTVPNAFNIKTDRNRIVADDTNYQTNNEKVFAAGDARRGQSLVVWAIKEGRGVAKAVDQYLASKVCV

SEQ ID NO: 30182 - protein, 422 aa, Polaromonas sp. JS666
MPFSSLGFSPALLPAFLRAIGDKGYRAPTAIQSQAIPAILLGRDVVGSAQTGSGKTAAFALPMLQQLANAPTGTPRPTRGLILVPTRELAAQVGEAIAGFAKYLPQRVKVAVVFGGVSINPQMMNLRGGADIVVATPGRLLDLLEHNALKISEVSTLVLDEADRLLDLGFGEELGRILELLPPRRQNLFFSATFPPAIEVLAESMLHDPLRIEVQAVPETKPDIAQRAIQVDASRRTQLLRHLVQTEKWERALVFVATKHAAEIVADKLRKVHIEAEPFHGELSQGKRTQVLQDFRIKAVQVVVATDVAARGIDIAQMPVVVNYDLPRSAVDYTHRIGRTGRAGESGLAVSFVSAGTEAHFKLIEKRQGIKVQREQVEGFEPLETLAPNAADPASTGGIKGKRPSKKDKLREAAARAQTQDK

SEQ ID NO: 30183 - protein, 526 aa, Arabidopsis thaliana
  misc_feature (449)..(449): Xaa can be any naturally occurring amino acid
MDEEATSWIRRAKFSQTVSYRLNSSKLASLPFMINQDKFSGLKAIPQRSSSSSSASSSDPKLVSSNSQTTGDTSSLEAADVYVVDSEIQTNPVTHKQRSVSPSPQMAVPDVFKEARSERKRFSTPHPRRVESEKGMKPKLSHKNSFDKRSFNLRSPSGPIRDLGTLRIQERVKSKKDTGWSKLFDNTGRRVSAVEASEEFRVDMSKLFFGLKFAHGLYSRLYHGKYEDKAVAVKLITVPDDDDNGCLGARLEKQFTKEVTLLSRLTHPNVIKFVGAYKDPPVYCVLTQYLPEGSLRSFLHKPENRSLPLKKLIEFAIDIARGMEYIHSRRIIHRDLKPENVLIDEEFHLKIADFGIACEEEYCDMLADDPGTYRWMAPEMIKRKPHGRKADVYSFGLVLWEMVAGAIPYEDMNPIQAAFAVVHKNIRPAIPGDCPVAMKALIEQCWSVXAPDKRPEFWQIVKVLEQFAISLEREGNLNLSSSKICKDPRKGLKHWIQKLGPVHAGGGGGSSSSGLGGSALPKPKFA

SEQ ID NO: 30184 - protein, 417 aa, Gibberella zeae PH-1
MASLGAPSKKHKVTIVGSGNWGSTIAKIVAENTRAHKELFEEDVQMWVYEENVTIPKESKLYDEANGDAPQKLTEVINKHHENVKYLPGIPLPTNLIANPDIRDAVKDSSILVFNLPHQFIANVCKQINGHILPFARGISCIKGVNVTDTDISLFSEWIGDGLGIYCGALSGANLAREIAEEKWSETTIAYDPPALDNSRAPTPRSGSPNPTMGELPEAHHKDVRGRTSKTKLTAMPAEYPPLDQHCFRTLFHRPYFHVQMVSDVAGVSLSGALKNVVALAAGFVDGRGWGDNAKAAIMRVGLMEMVKFGKEFFGETVHTATFTESSAGVADLITSCSGGRNFRCAKMAVQKGISVQEVEKQELNGQKIQGTTTAEEVNSFLKARGLESEYPLFTAVNAILNGEAQVDDIPTLIQDS

SEQ ID NO: 30185 - protein, 483 aa, Magnetococcus sp. MC-1
MKSIRRTKIIATLGPNASSRDFIKHLALTGVDTFRLNFSHGSHEDHRRRHGWIRSVEEELGRPLGIMMDLQGPKLRIGTFENSEVELVRGQKFALYKEERTGDINGVTLPHNELFQVMRPGLELLLNDGRINLRVMEVEDFGVCCEVRVGGILSDRKGLNVPAAMLPVKALTDKDLEDLEFGLELGIDWCALSFVQRPEDLREARKLIHGRAALLAKIEKPQAVDNLEEIVKVADGVMVARGDLGVEYTPERVPAVQKRLIRMCREQCKPVIVATQMLESMIDAPIPTRAEASDVANAIYDGADAVMLSAETAVGSYACNAVSVMDRIARVTEADPDCLQRNLHTPLTFDNSDNDAISKAARDVAMSRGCQAIVAFTKTGSTALRVSRTRASVPILGLTPDIRVARRLTMVWGVHSVNTSDVSNFAEMVGKATRICRREELANTDDRIVVIAGVPFGQEGTTNILRIARIGEAERPLDDGPLD

SEQ ID NO: 30186 - protein, 387 aa, Vitis vinifera
MEKKNSSETAGKAITCKAAICKEPGEALVIEEIEVAPPEAWEIRIKILCTSLCHTDVTFWKMNDGPERSFPKILGHEAVGVVESVGEHVEEVKEGDLVVPVFLPSCKECRDCTSTKSNLCTKFGSKFYQGMPRDGSSRFRNMKGEVVHHFLFVSSFVEYTVVDIAHVVRLNHEIPADKACLLSCGVSTGIGAAWKVAEVEEGSTVAIFGLGAVGLAVAEGARLRGASKIIGVDLNPEKFEIGKKFGVTHFINPTACGEKAVSQVVKEMTDGGADYCFECIGLASLMKDAFDCSREGWGKTVILGVEMHGSDLNVNSSQILRGRSVMGSLFGGLKPKSDIPILAKKYIDKELRLDEFITHEVNFQDINKAFEFQSQGKSIRCIIWMDK

SEQ ID NO: 30187 - protein, 170 aa, Oryza sativa Indica Group
MADLSFCSLFISFLQLGSSTLHCTLGVLSSHLLFSQISEILSRFERKGFKLVAIKLVVPSKEFAQKHYHDLKDRPFFNGLCDFLSSGPVLAMVWEGEGVIKYGRKLIGATDPQKSEPGTIRGDLAVVVGRNIIHGSDGPETAKAEIGLWFEPRELVSYTSNEEKWIYGVN

SEQ ID NO: 30188 - protein, 308 aa, Nicotiana suaveolens
MELLNTEQRAATMEKIKDACENWGFFEVVNHGICHELLDTVEKLTKGHYKKCMEQRFKEMVASKGLEAVETEIKDLDWESTFFLKHLPISNISEVPDLEDEYRKIMKEFAEKLEKLAEQLLDLLCENLGLEQGYIKKAFYGSNGPTFGTKVSNYPPCPKPDLIKGLRAHTDAGGIILLFQDDKVSGLQLLKDDKWIDVPPMRHSIVINLGDQLEVITNGKYKSVEHRVIAQPDGNRMSLASFYNPGSDAVIYPAPELLEKENKVIYPKFVFEDYMKLYAGLKFQAKEPRFEAMKAVENTVNAAPIATV

SEQ ID NO: 30189 - protein, 156 aa, Glycine max
MVLSKTASETDVSVHSTFASRYVRTSLPRFKMAEESIPKEAAYQIIHDELMLDGNPRLNLASFVTTWMEPECDKLIMAAINKNYVDMDEYPVTTELQNRCVNMIAHLFNAPLEESETAVGVGTVGSSEAIMLAGLAFKRRWQNRRKLEGKPYDNPN

SEQ ID NO: 30190 - protein, 434 aa, Oryza sativa Japonica Group
MEAQWLAEYPHQGADKRPRKRPRLAWDVAPPLFQPPKAIPMLYCGQELINGNFATAFLPPPPIYYTGPPRNLSPPWRPDDKDGHYVFAVGENLTPRYRILSKMGEGTFGQVLECWDLEHQETVAIKIVRSLQKYREAAMIEIDVLQRLGKHDFTGSRCVQIRNWFDYRNHICIVFERLGPSLYDFLRKNSYRAFPIDLVREFARQILESVAFMHDLRLIHTDLKPENILLVSSESIRVPDYKVTIRPPKDGSFFKNLPKSSAIKLIDFGSTTFEHQDHNYVVSTRHYRAPEVILGLGWNYSCDLWSVGCILVELCSGEALFQTHENLEHLAMMERVLGPLPKHMIVRADRRAEKYFRRGLRLDWPEGAASRESLKAVWKLPRLQNLVMQHVDHSAGDLIDLLQGLLRYDPDARLKAREALQHPFFTRCHRRCGY

SEQ ID NO: 30191 - protein, 426 aa, Bacteroides thetaiotaomicron VPI-5482
MKIEKIVAREILDSRGNPTVEVDVVLESGIMGRASVPSGASTGEHEALELRDGDKQRYGGKGVQKAVDNVNKIIAPKLIGMSSLNQRGIDYAMLALDGTKTKSNLGANAILGVSLAVAKAAASYLDLPLYRYIGGTNTYVMPVPMMNIINGGSHSDAPIAFQEFMIRPVGAPSFREGLRMGAEVFHALKKVLKDRGLSTAVGDEGGFAPNLEGTEDALNSIIAAIKAAGYEPGKDVMIGMDCASSEFYHDGIYDYTKFEGAKGKKRTAEEQIDYLEELINKFPIDSIEDGMSENDWEGWKKLTERIGDRCQLVGDDLFVTNVDFLAMGIEKGCANSILIKVNQIGSLTETLNAIEMAHRHGYTTVTSHRSGETEDATIADIAVATNSGQIKTGSLSRSDRMAKYNQLLRIEEELGDLAVYGYKRIK

SEQ ID NO: 30192 - protein, 230 aa, Psychrobacter arcticus 273-4
MSYQFITSAKLPTRHGEFDIHIFENDEGQEHVMLTVGLPVVDQTDTTDSLPSPDTILNQEDNALSERPIPLIRIHSECLTGDAFSSLKCDCGPQLNTAMHAIQETGCGAILYLRQEGRGIGLTNKIRAYALQDQGHDTLDANLMLGLPADARIYDMCGPMLAHIGVDAVRLITNNPSKVAYLTEHGIDVIERVPLVVGVNDMNAEYLATKRDRMGHLLDTDFNTTLHLNK

SEQ ID NO: 30193 - protein, 680 aa, Psychrobacter arcticus 273-4
MQQSPHSLQSQSLFASAVDSAVPLSNLQQTYAVIPRERPYTPLLDRVDSPADLKAFSTADLIALADELRLFVLYSAGQSGGHFGANLGVIELTIALHYLLDAPQDQIVWDVGHQAYAHKVLTGRRDRLGTIRSKAGLTAFPERAESVYDTFGVGHSSTSISAGLGMSLALRYQGRAQTVACIIGDGAMTGGMAFEAMNDAVQQDADLMVILNDNDMSISCSIGGFSRHLAMLWESGYQVDISDAGEPILCRRPDMQAFDRRKRHKKQRDVPQLEDNLFKAIGFTYFGPFDGHNIPELLRVLSLAKQVKGPVLVHIYTTKGKGFAPAELDPVGYHAIGSLPAEDDAPKIEKAAAKPSLKYSQVFGQFLCDKAVQDNKLLAITPAMEEGSGMIEFARQFPERFFDVAIAEQHAVTLAGGMATQGVKPIVAIYSTFLQRGYDQLIHDVALQNLDVMFAIDRAGLVGEDGATHAGVFDFAFLRCVPNMMIAAPKDENECYHLLNTCYEYQGCTAVRYPRGVGTGATITQPAQTYNIGKAVIESVLGEKDAPKKLALLAFGTMVATAQQAAEMIAKSPLLASSCQLHVVNMRWVKPLDTTLLEQLLLQGVTHIATLEEHTIMGGAGSAVNEYLLNDSAAFKNHRPAICNIGIPDRFVAHGSQSEQWADCGLDVEGVVNQLQQLLS

SEQ ID NO: 30194 - protein, 275 aa, Psychrobacter arcticus 273-4
MEPMVVIAARAAEKVGKEILYAHQNRHKIELDIESKGLDGLVTRIDRFSEELTIETLKSSYPTHSYLGEEFGMQEGRGEDADWCWIIDPLDGTKNFVHGVPQFCVSIAVQHKGVTQHGVIYDPVRDEMFSASRGKGARLNQRRISVSERKTIDGGLFTTGHPLERKRNGEIISYAKEHYESLQKITEAGGQIRRLGSAALDLCYVAAGRFDGYFEMSIKPWDIAAGELIVTEARGVVVDHTGAHNSMTSGSIFACNIKLLKPLMQVVVPAWGDAL

SEQ ID NO: 30195 - protein, 234 aa, Salmonella enterica subsp. enterica serovar Typhi str. CT18
MNDIAHNLAHIRDKISAAATRCGRSSEEVTLLAVSKTKPASDIAEAIAAGQRAFGENYVQEGVEKIRHFQEAKVEGLHWHFIGPLQSNKSRLVAEHFDWCHTIDRLRIASRLSEQRPDNLPALNVLIQINISDENSKSGIPLAELDELAAAVATLPRLRLRGLMAIPAPESDYVRQFEVARQMAVAFAGLKARYPDVDTLSLGMSDDMEAAIAAGSTMVRIGTAIFGARDYTKN

SEQ ID NO: 30196 - protein, 419 aa, Pseudomonas fluorescens Pf-5
MLELVAAFICLTTLLTYVNFRFIGLPPTIGVMVTALLFSLLLQGLSYLGYPGLEEHVEELIGKIDFGDLLMNWMLSFLLFAGALHVNLNDLRSYRWPIGLLATVGVLIATFVIGSLAYWIFGLFGWHVSFLYCLLFGALISPTDPIAVLGVLRTANASKPLKTTIVGESLFNDGTAVVVFTVLLGIAQLGETPTVAATAWLFVHEAIGGVLFGGLIGYLVYLMIKSIEQHQIEVMLTLALVIGGSAMASELHVSAPIAMVVAGLIIGNLGRNLAMNDMTRRYLDGFWELLDDMLNALLFALIGLELLLLPFNWLHLAAASLLAVAIVLSRVLTVAPAILLLRRWRSVPRGTIRVLTWGGLRGGVSVALALALPLGPERDLVLSITYIVVLSSILLQGLTIGKLVRHVTQDAPAAKAEAH

SEQ ID NO: 30197 - protein, 214 aa, Arabidopsis thaliana
MEKANYFSFVMLINMLPSVNPRFLANVTFLMPKDKTLSTSNIINQQDSVTEFLLRHSIPSSLLFEHLNLIPNGSIVPSSLPHYTLEISNGGRSNYFLNNVKIISRNICSLGSIKCHGIDGILQSPSTVDDDSPRNNHTLPFISCPSSHNNSDQNSHNNSDQNSSRPADHTLTAPPPVSSPISQPKSDSPSIHDVKMLTSIVIPLFGLLASLIGM

SEQ ID NO: 30198 - protein, 460 aa, Zea mays
MPPSGLITVRFALLVFLLISCRIVVFASGYGGTTSSQPRAVADWERGCLEILGSVRQLFRVRGSLFSVGGSTVTDANGLGLKAVTGEDYCRVVIQYPSDTVSKWRDPITHKAESLSFEFNLCEAVASWEHVRNSTTVLTKEYIDALPNGWEEYAWRRINKGILLNKCQNRSLCMEKLSLVLPETSPYVPRHFGRCAVVGNSGDLLKTKFGDEIDSYDAVFRENGAPTQNYTEYVGRKSTFRLLNRGSAKALDKVVELDETKKEALIVKTTIHDIMNQMIRELPITNPVYLMLGTSFGSSAKGTGLKALEFALSICDSVDMYGFTVDPGYKEWTRYFSEVRKGHTPLHGRAYYQMMECLGLVKIHSPMRGDPGRTVRWLPTKATIEAARVASEKLLKRPGAGSDDPLGTCTMIKKRRKGKAPNRSGLRDAAMKHLEDMKGAARYPLERNAGGGYLCMINDR

SEQ ID NO: 30199 - protein, 423 aa, Borrelia burgdorferi B31
  misc_feature (3)..(4): Xaa can be any naturally occurring amino acid
MVXXKTLEPKFFQSLLDNSPTPYHLVNYIEEKLINYFNAQQLKLNEKWKIKTGSYYIKKEGTSLIAFNIDVKKKYEPFLIAAAHTDSPGLKLKIDATEKVSGVFYNHIEVYGSPIISTWIDRDLSLAGIVYFKKNENIESKLINIENIGIIPNLAIHLNRQINEGFKYNAHDNLTVISSTKKAIKDNILEQLGIECENFLSCDLIFTESQPSKIIGTEGEFLASKNLDNKSGCHAIMNSYVHTSNDKNKIAVFFDNEEVGSLTSRGADSNFLSEVLERIDIALDLTREEHLIKTNKSFNISIDSVHGIHPGYTSKHDPNYQANLGKGVVVKNSANFRYATTSTGFAKLKNLAIKNNIKIQEIIMKANVPSGTTIGPISNARTGIETIDIGTPMWAMHSLRETVSIADHIEAIKLLRAFFEKGI

SEQ ID NO: 30200 - protein, 220 aa, Robiginitalea biformata HTCC2501
MKHPIIAPSLLAADFGNLQQAVEMVEQSQAGWHHIDVMDGLFVPNISYGMPVIQAIGKHASKPLDVHLMIVDPDRYIDTFADLGAATLTVHLEACTHLHRSLQRIRDAGMKAGVALNPHSPVSLLSEVAEMADLVLVMSVNPGFGGQSFIENTYRKIEELRKLLSERNSQALIEVDGGVTLENAHALVAAGADVLVAGSTVFRSDDPAGTIARLAAAGQK

SEQ ID NO: 30201 - protein, 150 aa, Triticum aestivum
  misc_feature (138)..(138): Xaa can be any naturally occurring amino acid
MAEQTFIMIKPDGVQRGLIGEVISRFEKKGFYLKGLKLQNVEKSFAEQHYSDLSSKPFFAGVVEYIVSGPVVAMVWEGKSVVATGRKIIGATNPLASEPGTIRGDFAVDIGRNVIHGSDSFESARKEIALWFPEGIAXWRSSQHNWIYEA

SEQ ID NO: 30202 - protein, 622 aa, Pseudomonas fluorescens Pf-5
MSFASLGLSEALVGAIEAAGYTQPTPVQQRAIPAVLQGRDLMVAAQTGTGKTGGFALPILERLFPNGHPDKSQRHGPRQPRVLVLTPTRELAAQVHDSFKLYARDLKFVSACIFGGVGMNPQVQAMARGVDVLVACPGRLLDLAGQGSVDLSHVEILVLDEADRMLDMGFVHDVKKVLARLPAKRQNLLFSATFSKDITDLAGKLLHNPERIEVTPPNTTVERIEQRVFRLPASHKRALLAHLITAGAWEQVLVFTRTKHGANRLAEYLDKHGLSAVAIHGNKSQNARTKALADFKAGEVRILVATDIAARGLDIDQLPHVVNFELPNVDEDYVHRIGRTGRAGRSGEAISLVAPDEEKLLKSIERMTKQKIADGDLMGFDASAVEAEKPEVRERPDVRNPRNPRGPRGDGPNGGGGGGGRKDKGKDKGGKEKPARGERPAREQKPREGTPAREQRQPTPRADRAPDEFLDDDVDNFGNRADYVSPYQNKNNQGRGRRPGAPAQGAGAGNPPRGGAGGGQGRSGNPRNSNGSTTGTAPAKRSGGPRNGAPRDSQGRRDEPRNRRPNRDDQPRQEPAVQNPRGNQPKIMHKESKADRFPTPEQLDQLPSRPRGEKPALLTRNR

SEQ ID NO: 30203 - protein, 186 aa, Zea mays
VGAMLPYWFSAMTMKSVGSAALKMVEEVRRQFNTIPGLMEGITKPDYATCVKISTDASIKEMIPPGALVMLTPLIVGIFFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFKWL

SEQ ID NO: 30204 - protein, 326 aa, Ralstonia metallidurans CH34
MAKVVRIYETGGPDVLRFENATVGEPGPGEVRVRHVAVGLNFADTYFRSGLYKVPLPSSIGNEAAGVIEAVGSGVTHLAVGDRVTYTGFTPTLGAYSTDRLISADPLIKLPEAISCEVAAAMTMRGLSAAYLMRRIYPFKAGDTILLHAAAGGAGLIISQWAKLLGLTVIGTVSTDAKAEVARAHGCDHTINYSHEDVAKRVRELTDGVGVSVVFDSVGKDTFMSSLDSLKRRGLLVCVGFASGAVPAFDPAILARKGSAYLTRPGLADYIADPAEKAELVDELFGHVAAGRIRIDINRRYALEDAVQAHRDLEARKIVGSSIFAI

SEQ ID NO: 30205 - protein, 468 aa, Pseudomonas fluorescens Pf-5
MGLNNQWMQRDLAVLWHPCTQMKDHEQLPLIPIKRGEGVWLEDFEGKRYLDAVSSWWVNVFGHANPRINQRIKDQVDQLEHVILAGFSHQPVIELSERLVKITPEGLTRCFYADNGSSCIEVAMKMSFHYWINRGQPNKKRFVTLSNGYHGETIAAMSVGDVPLFTETYKALLLDTLKVPSPDCYLRPEGMSWEEHSRNMFAAMEQTLAEHHETVAAVIVEPLIQGAGGMRMYHPVYLKLLREACDRYGVHLIHDEIAVGFGRTGTMFACEQAGIRPDFLCLSKALTGGYLPLAACMTTDDVYSAFYDDYPTLRAFLHSHSYTGNPLACAAALATLDIFEQDNVVENNHALARRMASATAHLVDHPHVAEVRQTGMVLAIEMVQDKASKTAYPWQERRGLKVFQHALERGALLRPLGSVVYFLPPYVITPEQIDFLAEVASEGIDIATRDQVSVAVPKDFHPGFRDPG

SEQ ID NO: 30206 - protein, 327 aa, Erwinia chrysanthemi
ADKLPNIVILATGGTIAGSAATGTQTTGYKAGALGVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVINDRIGSARYITKTNASTLDTFRANEEGYLGVIIGNRIYYQNRIDKLHTTRSVFDVRGLTSLPKVDILYGYQDDPEYLYDAAIQHGVKGIVYAGMGAGSVSVRGIAGMRKALEKGVVVMRSTRTGNGIVPPDEELPGLVSDSLNPAHARILLMLALTRTSDPKVIQEYFHTY

SEQ ID NO: 30207 - protein, 335 aa, Vitis vinifera
MERYEIIKDIGSGNFGVARLVSDKRTRELFAVKFIERGQKIDEHVQREIMNHRSLMHPNIVRFKEVLLTPTHLAIVMEYAAGGELFGRICNAGRFSEDEARFFFQQLISGVSYCHSMRICHRDLKLENTLLDGSTAPRVKICDFGYSKSSVLHSQPKSTVGTPAYIAPEVLSRKEYDGKLSDVWSCGVTLYVMLVGAYPFEDPDDPRNFRKTIGRILSVHYSIPDYVRVSIECRHLLSRVFVANPDKRITIPEIKTHPWFLKNLPIEMMDGGSWQKNDVNNPSQSVEEILSIIQEARKTTGVRKAGGPFMEGSMDLDDIDADEDIETSGDFVCPL

SEQ ID NO: 30208 - protein, 371 aa, Gibberella zeae PH-1
MPFRQRMARHFGDSLAPEKPYLSYYDVLLTAEDIKALKHDWLTDNNIAFWEEYLERETLPKYPQARIVLLRPSMTFLLMKEPDTRSIQSALPDFSKVTHVFLPINDNRNVSVAEGGSHWSLLLVSTLDGVAFHYDSLGGANYSEANVATRKLANILGRPLRFINLDDCPQQENGSDCGVFVCLLMRHLLVKRLLCANAREKVSMSMGGKMVDSYGGRKEMMRIIENLQFEDLLKELLTEADATKKVAAKPTANQRVTRSRVKEDSPRDEDAPVKTSTTTKTSPAKTSTPVKTSPKRTLPPWKGMRDFGRPQGWHTRSTSNTLGPRTCKPDRITKETRVPPPSPSTPVKIRSKRPSNLTTALPQSRKVIQTR

SEQ ID NO: 30209 - protein, 332 aa, Thiomicrospira crunogena XCL-2
MKNKQRDFVDQIIPHRTPTQKGTGKAPVNIALSKYWGKRNVDLNLPTNSSLSISLPGLGTKTQIEWVENQSDHIYLNETKVASDDSFAQRIRLFLDLFRPNTQGGFIVNTLNSVPTAAGLASSASGYAALVLALNDCFQWDLPLKRLSLLARLGSGSASRSLYDGFALWHKGQLDNGMDSYAEKIDQAWPELCIGLLEIDVSTKPISSTQGMQNTVNHCELYQAWPDKAEADLQKTHQAIQDKDFQQLGQTSENNALAMHATMIATWPPILYWQPESVAAMHKVWQLRAEGCDVYFTMDAGPNLKLLFLKQDAPMIQTHFPSIKVIQPFSDT

SEQ ID NO: 30210 - protein, 249 aa, Vitis vinifera
MKFNIANPTTGCQKKLEIDDDQKLRAFFDKRISQEVSGDALGEEFNGYVFKIMGGCDKQGFPMKQGVLTPGRVSLLLHRGTPCFRGYGRRNGERRRKAVRGCIVSQDLSVLNLVIVKKGESDLPGLTDTEKPRMRGPKRASKIRKLFNLSKDDDVRKYVNTYRRSFTTKSGKKCSKAPKIQRLVTPLTLQRKRARIAEKKKRIAKAKSEAAEYQKLLATRLKEQRERRSESLAKRRSRLSAASKPSVAA

SEQ ID NO: 30211 - protein, 476 aa, Arabidopsis thaliana
MVKPSSSVSSVSMFALFSLVLCILIHCLYTKKPSFFQRFLSLLLPDLRLLEVDKEKQDPKSPRGALEACLTRCSISSASSSSDDPPPNREAIDNADADTDVQCKNHRASSNWGKFFKLWKRRSMKRLSSFPPLSGAAPPIIKQNKSADPNMNGMVLHDIYDFQSSLQNFSISDIEIATDNFSPENIIGRGGYADVYQGILPEGKLIAVKRLTKGTPDEQTAEFLSELGIIAHVDHPNTAKFIGCCIEGGMHLVFRLSPLGSLGSLLHGPSKYKLTWSRRYNVALGTADGLVYLHEGCQRRIIHRDIKADNILLTEDFQPQICDFGYFAPEYFMHGIVDEKTDVFAFGVLLLELITGHPALDESQQSLVLWAKPLLERKAIKELVDPSLGDEYNREELIRLTSTASLCIDQSSLLRPRMSQVVELLLGHEDVVMTPREAKIKMMQRTYSEELLDSVEYNSTKYLGDLDRIREVALAS

SEQ ID NO: 30212 - protein, 252 aa, Kandelia candel
MPIRQIAVGHPHEATRPDVLKAALAEFISTLIFVFAGEGSGMAFNKLTDNGSTTPAGLIAASIAHAFGLFVGVSVSANISGGHVNPAVTFGAFIGGNITLLRGILYWIGQLLGSTVACLLLKFSTGGLTTSAFSLSSGVSVWNAFVFEIVMTFGLVYTVYATAIDPKKGNLGTIAPSPSVSLWVPSVWTGGAFDGASMNPAVSFGPALVSWTWENHWVYWAGPLIGSAIAALIYDSFFIGYGTHEQLPTADY

SEQ ID NO: 30213 - protein, 455 aa, Prochlorococcus marinus str. MIT 9515
MYSLLAELSAHDLEVAETLIGVIRFLLIFLAARALAEVLVRLSLPTIVGELLAGVVIGASGFHLLIPPSAHTELNQGLVNVISSLASIPPEVVPDVYFESFPSLQAVATLGLYALLFLTGLESELEELVAVGAQAFTVAMAGVILPFAFGTFGLMFIFQVDLIPAVFAGASMTATSIGITASVFGELGYLKTREGQIVIGAAVLDDILGIVILAVVVALAAGGSLEIAPIVKLVAAAVVFVIAAIALSRTAAPGFDWLLDRLKAPGAVVVASFVILVLCCFVATAIGLEAALGAFAAGLILSSSKNNHAIQQSVLPLVSLFATIFFVLVGAGMDLSVINPLDPASRSALIVAGFLLVVAIIGKIAAGWVFSSDKPTNRLVVGLGMMPRGEVGLIFLGLGTSAGLLTPSLEAAILLMVIGTTFLAPVLLRIVLKDKPPGGDNKISDDVAADPVGLL

SEQ ID NO: 30214 - protein, 388 aa, Vitis vinifera
MDPHQHQPIGQADETSPPPSNTAATSCRCCGGPTTCPPPPAWSDISPPPSYRPIRAPAINLPPSNSQQAIILAPVPQAQKTPVVSPPYLFQIPVKRIQTPDDIRHFHDSDSGKNFLGFVVSLSESIRSHKISDPCHQSPILNSILSILQSLIDWVDEIPPVQQSSRYGNLSFRVWQSRLFDNSEQLMLQFLPDDLRSATVELVPYFADSFGNSSRIDYGTGHETNFAAWLYCLARLGLLKEEDYQALVSRVFVKYLELMRKLQFVYCLEPAGSHGVWGLDDYHFLPFIFGSSQLIDHKYMKPKSIHNQDILDNFSKEYMYISCIAFVKQVKKGLFAEHSPLLDDISGVPNWNKVNSGMLKMYKAEVLEKVPIMQHFLFGWLIKWYDHC

SEQ ID NO: 30215 - protein, 135 aa, Oryza sativa
  misc_feature (53)..(53): Xaa can be any naturally occurring amino acid
  misc_feature (71)..(71): Xaa can be any naturally occurring amino acid
PPMAASPASTAAAVVNAPAATGGLLLPRGRSSWSWSCCNNNNSSMGRRWRAAXAVGEVAAEGNTYLIAGAXVAVALVGTAFPILFSRKDTCPECDGAGFVRKGGATLRANAARKDLPQIVCPNCNGLGKLGQIDK

SEQ ID NO: 30216 - protein, 357 aa, Legionella pneumophila str. Lens
MTIEDTVIKLIGSLKDPLLDLTGKEMNLQYKITTSNQAIHVVLTAGYPTSLLETSYKPIVQKIVQDEFPNYQVTISIQQFIKAHKTQLTGKALRGVKNTIAVASGKGGVGKSTVTVNLAAALAKLGARVGILDADIYGPSIPLMLGETKPVQVKDNCYIPVEAHGMQAMSIGYLTDTNQALIWRGPMLAKSLIQMLDITLWNELDYLFIDLPPGTGDIQLTLVQKIPLTSAIVVTTPQNVATLDAQKAITMFSRTGIDVLGIIENMSTHICSHCGHQEAIFGRGGAAALCDAYQCTLLGQLPLDSHVRRHCDEGVPTATHSSNQLTDTFIKTAMRTAIELSKKPINYADRFPKIVVE

SEQ ID NO: 30217 - protein, 433 aa, Pneumocystis carinii
MGIFKIHARSFYDSRGNPTVEVEVTTETGVHRANVPSGASTGIHEALELRDNGSSWSGKGVTLAVSNVNDIIAPSLLSAGIDIKDQRSIDKFLIDLDGTSNKSRLGANAILGVSIAICKAAAAEKGVPLYRHFADIADIKEPFILPLPCFNVLNGGSHAGGRLAFQEFMILPTSAVTFHEAMQQGSEVYSALKKLSRKRYGHSAGNAGDEGGVAPDIQTADEALDLIVTAIEEAGYTGKIKIALDVAASEFYKNGKYDLDFKNPESDSSQHKTSKELADIYLDLSKKYPIVSIENPVDRDDWDAWIYVSRRATFQMVGDDLTVTNVSRINEAADKKACNCLLLKINQIGTISESIDAFKTAFDAGWGVMVSHRSGETEDTVIADLVVGLGTGQIKTGAPCRSERVAKYNQLLRIEEELNHSVYASMNYIKNIK

SEQ ID NO: 30218 - protein, 348 aa, Salmonella enterica subsp. enterica serovar Typhi str. CT18
MEFFRKTALAALVMGFSGAAFALPNITILATGGTIAGGGDSATKSNYTAGKVGVENLVDAVPQLKDIAVVKGEQVVNIGSQDMNDEVWLTLAKKINTECDSTDGFVITHGTDTMEETAYFLDLTVKCNKPVVLVGAMRPSTSMSADGPFNLYNAVVTAADKQSANRGVLVVMNDTVMDGRDVTKTNTTDVATFKAVNYGPLGYIHNGKIDYQRTPERKHTTSTPFDVSKLTALPKVGIVYNYANASDLPAKALVDAGYDGIVSAGVGNGNLYKTVFDTLATAAHNGTVVVRSSRVPTGATTQDAEVDDAKYGFVASGTLNPQKARVLLQLALTQTKDPKQIQTMFNQY

SEQ ID NO: 30219 - protein, 258 aa, Agrobacterium tumefaciens
MTYESLLKRFRLDKKVALITGGTRGIGLATAHAFGEAGARLYLSARREEFEDGGAILRAGYDVTFYPADLATRAAASALVNRVIRDAGRIDILINNAGLANGGDTPRFTEEQWRDVMALNVDSVFWCSQAVIASMRDTGGGKIVNVGSMSGIVSNIPQNQVAYNSSKAAVHMMTKSLASELALDNIRVNAVAPGYIDTEMSREGMVHPIRGPIWREMTPMQRFGKPDEVAAAILFLASDASSYVTGDILVVDGGYTTR

SEQ ID NO: 30220 - protein, 757 aa, Bacteroides thetaiotaomicron VPI-5482
MSQLPTLIADLALILICAGVMTLLFKKLKQPLVLGYVVAGFLASPHMPYTPSVMDTANIKTWADIGVIFLLFALGLEFSFKKIVKVGGSAIIAACTIIFCMILLGIGVGMGFGWHRMDSLFLGGMIAMSSTTIIYKAFDDLGLRKKQFTGLVLSILILEDILAIVLMVMLSTMAVSHNFEGTEMLESIGKLLFFLILWFVVGIYLIPEFLKRCRKLMGEETLLIVSLALCFGMVVMAANTGFSAAFGAFIMGSILAETIEAESIDRLVKPVKDLFGAIFFVSVGMMVDPAMIIEYAIPIIVITIAVILGQATFGTFGVILSGKPLKTAMQCGFSLTQIGEFAFIIASLGVSLHVTSDFLYPIVVAVSVITTFLTPYMIRLAEPASSFVDAHLPASWRKFLMRYSSGSQTVLNHENLWKKLLLAMVRITVVYSIVSISIIALSFRFVVPFFKENLPHFWASLLGAVFIILCISPFLRAIMVKKNHSVEFMTLWHDNRANRAPLVSTIVIRIMIAALFVIFVISGLFKASIGLIIGVAVLAVLLMVWSRRLKKQSILIERRFFQNLRSREVRAEYLGEKKPEYAGRLLSHDLHLADLEIPGESTWAGKTLMELNLGKKYGIHIASILRGKRRINIPGGSVRLFPMDKIQVIGTDEQLNVFSSAMQSGAKIDWEMYEKGEMTLKQFIIDADSVFLGKTIRESGIRDKYHCMIAGVEREDGTLMVPDVNAPFEEGDVVWVVGEKENVYQLVDQKNEKIQVK

SEQ ID NO: 30221 - protein, 80 aa, Prochlorococcus marinus str. MIT 9515
MSQEEILQKVCSIVSEQLSVESGEVKSDSNFQNDLGADSLDTVELVMALEEAFDIEIPDEAAEGIATVGDAVKFIEAKKG

SEQ ID NO: 30222 - protein, 183 aa, Zea mays
  misc_feature (176)..(177): Xaa can be any naturally occurring amino acid
MGSILSATSTTAKSMDQHEASGTDPNKRVKISTYEYGSNPRIIPTLPDELSLQILARSPRIHYLNLKLVCRAWKAAIIGYELSQLRRELGVSEEWVYVLTKAEAYKLHWYALDPVFQKWQRLPPMPSFVNQEESNRTASSAFWMWNVVGSSIRIADYVRGLFWRRNSLDQCPFCGXXSVGVAD

SEQ ID NO: 30223 - protein, 423 aa, Thermotoga sp. RQ2
MGNTVAMILAGGQGTRLGVLTERIAKPAVPFGGKYRLIDFTLSNCVNSGIYRVGVLTQYRPHVLSKHIGIGRPWDLDRKDGGVEILPPYVGRHESDWYKGTANAVYQNLEFLEENDAELVLILSGDHVYAMNYNDLIDYHLLKEADGTIACMEVPIEEASRFGIMITDVDGRIVDFEEKPAKPRSNLASLGIYVFNYEFLKKVLIEDENDPNSSHDFGKDVIPRILRENLGSLYAFRFDGYWRDVGTLRSYWEANLELVLPVPPFNLYDPNWRFFTHTEEMPPAYVAPGSKVSTSLVSEGAEVYGNVFNSVIFQGVKIGRGTVVKNSVIMTRTEIGENCYLENVIIAENVKVGNNVRMGVGEDAESKLDPKVYSGLLTVVGMNSVIPDDMVIGKNCVIGIGVRPEDFKSKTLESGDYVIVREE

SEQ ID NO: 30224 - protein, 663 aa, Mycobacterium smegmatis str. MC2 155
MTSESTATPATPTLRELTVRGILLGGVITLVFTAANVYLGLKVGLTFATAIPAAVISMAILRNFRDHSIVENNIVQTVASAAGTLSAIIFVLPGLVMIGWWTGFPYWITVAVCAVGGILGVMYSIPLRRALVTGSDLPYPEGVAAAEVLKVGERTEGAEDNRIGLRIITFGSIVSVAFALLANLKVLANSITAYFRVGAGGSMFGASLSFALIGVGHLVGMTVGIAMLVGLVISFGIILPFRTIGDFAGSESVADVISSAFANEVRFVGAGAIAVGAVWTLLKILRPIVKGITEALVSARERREGQLVDITQRDIPFPIVVATIVVMLLPIAVLLWEFSRGTVLQGSSAGIIVASVVFVFVIGLVIAAVCGYMAGLIGSSNSPISGVGILTVLIAALLIKIVFGPTNDDQATALVAFTLFAAAITFGVATISNDNLQDLKTGQLVGATPWKQQVALVIGVLFGSAIIPPVLELMQTAFGFLGAPGASENALAAPQAALISSLAKGVFGGSLDWSLIGLGAAIGVVVVIIDEILHRTSRFALPPLAVGMGMYLPMSLILVIAIGAVIGYVYNRWAIRTGGDVQRKKRLGVLLATGLIVGESLYGVVFAGIVAGTGNEDPLAIFTGNDGNFAQIFGIVAFAAVILWLYKRTQTLSSREVGAKSGQ

SEQ ID NO: 30225 - protein, 370 aa, Thermotoga sp. RQ2
MRVLGLILAGGKSDRLWPLTKVRASAAVPVFGKYRAIDFTLSNMVNSGIRKVGILTQYNPRSLMDHLGSGKEWDLDRKSGGLFILQPYVGPNREVWYRGTADAIFQNMTILRRGEEDHVLIGSGDHIYKMIYRDLFNYHLKKGADITLVVKELDETYNLSEYGIVQLDDDMRVVEIEEKPAHPKGNIAFLGVYFMNKELLKELLYATVPQGKYDLLLDIVIPNLDRLKVYAYRFDGYWRNVKKGIKEYYRINMDILKKEVRDELFYRNGKVYTKLKDLPPPKFTTTAVVENSLIADGSIVSGTVRNSVIFRNVRIKVGAVVENSIIMESTVVEEGAVLRNVILDKNCIVREGRVIEGDTELPVFEKRAVL

SEQ ID NO: 30226 - protein, 232 aa, Xanthobacter autotrophicus Py2
MNTQAEAQDAASGLHAVRAEVLSSCRDAGRDPATVTLVAVSKTFPAPEIVPVLAAGQRVFGENRVQEAQGKWPALRADYQGVELHLIGPLQSNKAREAVELFDVIHTVDRPKIAAALAGEMARQGRNPRLFVQVNTGAEPQKAGVLPETADAFIAECRERHGLKIFGLMCIPPATDVPDPHFALLAKIAARNGISGLSMGMSADFPAAIRQGATHVRVGSAIFGHRSLPNEA

SEQ ID NO: 30227 - protein, 482 aa, Solanum tuberosum
MASATASHTFCGIPTTSSSSTTNRSTTHSSARFLLKTPLRRLGFAGAVADPLFTNHVATKLRSLKASSNPVRAVVSMAKKSVGDLSSSDLKGKKVFVRADLNVPLDDAQNITDDTRIRAAIPTIKHLIANGAKVILSSHLGRPKGVTPKYSLAPLVPRLSELLGIQVVKADDCIGPEVEKLVDSLPEGGVLLLENVRFYKEEEKNEPEFAKKLASLADLFVNDAFGTAHRAHASTEGVTKFLKPSVAGFLLQKELDYLVGAVSTPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSIKTFNDALDTTKTVIWNGPMGVFEFDKFATGTEAIAKKLADLSGKGVTTIIGGGDSVAAVEKVGVASVMSHISTGGGASLELLEGKVLPGVIALDEADAPVAV

SEQ ID NO: 30228 - protein, 330 aa, Candida albicans SC5314
MSTTATSTNELALLDKSVVVSPLVLLSVVDHYNRVAKDSKKRVVGVILGDNSTDTIKVTNSYAIPFEEDEKNPGVWFLDHNFIDSMGEMFKKINAKEKLIGWYHSGPKLKPSDLKINEVFRRYTDNPLLLIVDVQPREVGIPTDAYFAVDDIKNDGSAAEKTFIHVPSLIEAEEAEEIGVEHLLRDIRDQAAGNLSLRVSETHQSLLGLHQKLGEIANYLDKVYQKKLPMNHTILGKLQNVFNLLPNLMQQSGSDLDGGSDSSHALATAFTVKTNDELMIIYISTLVRAIIAFHDLIENKLENKKLNENKAQASVAESSLNSEKKDSIEE

SEQ ID NO: 30229 - protein, 448 aa, Picea sitchensis
MALPFPSTCSANSAVSASNCASSSFIFRGSQYMQELANTAVLASNRSSSSFTVRGSHYMQELSSLRYDSRPPVQHARALCQRIPLPMASTNLYGFNRFRTKNQGGLEDRPPRRPVLSKATEPSASINSKEPSAFPAGQKFHLEDVIEAQQFNREILSAIFEVAQQMEMIEKDPVGVQILRGHLMATLFYEPSTRTRLSFESAMKRLGGEVLTTENAREFSSAAKGETLEDTIRTVEGYSDIIVLRHFESGAARQAAAVANIPIINAGDGPGQHPTQALLDMYTIQRENGRLDDIEVALVGDLANGRTVRSLAYLLAKYNNVKIYFVGPDVVKMKDDIKNYLTLKGVEWEESTDLMEVASKCDVVYQTRIQRERFGERIDLYNEARGKYIIDKKVMNVLQKHAVIMHPLPRLDEIMVDVDTDPRAAYFRQAKNGLYIRMALLKLLLLGW

SEQ ID NO: 30230 - protein, 478 aa, Borrelia burgdorferi B31
MKERSVSNFDIVIFGVTGNLSRKKLIPSLFNLFKNKCISNFRVIGFSRKIFTDKEFRLYIKDSLWQEETDSLIEIFLNFFVYVFGDFNEKESYKNLFKFLDRSRETIYYLSTSPAFYGPIINHLKKYFLSEKLTLSKIVLEKPFGSSLETAKKLNSLLYSAFKEDQIYRIDHYLGKETVQNIFTFRFGNSIFENIWNNRYVDFVQITVAEELGLDGRVEYYDSVGALKDMVQNHILQLLSLVAMESPIKFDSEFIHDEKVKVLKSLRKISKEDIKNYIVKGQYIGSQVQGVFKKGYKDETEFLGNSNTETYLAMKVFINNWRWSGVPFYLRTGKGLARKFSEIYIQFKKPSFTLFNNSSVDFSNALIFRIQPRDGIEIKFNTKKPGYNYEIQTANMEFSYHGAFKRLFDEAYERLLLDAFLGDGTLYATSDEIESSWEFVSDIANKWADIEICNYFYGSEGPKEIDSILEKDHFWRKI

SEQ ID NO: 30231 - protein, 327 aa, Borrelia garinii PBi
MYNLRNRSFLNLLDFTSKDIRYLLDLSIDLKKSKYAGIEVQKLKGKNMAIIFEKDSTRTRCAFEIAAYDQGANITYLGSRGNQIGVKESMMDTARVLGRMYDAIGFRGFSQQTVECLANYSNVPVYNGLTDTAHPTQILADLMPIEEHKGSLKGVKIVFCGDGRGNVANSLLKGCAIMGLDFRIFAPKELFPDSNLTLKAKSLALDSGGKITITDSKEEAVKCADVVYTDVWVSMGENNWEDRINLLRFYQVNKEIMDMAKDSAIFMHCLPAFHDLNTVVGKDIFDKYGINGIEVTEEIFESKNSVVFDIAENRVHTIKAIVVATLG

SEQ ID NO: 30232 - protein, 352 aa, Chlamydomonas reinhardtii
MLCGCGGAKQVSRVALVPKAVAAPEKAAVKMNIATDVTELIGKTPMVYLNKVATGTHAKIAAKLEIMEPCCSVKDRIGYSMISSAEKEGLITPGKTVLVEPTSGNTGIGLAFIAAARGYKLILTMPASMSLERRILLRAFGAELVLTDPAKGMKGAVAKAEEILASTPDAFMLQQFQNPNNPKVHYETTGPEIWSATDGKVDILVSGVGTGGTITGTGRYLREKKSDVQLVAVEPAESPVLSGGKPGPHKIQGIGAGFVPAVLDTALISEVVQVSSDDAIDMARRLALEEGLMVGISSGAAVQAAIKVASRPENEGKLVVVVLPPFGERYLSSVLFQQLRDEASKMTFEPSA

SEQ ID NO: 30233 - protein, 371 aa, Ostreococcus tauri
MYRQLAAISKFSKSTTHRARDGRPCACCAPNSRFKGFAIALSNAMAVARRRRETLDAETLDDLLGKSAEAKRAEWAAADDDALLAVIETYRNAVRTLKGEIEKCGGVVRGVDAVELRERASSGSDEDEDEDEAEGPNIDDIDPREWMVPPQCIPVHANVTTYDWRPMYEHEQFDVIMMDPPWQLATANPTRGVSLGYSQLTDQDIANLPLPQLQKNGLLFVWVINAKYQWCLNQFKKWGYEFVDEIVWVKVTNSRRLAKSHGFYLQHAKEVCLVARRGDTPPGLKDKAIGSDIIFAPRRGQSQKPTEIYELIEELVPNGRYLEIFARKNNLRDFWVSVGNEVTGTGLPPDDVKAFEERGAIPSAKYGAGNR

SEQ ID NO: 30234 - protein, 341 aa, Magnetococcus sp. MC-1
MAVEYADNPSVAVIGAGSWGTALAALLAGKLPQVTLWAREPEVVEGINQGHHNPVYLADLDLPPNLVAHQDLAWVAANHDVLVMVVPTQFCRQVLAQLKPHVRPHVTFVSATKGVETANLALISEIFTQTFAAPIAQRTCYLSGPSFAREVIAGQPVAVAMAGADEAALAAMQALFFFPHFRTYSTSDVVGVELGGALKNIIAIAAGISDGLGYGAGARAALITRGLAEIARLGHIYGANPQTFAGLSGMGDLLMTASSTLSRNYTTGFRLGQGESLSHISGSSREVAEGVQTAASTWLLAQRHGVEMPITQAVHAILFEQVPPQQAVTQLLNRDMKREAV

SEQ ID NO: 30235 - protein, 451 aa, Mycobacterium smegmatis str. MC2 155
MSVLLFGVSHRSAPVSVLEQLSTNEAEQAKIIDQVLQSSLVTEAMVLSTCNRVEVYAVVEAFHGGLSVIGQVLAERSGMSLNDLTKYAYVRYAEAAVEHLFAVTSGLDSAVIGEQQVLGQVRRAYATAEANRTVGRTLHELAQRALSVGKRVHSETGIDAAGASVVSVALGMAETKLSGGLGGRTAAVVGAGAMGALAGAHLVRAGIERVHVVNRSLPRAERLAKNLTEQGVVADAVGLDDIARALVDADVVLSSTGAVRPVVSLADVHYALAQRTLAGAEHQMVVCDLGMPRDVDPAVSGLPGVWVVDMDRIQREPSARAAAVDAEAARNIVAAEVANYLAGQRMAEVTPTVTALRQRAADVVEAELLRLDNRLPGLDAAHRDEVAKTVRRVVDKLLHAPTVRVKQLASAPGGDSYAEALRELFELDPQAVEAVAASELPLITTDLDKTE

SEQ ID NO: 30236 - protein, 542 aa, Mycobacterium smegmatis str. MC2 155
MITATDLEVRAGARTLLLIEGSALRVQPGDRIGLVGRNGAGKTTTMRILAGEGEPYAGSVTRSGDIGYLPQDPKEGDLDVLARDRVLSARGLDTLLADLEKQQALMAEVADDAARDKAVRRYGQLEERFSALGGYAAESEAGRICASLGLPERVLTQPLHTLSGGQRRRVELARILFAASETGSGSATTLLLDEPTNHLDADSIGWLRDFLKNHTGGLVMISHNVELLEEVVNRVWFLDAVRGEVDVYNMGWQKYLDARATDEQRRRRERANAEKKAGALRAQAAKMGAKATKAVAAQNMLRRAERMMAALDEERVADKVARIKFPTPAPCGRTPLVAKGLTKNYGSLEVFTGVDLAIDRGSRVVVLGLNGAGKTTLLRLIAGTEKPDAGHLEPGHGLKIGYFAQEHDTLDNQATVWENIRHAAPDTGEQDLRGLLGAFMFTGPQLDQPAGTLSGGEKTRLALAGLVASTANVLLLDEPTNNLDPASREQVLDALRSYEGAVVLVTHDPGAAEALDPQRVVLLPDGTEDFWSDEYRDLIELA

SEQ ID NO: 30237 - protein, 564 aa, Cryptococcus neoformans var. neoformans JEC21
MPPTAKRPRQKSPQHEDPGARPRESPDPEASASHLVSFLSGYADHQSDEEENEHDLDDDDADRYEPSDQEEDAEDGVNEEEEETRVTPRKMGLLPASMTSTPRSKRGTPKKRKPGSTTPTPRRTPVKTPKRSFVLAPGDGEQEDMGFIRASKADGYFTLMAQSSKTSGNSYSLLADPLSKQAYERYIAESSEVRATLIPPETFMGKFRQWEKELEAGFNLLFYGFGSKRPALNLFAQNRLAKKGHVVVVNGFFPGLGIRDVLSEVEDRLEVPQNVSVPAYCSTPLERAAHRIYAYLLPPAAIQSHSRKHWPTASAPLYLVIHNIDAQSLRTPRSIATLSLLASSPRIHIIASFDHVHTPIIFSTSLSNSPPHSYPDGGWRGTPQKDRGFNWIHHSLTTYAPYDLELSYLRLSAQSLTPSGSGTGGISEEGALQILKSVPVKAARLLKLILTQQLSRLPSHPKWHVAYPAPSSGSGIAPPFAVDGYLLNKTAKDKFIATEDERFEAFIGEYKDHGLVAEASVASDVDENHDGAVTEGRKEGRWFWVPLGKAAVERILQSMEDIES

SEQ ID NO: 30238 - protein, 423 aa, Magnetospirillum magnetotacticum MS-1
MSTPSSRIAVIGLGYVGLPLAVAIARHFPTIGFDIDQGRIGELHKGFDRTGEVEASRLRASTMRLSAKAEDIIGQDVYIVTVPTPVDSDNRPDLKPVLSACRSVGQAMKKGAVVVFESTVYPGVTEDICGPELEKHSGLKCGTDFFLGYSPERINPGDREHTVDRITKVIAGQTPEVTALLTRVYGSVTTGGVFPAASIRVAEAAKVIENAQRDINIAFINEITMIFQKLGISVYDVLDASSTKWNFLNFKPGLVGGHCIGVDPFYLAQCAQDNGHHPEIILSGRRINDGMGEWIADRVSAQLTAGSRILVLGLTFKENVPDLRNSKVVDVIRALRNRGHTVDVHDPFADPAEAAHEYSETLMPSLDGARGYDCLLGAVPHQSYVAFSGENFTTLVRDGGLVADVKGMWRGMDIPESLRLWRL

SEQ ID NO: 30239 - protein, 535 aa, Legionella pneumophila str. Lens
MAKLTTQINTSSQEFKNNQANMQALVTDLREKIHQISLGGDEKARTKHQQQGKLLPRERLHQLLDPGSPFLELSQLAAYQVYEDSIPAAGIITGIGRVAGNECVIVVNDATVKGGTYYPLTVKKHLRAQEIALINHLPCIYLVDSGGAFLPLQDQVFADKEHFGRVFYNQAQMSALNIPQIAVVMGSCTAGGAYVPAMADESIMVKNQATIFLGGPPLVKAATGEIISAEELGGAEVHCRHSGVSDHYAENDAHALHLARAAISNLNRKKPDSIHRADTVPPLYDSEDLTGIIPTDPRKPFDIREIIARVVDGSEFDEFKALFGTTLVCGFARLYGYPIGIIANNGILFSESAQKGSHFIELCCQRKIPLVFLQNITGFMVGSKYEASGIAKHGAKMVTAVANANVPKFTIIVGGSFGAGNYAMCGRAYAPRFLWAWPNARISVMGGEQAANVLAQITREKYAKQGKEWSLEEEEQFKTQMRSQYETQGNPYYASARLWDDGVIAPQDTRKILGLGLSAALNAPIEDTRFGVFRM

SEQ ID NO: 30240 - protein, 155 aa, Zea mays
AVPVRILSTTRRPLPCSTCRQFEENSCNRGGYCNFIHVKQIGRDLRRKLYGRSASRRYHGRSRSRSPPPQRRGHRDRGRGRGSRYDRYDDGAGRGGRHGRYDDGAGRGGRHDRYDDGGRRRHGSPPRRARSPVRESSEERRAKIEQWNREREGKQ

SEQ ID NO: 30241 - protein, 723 aa, Thermotoga sp. KOL6
MWLLFLVPLIALGFAAANFSAVVKKPEGTDRMKEISSYIRSGADSFLAHETKAIFKVAIVIAILLMIFTTWQTGVAFLIGAVMSASAGIVGMKMATRANVRVAEAARTTKKIGPALKVAYQGGSVMGLSVGGFALLGLVLVYLIFGKWMGQLDNLNIYTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQKLGERFVHQIPKETIQSLISYPIYFALVGLGCSMLGILYVIVKKPSDNPQRELNISLWTSAILTVVLTAFLTYFYLKDAQGLEVVGFRYGPISPWFSAIIGIFAGILVGFWAEYYTSYHYKPTQFLSRSSIEGTGMVISNGLSLGMKSVLPPTLTLVLGILFADYFAGLYGVAISALGMLSFVATSVSVDSYGPIADNAGGISEMCELEPEVRKITDHLDAVGNTTAAIGKGFAIGSAILAALSLFASYMFSQISPSDIGKPPSIVLLLNMVDARVIAGALLGAAITYYFSGYLISAVTKAAMKMVDEIRRQAREIPGLLEGKAKPDYNKCIEITSDNALKQMGYPAFIAILTPLITGFLLGPEFVGGVLIGTVISGAMLAILTANSGGAWDNAKKFLEAGHLEGYGKGSDPHKALVIGDTVGDPLKDTVGPSLDILIKIMSVVSVIAVSIFKHIHLF

SEQ ID NO: 30242 - protein, 331 aa, Mycobacterium smegmatis str. MC2 155
MEAAVMGCGAWGTALAKVLADAGNPVTMWARRPEVADEINSEHRNSEYLGDVVLPASIRATSDPEEALRGACTVMLAVPSQKLRANLDNWKHLIEDDVTLVSLAKGIELGTLMRMSQVIVQVTGADPSRVGVVSGPNLASEIADEQPAATVIACSDSGRAVTLQRAMATGYFRPYTNPDVIGAEVGGACKNVIALACGMAVGVGLGENTVAALITRGLAEIMRLGIALGATPATLAGLAGVGDLVATCTSPHSRNRTFGERLGKGGTMESALAAAGGHVAEGVASCESVLALASSYGVEMPLTDAVHRVCHKGLSVHEAVALLLGRSTKPE

SEQ ID NO: 30243 - protein, 479 aa, Burkholderia pseudomallei K96243
MEEAKHFIAGAWAPPAGGETIAVIDPSDGEPFARLARGTAPDVGAAVQAARAAFDGSWGALGAADRGRMLYRLSMLVAACREELALIESRDTGKPLTQARADADALARYLEFYAGAADKLHGETLPYRDGYTVLTLREPHGVTGHIVPWNYPMQILGRSVGAALAAGNACVVKPSEDACLSILRVATLAAEAGLPEGAFNVVTGYGHEAGAALARHPGVDHLSFTGSPDTGRLVAQMAAEHHASVTLELGGKSPQIVFADADLDAALPVLVSAIVQNAGQTCSAGSRVLIDKAVYEPLVERLATAFNGLKVGPGRADLDCGPLINAKQQQRVWDFLSDAQHDGITMAAHGQVVPDAPETGFYQAPALLRDVPHTHRLAQEEVFGPVLAAMPFADEDEALALANGTPFGLVAGIWTRDGARQMRLARKVRAGQVFVNNYGAGGGVELPFGGTGRSGYGREKGFEALYGFTVLKTIALRHG

SEQ ID NO: 30244 - protein, 175 aa, Burkholderia pseudomallei K96243
MSFSNVPAGKDLPQDFNVIIEIPAQSEPVKYEADKALGLLVVDRFIGTGMRYPVNYGFIPQTLSGDGDPVDVLVITPFPLLAGSVVRARALGMLKMTDESGVDAKLVAVPHDKVCPMTANLKSIDDVPAYLKDQIKHFFEQYKALEKGKWVKVEGWDGIDAAHKEITDGVANFKK

SEQ ID NO: 30245 - protein, 86 aa, Thermotoga sp. RQ2
EHGLKINETVFKVVDDYRGPGYAIPSSEDVEILKEVASIESIILDPVYTAKAFRGMIEMFRNSGKNVLFIHTGGIFGLFAQSGRLV

SEQ ID NO: 30246 - protein, 468 aa, Salmonella enterica subsp. enterica serovar Paratyphi B str.
MDTLQQSPPAEPEGGLRRNLKKRHLLMMSLGGTIGTGLFIGIAEPLSSVGPAGTLLAYLFAGTIMLATMMCLGELSCAFPHSGSFQHYALMFMPSPCWSYTIGWLYWFSWVFSLAADLTAAGFIAHQFFPAVPVYMFCLAILLILTAINLTSAKSFGECEYWLSAIKVFAIVLFICAGGVMIYSLMGHSDWHPTLKTDGMWFPHGWEQIVVCMTIVIYSFQGVELVGNAAGETESPHIILPKVILGIGLRIILFYGLAIAVLALVYPHELTPNGQSPFVWVFSHAGIPGADTLMTLVIFSAAVSAANSAIYASSRMLWSMAGDRFAPACFGKTNGGGVPVYAILITALLALVSLLTRYIPAQQFYLYLIASTGQVGCLAWITIGWCQYRFRQSVRNGTYASDLLRYRSPLFPWTARFVIITNFAIMVGTWFSEQGVVIMLVELAFMIGILLSWYLFRPTLSRLRNTVG

SEQ ID NO: 30247 - protein, 274 aa, Oryza sativa
MSPSRSRSNSRSRSRRRSRSRSRSKSKSRSRSRSRSRSRSPRRERLHSERVSRRSRSRSRSRSRSPIRRREHRGHRDLICKNCRRPGHFARDCQSTATCNRCNLPGHFAAECTSETVCWNCKQSGHIATECKNDALCHTCSKTGHLARDCPSSGSSKLCNKCFKPGHIAVDCTNERACNNCRQPGHIARECTNEPVCNLCNVSGHLARNCQKTTISSEIQGGPFRDITCRLCGKPGHISRNCMTTMICGTCGGRGHMSYECPSARMFDRGLRRF

SEQ ID NO: 30248 - protein, 420 aa, Aster yellows phytoplasma
NSSINEYFPSVKDIIEAKYILKDIIYNTPLQKNTILSEKYKCNIFLKREDLQIVRSYKIRGAYNKIKSISNDDLKNGIVCASAGNHAQGVAYSCNKLKIFGTIYMPITTPKQKIDRVKMFGKHYINIILTGDTFDECSYKAFKSCKKEKKKFIHPFDDKRIIEGQGTVGLEILQQMKDKIDYIFLPVGGGGLASGVGSYFYHISPYTKIIGVEPKGAPSMSFSFIENKVIELKNIDKFIDGASVKKVGLLNFNICKKVLYDIKPLHEGKVCTTILDLYNLEAIVAEPAGALSISALDIYSDKIKNKNVVCILSGGNNDIIRTEEIRKRSLIYKGLKHYFLVRFPQRAGALKEFVSTILGPNDDITYFQYSKKTSKEEGPAVIGIELSDKEDFSGMIEKMKHYNIHYQYINDNPDLFDILI

SEQ ID NO: 30249 - protein, 479 aa, Zymomonas mobilis
MNNNSEIENDTQTNVRNTVSDFIGSQLYLLGTVLVTAIAGFLYGYDTGIISGALMNIAHDFKLDAHQQEIITSILLFGAVIGSLVCGRLSAFVGRRHMIMIVTAIFGFSVIAADAPTAFWLGAARLVLGFAVGGSSQIVPVYIAELAPADQRGRMVTFYNISIGLGILAAGIVGAFLQEEWTWRTMFSVAAIPAAVLFCSMMMLPESPRWLVRQERVEEARDMLDTVRETDHEVTKELRSIKKNQQPDEGSGSRWLESLAQPWVRPALIAGLGVAAFTQLSGIEMMIYYTPTFLRDSGFTEKMAYYSALGVALIYVIMTTIGKLLVDHVGRRKLALCMMPLAALSLFALGIAFNLPGGASEHRWLILACLFAFMVFNAGGIQVIGWLIGSEVYPLCIRARATSLHAATLWGSNLILTSTALTMTSLLGIGGSMWFYGGLNALGFVFVYFMVPETKGRSLEEIESSLKDGSFLPSKKASA

SEQ ID NO: 30250 - protein, 757 aa, Cytophaga hutchinsonii ATCC 33406
MSISKEDALNYHTQGKPGKIEVVPTKALSTQLDLALAYSPGVAEPCKEIAANKEDAYKYTAKGNLVAVISNGTAVLGLGNIGPDASKPVMEGKGVLFKKFAGIDVFDLEVNCEDPEQFIKIVESLEPTFGGVNLEDIKAPECFIIEQELRKRMNIPVMHDDQHGTAIISSAALLNALEVVGKKAEDVNVVVSGAGAAAISCTRLYKHLGVRSENIVMCDINGVLRKDRTDLDVSQLEFATGRDLYTLADAMPGADVFIGLSAGNILKPEVLATMAKDPIVFALANPTPEIDYHLALNTRPDVIMATGRSDYPNQVNNVLGFPYIFRGALDVRATEINEAMKLAAVYAIAKLAKEVVPDTVNKSYGDNKITFGKNYLIPKPLDPRLITTISPAVARAAMESGVAKKDIEDWGAYEVELLQRIGIDQRLMSRIITQAKQEPKRVVFAEADNLKILKAAQIISDEGIAFPILLGNAEKIKELLIENALVIKDFLIVDPFEEKEKRSLYGNLLHNKRKRKGITAEIGRKLMRNRNYYGAMMVETGEADAFISGLTQEYGETIKPALQVIGVEEGIKRVAGMYILSNRKGVYFFSDTTVNMDPTAEELVDIIGVTARGVKFFNFEPRIAMLSYSNFGSNEGAVPTKVALATRLAKEKYPDLIIDGDIQANVAVDTALQEEMYPFSALAKDGANTFIFPALTSGNIAYKLLQEIGGMEAIGPLLMGMAKPVHILQLGSSVREIVNMVAIAVVDAQSQNSKINL

SEQ ID NO: 30251 - protein, 321 aa, Staphylococcus aureus subsp. aureus Mu50
MLNNEYKNSSLKIFSLKGNEALAQEVADQVGIELGKCSVKRFSDGEIQINIEESIRGCDVFIIQPTSYPVNLHLMELLIMIDACKRASAATINIVVPYYGYARQDRKARSREPITAKLVANLIETAGATRMIALDLHAPQIQGFFDIPIDHLMGVPILAKHFKDDPNINPEECVVVSPDHGGVTRARKLADILKTPIAIIDKRRPRPNVAEVMNIVGEIEGRTAIIIDDIIDTAGTITLAAQALKDKGAKEVYACCTHPVLSGPAKERIENSAIKELIVTNSIHLDEDRKPSNTKELSVAGLIAQAIIRVYERESVSVLFD

SEQ ID NO: 30252 - protein, 108 aa, Glycine max
  misc_feature (85)..(85): Xaa can be any naturally occurring amino acid
AASMISSPAVTTVNRAGAGMVAPFAGLKSMGGFPTIKTNSDVAFIASYGGRVQFKLVWPPVGNKMFYTLFFLPYLYDAQLAKEVXFLHRKGWITWLEFEWEHGFLCRE

SEQ ID NO: 30253 - protein, 299 aa, Mycobacterium tuberculosis CDC1551
  misc_feature (37)..(37): Xaa can be any naturally occurring amino acid
  misc_feature (50)..(50): Xaa can be any naturally occurring amino acid
  misc_feature (73)..(73): Xaa can be any naturally occurring amino acid
  misc_feature (100)..(100): Xaa can be any naturally occurring amino acid
  misc_feature (162)..(162): Xaa can be any naturally occurring amino acid
  misc_feature (208)..(208): Xaa can be any naturally occurring amino acid
  misc_feature (245)..(245): Xaa can be any naturally occurring amino acid
IEALPTHIKAQVLAEALPWLKQLHGKVVVVKYGGNAXTDDTLRRAFAADXAFLRNCGIHPVVVHGGGPQITAXLRRLGIEGDFKGGFRVTTPEVLDVARXVLFGQVGRELVNLINAHGPYAVGITGEDAQLFTAVRRSVTVDGVATDIGLVGDVDQVNTAAXLDLVAAGRIPVVSTLAPDADGVVHNINADTAAAAVAEALGAEKLLXLTDIDGLYTRWPDRDSLVSEIDTGTLAQLLPTLELGXVPKVEACLRAVIGGVPSAHIIDGRVTHCVLVELFTDAGTGTKVVRGEGHHHHHH

SEQ ID NO: 30254 - protein, 555 aa, Glycine max
MEGIISGVWNVLLQYFRSYKVAKTAVLNYITPFTDKFDLVDILLVWTVIVVIGTVIYRNVNYARKHGFRKTVTAWFFRRLKRISFITNKIDGEISKLASSLEADIQKHRDASKTTHIPTTGLSEEALVKKLAQWQKIDHKIYGEKKITGCIYYNEGEKLQTIVKDVAKEYFYINPLHFDLFPTANQMEGEVIYMVKNLYNGDDKSCGILSSGGTESIMIAMLAYREQGRINGIFEPEIVAPITAHVAFENAAFYYGMRMKWVPVDIKTGVVSPHDIKKAISKDTVCVIGSYPNYPYGTCDPIEQLAAIAKKKKVGFHTDCCLGGFVAPFAEKFGAMSEVFDFRVPGVTSISVDPHKYGLAPKGVSVVLFRDRKLRGGSFFSCTTWPGGIYSTPTHAGSRGHAPVAGAWVALQYTGYNGYMDKAGKIIEATRRVAKKISEIPELQVVGNPQLGSVAFVTKTNKLSIYDLVDKIGQRGWKLAALQLPPAVHLSITNYNIGQIEDFIASVKWGVTELLKAGPPKVQGELAQIYGSNAKLPESIMQDGAKVILEGLLKP

SEQ ID NO: 30255 - protein, 438 aa, Oryza sativa Japonica Group
MEVPAASVKGGGGRRSDEEAPGRIAGNGAGNVACLFTRQGKKGTNQDAMVAWEKGQQQNVTYLVPLNYNGRSDTVFCGVFDGHGPHGHLIARKVRDILPSRLCDLIYEDCGDSPTSNSDVSTLEENLSPYADAECRSPTLAGQKEHQEFFNAMKESFRKAFKNVDKELKLQRNIDSICSGTTAVTLIKQGHDLIVGNLGDSRAVLGTRDQNDKLVAHQLTVDLKPDHPREARRIRRCNGRVFAHQDEPDVARLWLPNCNSPGLAMARAFGDFCLKDFGLISVPDVTYRQITEKDEFIVLATDGVWDVLSNQEVVDVVASCSGRFAAARSVVDLANETWRFKYPTSKTDDCAVVCLFLNKYEVTGGLSGQPGYSPRMPALSGITRPNSKRVTPDDVDDGSDSNVSGDERSLDGFTRLNTLWHYQSLVKQVQLRNELVSR

SEQ ID NO: 30256 - protein, 228 aa, Glycine max
MQGQGVDEVNIEELASNLSLYKDQLNQVRQLLNDDPSNSEYADMERELSEVIALTEELLATAKQNEIPAPPNAAAASPTLSIHNDNQVLDSSSDHQEKLPVGTKVQAVWSEDGEWYDATVEAYTPNGYYVSYDNWGNKEEVDPANIRSIQEGSVDALLEAERVAEATKQAIKRKIVQAASIDLQSRSLPAKLRIEADDPEDVKASKRKKIHAFKSKMPMEQLEVTQNK

SEQ ID NO: 30257 - protein, 394 aa, Chlorobium tepidum TLS
MHSLYLKPKEHRRLVSGHLWVFSNELREVPRDIAAGETVQLFTHDGRLLGAGFFNPQSLIAFRLLTRGEEQPDRDFFRRKLLEALKLREKIYPESETNAWRLVHGESDGLPGLVIDRFDRAFVLQSFSAGIDQHLPLFCELLRELFDPKAIVVRNESPLRELEGLPLYRETVLGESSDMHQEIRDSGISYRVNILEGQKTGFFLDQRENRRHIRKYAAGADVLDVYTNDGGFALNAMHAGAKSTTMVDISQEALQRAEQNARTNGFGNFSIVAADAFETLGQLRHENHTFDLVILDPPSFTKSRKTVPTALKAYTKLNRLGLQLVRNEGYLATASCSHHVSEEDFLAAIHLGAMQAGKHLRLISRAAQPPDHPVLLAMPETSYLKFACFYVTNL

SEQ ID NO: 30258 - protein, 384 aa, Vitis vinifera
MDPHQHQPIGQADETSPPPSNTATTSCRCCGGPTTCPPPPAWSDISPPPPYRPIRAPAINLPPSNSQQAIILAPPRRPPLSLRPIFSKSPSSESRPDDIRHFHDSDSGKNFLGFVVSLSESIRSHKISDPCHQSPILNSILSILQSLIDWVDEIPPVQQSSRYGNLSFRVWQSRLFDNSEQLMLQFLPDDLRSATVELVPYFADSFGNSSRIDYGTGHETNFAAWLYCLARLGLLKEEDYQALVSRVFVKYLELMRKLQFVYCLEPAGSHGVWGLDDYHFLPFIFGSSQLIDHKYMKPKSIHNQDILDNFSKEYMYISCIAFVKQVKKGLFAGHSPLLDDISGVANWNKVNSGMLKMYKAEVLEKVPIMQHFLFGWLIKWYDHC

SEQ ID NO: 30259 - protein, 144 aa, Physcomitrella patens subsp. patens
PRSEETSSDSVPNFSNSEYHVLAVDDSIIDRKVIERLLKTSSYKVTTVNSALRALEYLGLSESCSSSGKPNVRAVNLIMTDYCMPGMTGYDLLKIVKAETSAFKELPVIVMSSENDSNRIKSCLAEGAEDFLIKPVQLEDVQRL

SEQ ID NO: 30260 - protein, 394 aa, Thiomicrospira crunogena XCL-2
MSRLSNRVNRVKPSLTLVISAKAAELKRAGKDIISLGAGEPDFDTPDHIKAAGISAIQNGQTRYTAVDGTPELKSAIIEKFKRDNNLTYEMDQILVSSGGKQSFYNLCQGLLNDGDEVVIPAPYWVSYPDMALLAGGKPIIIEADIEQGFKITPEQLKAAITPKTKMVVINSPSNPTGAVYTASELKALGEVLQQHPDIVIASDDMYEHILLDDTPFTNILEVCPELTDRTVVMNGVSKAYSMTGWRIGYAGGPKDLIAAMRKVQSQSTSNPCSISQAASTEALNGPQDCIDTMLTEFKKRHEFVVERINEIPGFKCIPAAGAFYAFMDVKAAMKQKGYQTDTDFATAILEEVEVAAVPGSGFGAEGHLRISFATSMVNLINALDRIDSFMKDA

SEQ ID NO: 30261 - protein, 1375 aa, Arabidopsis thaliana
MQPLQNFGSATPPPPISNSSTSCNKTCGGISIPFPFGIGGKDCYLNGWYEVICNTTTSDSNTTVPLLSMINREVVNISLPDSNEPYGLVQIKGPVTSLGCSSNTSEGPQNSLPVLNVTGKGSPYFLTDENRLVAVGCGIKALMTDTESEILGCESSCEHRKSGEEVTNLICTGYRCCQARLPVGRPQAITVNIENSSGGEETCKVAFLTDKRYSPSNVTEPEQFHNNGYVVLELGWYFATSNSRFKSLLGCTNMSRKGSGFSDDNCSCEYDYFSGMSYRNCYCDYGYTGNPYLRGGCVGILIGLSGLVFFVGLFWLFKLIKKRRNINRSKKFFKRNGGLLLKQQLTTKDGNVEMSKIFSSKELRKATDNFSIDRVLGQGGQGTVYKGMLVDGSIVAVKRSKVVDEDKMEEFINEIVLLSQINHRNIVKLLGCCLETEVPILVYEYIPNGDLFKRLHDESDDYTMTWEVRLRIAIEIAGALTYMHSAASFPIFHRDIKTTNILLDEKYRAKVSDFGTSRSVTLDQTHLTTLVAGTFGYMDPEYFLSSQYTHKSDVYSFGVVLVELITGEKPLSRVRSEEGRGLATHFLEAMKENRVIDIIDIRIKDESKLEQVMAVAKLARKCLNRKGKNRPNMKEVSNELERIRSSPEDLDVHCYLNPWYEVVCNSTNSVPFLSRINRELVNISLNGVVHIKAPVTSSGCSTGTSQPLTPPPLNVAGQGSPYFLTDKNLLVAVGCKFKAVMAGITSQITSCESSCNERNSSSQEGRNKICNGYKCCQTRIPEGQPQVISVDIEIPQGNNTTGEGGCRVAFLTSDKYSSLNVTEPEKFHGHGYAAVELGWFFDTSDSRDTQPISCKNASDTTPYTSDTRCSCSYGYFSGFSYRDCYCNSPGYKGNPFLPGGCVDVDECKLDIGRNQCKDQSCVNLPGWFDCQPKKPEQLKRVIQGKIELDFITILSVLQNVLLFTVWFFGGAGVLIGSALLLFAFGIFGLYKFVQKRRKLIRMRKFFRRNGGMLLKQQLARKEGNVEMSRIFSSHELEKATDNFNKNRVLGQGGQGTVYKGMLVDGRIVAVKRSKAVDEDRVEEFINEVVVLAQINHRNIVKLLGCCLETEVPVLVYEFVPNGDLCKRLHDESDDYTMTWEVRLHIAIEIAGALSYLHSAASFPIYHRDIKTTNILLDERNRAKVSDFGTSRSVTIDQTHLTTQVAGTFGYVDPEYFQSSKFTEKSDVYSFGVVLVELLTGEKPSSRVRSEENRGLAAHFVEAVKENRVLDIVDDRIKDECNMDQVMSVANLARRCLNRKGKKRPNMREVSIELEMIRSSHYDSGIHIEDDDEEDDQAMELNFNDTWEVGATAPASMFNNASPTSDAEPLVPLRTW

SEQ ID NO: 30262 - protein, 363 aa, Photobacterium phosphoreum
MTLSTAQEIIEDIHQGKMVILMDDEDRENEGDLIIASDKVTPEAINFMATYGRGLICLTLNKERCLQLELPMMVKSNTDKFATPFTISIEAASGVTTGISVNDRARTVQAAIAATATAKDIVMPGHIFPLMAQDGGVLARAGHTEAGCDVARLAGLEPSSVIVEILNDDGTMARRPQLEVFAKKHGLKLGTVADLIEYRNKYETMIERISECKLNTEFGEFDMITYRDKINHQIHYALQKGNIEPNSQTLVRVHLQDTFKDILQTGSTRWTLPAAMERISSENGVLVIVTKQEDPEMVISKIQNLALENKETPVVNSQSRQVGLGSQILSDLGIRKMRLLSSSSHLYHSLSGFGLEIVEYVCS

SEQ ID NO: 30263 - protein, 155 aa, Photobacterium phosphoreum
MKVIEGAIVAPNAKVAIVIARFNSFINESLLSGALDTLKRQGQVSYDNITIIRCPGAYELPLVAQLTAKSDRYDAIIALGSVIRGGTHFEYVASECNKGLAQVALDYNIPVAFGVLTVDYLEQAIERAGTKAGNKGAEAALMLLEMVNILAQVES

SEQ ID NO: 30264 - protein, 528 aa, Cryphonectria parasitica
MMHDQASNGGDQAAPIKTQETPVPMSSSNSVPIMNAPAPLLRPAIPGSRGGARTPRLGLAIPPSPNVKPVTNPAGGAPQPQKASRPAPPTLSIATPMGSIGPPQEQQPGRSVAQPGHSASSGSEISAAHSRTDSFGGRGSNPTSAGSQYSNLSFVSQYGLGGKPHGTPDPQSAAGSMYSNASEGGLDMSRQDSMHGLERAMDEVTLERVRNLDVEDLDDEGWRIASQENRIVELGGLGEGAGGAVTRCQLKGGKTIFALKVITTNPDPDVKKQILREINFNKGCASDHICRYYGGFLEPSTATISIAMEFCEGGSLDSIYKEVKRLGGRTGEKVLGKIAEGVLQGLTYLEAKRILHRDIKPSNILLCRNGEVKLCDFGVSGDFGTKGEANTFIGTSYYMAPERITGQTYTITSDVWSTGVTLLEVAQHRFPFPADGTEMQPRAGLIDLLTYIVQQPIPKLKDEPEAGIFWSDNFKHFIESCLEKNPKRRGMPWKMLEHPWMIELKTKRVNMGKYLSQVWGWDDPKHSK

SEQ ID NO: 30265 - protein, 267 aa, Kineococcus radiotolerans SRS30216
MSGTLALVGAGVMGQTLLGGLLRAGREPGGVLVVDRRPGRARELHERFGVRVVDDVGAVAGASTVLLAVKPQDLLALLDSLAGHLAPDALVVSLAAGVTTAAIEARLPAGTAVVRVMPNTPSLVDEGMAGLSGGSACGDEQLAEAEDLLRSCGRTVVLAEKHLDAVTALSGSGPAYVFYVVEAMVEAGVLLGLPRATATELVVQTVVGAGAMLRETGQHPTVLREQVTSPAGTTAAALRQLDDSGVRAALVAAVEAAAARSRQLSGS

SEQ ID NO: 30266 - protein, 174 aa, Glycine max
MASASPTATLLKPNPPPPRKPTITTASVSPPRRHTLPRRDFLSLTAAAASTLILTQSIQFVAPSPASAAEDEEYVKDTSAVISKVRTTLSMERTDPNVADTVAELREASNSWVAKYRKEKALLGKASFRDMYAALNAVSGHYVSFGPTAPIPAKRKARILEEMETAEKALSRGR

SEQ ID NO: 30267 - protein, 549 aa, Vigna unguiculata
MATHNYKVFSCFNRKFTITEPKPPPDVQKAFSEFSDGASSMSAEHLLRFLAEHQGEVDCTVSDSEQILQQSRKEDGETGFDLHDFFHFLQENDLNVPLKSQVHHDMNAPISHYFIYTGHNSYLTGNQLSSDCSDAPIIKALQRGVRVIELDLWPNSNKDDIDVVHGRTLTTPVSLLRCLKSIKEYAFVKSQYPLVITLEDHLTPDLQAKVAKMATQVFGELLHYPQTDSLTEFPSPESLKGRILISTKPPKEFLESSEKESAEEVSSLRENADEQRTDNKRAPEYKRLITIHAGKPKGEIQDELKAAGNVRRLSLSEQALEKASESYGADVVRFTHNNILRVYPKGTRLNSSNYKPHIGWTYGAQMVAFNMQGHGKSLWYMQGMFRSNGGCGYVKKPNFLIQKGPQDEVFDPKIALPVKKTLKVKVYLGKGWSLDFSPSDFDSYSPPDFYVKVCIVGVPADMIKKKTSVISNNWFPVWNEEFDFPLTVPELALLGIEVREDDKHQKDDFGGQTCLPVSELKSGFRSVPLYDEKGDKYKSVKLLMRFQFR

SEQ ID NO: 30268 - protein, 372 aa, Thermotoga sp. KOL6
MKEMSILIVEDDDITREAMAQYLKLSGFEVLETNSGEKAIDFSNMIDVALIDVKLPGMSGIEVVSEIKSRNPSCVVFVITAYDDKETIKKCVEAGADDFIKKPVNLELLKLKITHAIRNKIFHLYRSSYMKSLKERLEIIEKTAEEFFTEYEDFMFEILDILNMLSEYRDVETYRHTERVGWLSGRIAEVMGLDELLVTEIQFSAPLHDIGKIGIPDKVLLKPGILTPEEFEIMKQHTIIGFRILSRSSSPILQMGAEISLTHHERWNGSGYPRGLKRKEIPISGLIVAVADSFDAMVTERPYKRAKTLDEAFQEIELLSGKLYSPEVVEAFLSLEKEIREVYRREKDENSSHQSGGSHKSSSGEGLEGLRE

SEQ ID NO: 30269 - protein, 427 aa, Xanthobacter autotrophicus Py2
MNSRAFPAPEDPSATPESSHLPLTPVGAGEDPYLERVRDPIRTLPESGIVEVMNYGRDRPGMIPLWAGEGDVATPPFICEAAATALHAGETFYTWQRGLPELRGAIARYMARTYGIPENPDRYFVTGSGMQAIHIALAMTAGAGDEVIIPSPSWPNAAAAAQKAGARPVYVPFAYGKDGFSLDHERLAQAITPRTRAIFLNTPANPTGFVATHDDLRAVLALARRHGLWIIADEIYGRFYYGDEPRAPSFHDVMDEGDHILFVQTFSKNWAMTGWRVGWIEADPRLGQVIENLIQYSTSGVAAFMQRGAVAALDQGEDFVAQQIARARKGRDRVADALIATGKVDLVKPPGAFYLFFGIAGRSDVRSLGLTLVDEANVGLAPGTAFGPGGEGFMRLCFARGDAQLAEASRRLVAWLTGDGQTGAGAA

SEQ ID NO: 30270 - protein, 302 aa, Psychrobacter arcticus 273-4
MKDWLLVISSQRGCAIDRANANFLLLYLNFKYLNFNRNESFMSTPFNDVAAQHADFNTKARQRIQQTEFMMSAPTFRLCPADIGLEVAFAGRSNAGKSSAINALTNQRQLARSSKTPGRTQMINFFNVGDADRRLVDLPGYGYAAVPLEMKKEWQVELEEYLVSRSSLAGLVLMTDIRHPLKFFDEQMLRWAKDGELPVHILLTKADKLKYGASKNALLNTRKRLKQLGLNCSIQLFSALRKEGLDELAGVMGNWYEYQLEANKIIESSFALLEGSELEDAIEKDAVQKDKNLKDSAQKESK

SEQ ID NO: 30271 - protein, 527 aa, Oryza sativa Japonica Group
MATLLSKLLALPQQWQLLLLLLLLPIASLLLVIGRNTGGRRRRRHLRLPPGPARLPVLGNLLQLGALPHRSLRDLARRHGPVMMLRLGAVPAVVVSSPEAAQEVLRTHDADCCSRPSSPGPMRLSYGYKDVAFAPYDAYGRAARRLFVAELFSAPRVQAAWRARQDQVEKLIGKLTRPEPEPVELNDHIFALTDGIIGAVAFGSIYGTERFAGGGRKRFHHLLDDVMDMLASFSAEDFFPNAAAARLFDHLTGLVAHRERVFQQLDAFFEMVIEQHLDSDSSNAGGGGGNLVGALIGLWKQGKQYGDRRFTRENVKAIIFDAFIGGIGTSSVTILWAMAELMRSPRVMRKVQAEIRATVGDRDGGGMVQPDDLPRLAYLKMVVKETLRLHPPATLLMPRETMRDVRIGGYEVAARTRVMVNAWAIGRDAARWEEAEVFDPDRFEAKRVEFNGGHFELLPFGSGRRICPGIAMGAANVEFTLANLLHCFDWALPVGMAPEELSMEESGGLVLHRKAPLVLVPTRYIQL

SEQ ID NO: 30272 - protein, 304 aa, Oryza sativa Japonica Group
MDGGRQSRRERSASLPKPRAPQLVKGIIHSSLPRLVFAPTDYASRLAPMADLHPPEPDTNGGSAAAAAAAAAAAAPLGDPAAEASGAQAAAGPPYSKRRRRPSVRLGDIGVHSAAAADVPLPQRRHHKTSSSSHPRPPRRAHPEDALDPLNHSSAAAHRRGQKPAQRRPRTAWIPAAPGTDGYEEEAEHYYDDADQSDSAAAAAARARVSGSRDASGDESDGVADWGLPNGRLPGSMGYGGVKAWLDGLGLSRYAPVFEIHEVDDEVLPLLTLEDLKDMGIGAVGSRRKLYAAIQKLQRSDSVS

SEQ ID NO: 30273 - protein, 282 aa, Oryza sativa
MAAAAKTAVQPAVVVGGGRVGQALLSMGPPGADVLVGRGEKVPEDAPGPILVCTRNDDLDAVLDATPRSRWRVQWKKSPDLFLEWVVLGKLNGMLDPWFESKGLVDANQVLAYFAVSKLGEPPVDGITDTNPEGLTAAFGNWAPAVATRLQNGGLTCKVLEKEAFQKQMLEKLIWISAFMLVGARHPGATVGAVEKEYRSEVASLIAELASAAAEERGLTFDAGIEERLCAYSRAVAHFPTAVKEFKWRNGWFYSLTEKALAQGKPDPCPFHAAWLKEIKVI

SEQ ID NO: 30274 - protein, 173 aa, Aster yellows phytoplasma
MTVLNKKIKLELKEKLVMVNRVCKVTKGRRYFSFTALVIKGDENGVVGYGLGKAKEAQDAIYKAAEKAKNKLLKINIIKGGTIPHEQEAKYCGARVFICPVPEGTGIIAGGAVRSVLEAVGLTNVLSKSKGSSNKINCIKATILALSKLRTVNTIALERGISISKILNGSDNY

SEQ ID NO: 30275 - protein, 502 aa, Arabidopsis thaliana
MAISFLCFCLITLASLIFFAKKIKHLKWNLPPSPPKFPVIGNLHQIGELPHRSLQHLAERYGPVMLLHFGFVPVTVVSSREAAEEVLRTHDLDCCSRPKLVGTRLLSRNFKDVCFTPYGNEWKARRKFALRELFCLKKVQSFRHIREEECNFLVKQLSESAVNRSPVDLSKSLFWLTASIFFRVALGQNFHESNFIDKEKIEELVFEAETALASFTCSDFFPVAGLGWLVDWFSGQHKRLNDVFYKLDALFQHVIDDHLNPGRSKEHEDIIDSMLDAIHKEGKDSSLELIIDHIKGFLANIFLAGIDTGALTMIWAMTELVKNPKLIKKVQGEIREQLGSNKARITEEDIDKVPYLKMVIKETFRLHPAAPLILPRETMAHIKVQGYDIPPKRRILVNVSAIGRDPKLWTNPEEFDPERFMDSSVDYRGQHYELLPFGSGRRICPGMPMGIAAVELGLLNLLYFFDWKLPDGMTHKDIDTEEAGTLTIVKKVPLQLVPVRVQ

SEQ ID NO: 30276 - protein, 578 aa, Oryza sativa Japonica Group
MAATAAAAHTLLHLAAPRKPSAGPPLPPATLRLPSRRLARLTASCSSGSGNNSAADFPNPNGILVAPPSAAAVAAASSHIDVDVATEADLRENGFRSTRRTKLVCTVGPATCGADELEALAVGGMNVARVNMCHGDREWHRGVIRAVRRLNEEKGFAVAVMMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 30277 - protein, 391 aa, Polaromonas sp. JS666
MTTILERTPKLETKLPAVGTTIFTVMSTLAAEKGAVNLGQGFPDFECDPQLVNAVTDAMTKGLNQYPPMTGVPVLREAISAKVAKLYGHRYNANTEITITAGATQAIITVILAVVHPGDEVIVLEPCYDSYVPNIELAGGKVVRVPLTPGTFRPDFDKIAAAITPQTRAIIINSPHNPSATVWTQADMLKLQDILAPTDVLLISDEVYEHMVFDAAKGCMHQSASLFPGLAARAFIVSSFGKTYHVTGWKVGYVAAPAALTAEFRKVHQFNVFTVNTPVQYGLAAYMADPKPYLDLPAFYERKRDLFRAGLAKTRFKLLPSEGTYFQCVDISEVSDLNEADFCQWLTTEIGVAAIPLSAFYGNGFDQRVVRFCFAKKDETLHSALGRLAKL

SEQ ID NO: 30278 - protein, 792 aa, Acinetobacter sp. ADP1
MEARVIGLEKLGKHDVELVGGKNSSLGEMISHLSNAGVSVPGGFATTAAAYREFLDQSGLNAKIQAELAKLNVEDVNALAESGAKIRQWIIETPLTPEFEKEVREAFNALSNGNPEIAVAVRSSATAEDLPDASFAGQQETFLNIRGIDNVLIAIKEVFASLYNDRAIAYRVHQGFAHDVVALSAGVQRMVRSETGAAGVMFTLDTESGFRDVVFITASYGLGEMVVQGAVNPDEFYLSKPLLKNGKHSVLRRNLGSKHQKMIYGEEGSAGKSVVVVDVEKQDRQQFALNDHELQELAKQAMIIEDHYGAPMDIEWAKDGDDGQIYIVQARPETVKSRQNVGTMERYLLKQRGTVVCEGRSIGQRIGSGKVRIVSSIKEMDKVQDGDVLVSDMTDPDWEPVMKRAAAIVTNRGGRTCHAAIIARELGVPAIVGCGNATEVLTDGQEVTVSCAEGDTGFIYEGSLDFEVQRNSIESMPKLPFKIMMNVGNPDRAFDFAQIPNEGIGLARLEFIINRMIGVHPKALLNIDSLPRETRAAVLARTAGYTSPIDFYVEKLVEGISTLAAAFAEKPVIVRMSDFKSNEYANLIGGKLYEPEEENPMLGFRGASRYVSDNFRDCFELECRALKKARDEMGLTNIQIMIPFVRTVAEAKRVIELLALNGLKRGENGLKVIMMCELPTNALLAEQFLEHFDGFSIGSNDLTQLTLGLDRDSGIVSHLFDERDPAVKALLSMAIHACRKAGKYVGICGQGPSDHPDLAKWLMEQGIESVSLNPDSVLDTWFFLAEEKTKQA

SEQ ID NO: 30279 - protein, 344 aa, Glycine max
MSCFSCFVSRGKDVRRVEIDNGSRSATSSSEGKGKKSVSNKGTSTAAASFGFRELAEATRGFKEVNLLGEGGFGRVYKGRLSTGEYVAVKQLIHDGRQGFHEFVTEVLMLSLLHDSNLVKLIGYCTDGDQRLLVYEYMPMGSLEDHLFDPHPDKEPLSWSTRMKIAVGAARGLEYLHCKADPPVIYRDLKSANILLDNEFNPKLSDFGLAKLGPVGDNTHVSTRVMGTYGYCAPEYAMSGKLTLKSDIYSFGVLLLELITGRRAIDTNRRPGEQNLVSWSRQFFSDRKKFVQMIDPLLQENFPLRCLNQAMAITAMCIQEQPKFRPLIGDIVVALEYLASHSNP

SEQ ID NO: 30280 - protein, 497 aa, Mycobacterium smegmatis str. MC2 155
MTAMTQTAPAATAATTNWDKLFIGGQWVEPSSSEIIEVFSPATGEKVGQAPLATKADVDAACAAARKAFDEGPWPRMTPQEREAVLAKATALIEESADEFKTLLKLETGQPQTIVDMMQYGAAMSTLQFYASAADKFAWKDIRDGIYGQTLVLKEPVGVVGAVVAWNVPFFLAANKLGPALLAGCTIVLKPAAETPLTTNLMAQKFLEAGLPEGVLSVVPGGPETGRALTDNPALDKFTFTGSSAVGKEIGKIAAEKLKPCTLELGGKSAAIILEDADLDSTLPMLLFSGLMNSGQACVGQTRILAPRSRYDEVVEKVAAGVAAMQVGVPDDPAAMVGPLISEKQRERVEGYIKKGIEEGARLVTGGGRPEGLDSGWFVQPTVFADVDNSMTIAQEEIFGPVLVVIPFEDEDDAVRIANDSVYGLAGSVYTTDHAKGVEIASKVRTGTYGINMYAFDPGAPFGGYKNSGIGRECGPEGIAGYCESKSVLLPFGYTPE

SEQ ID NO: 30281 - protein, 141 aa, Triticum aestivum
MAELEAGSISMAAGGGGRLRNALSGMLCAFALLLIGVLAFSIRLFSVIKYESVIHEFDPYFNYRVTQFLSKSGIYEFWNWFDDRTWYPLGRVIGGTVYPGLTLTAGTIWWLLNSLNIPLSVETVCVFTAPIFSANASWATY

SEQ ID NO: 30282 - protein, 197 aa, Zea mays
MVKSKAIRVHELGGPEVLRWEEVEVGEPGEGEIRIRTTAVGVNFIDIYFRKGVYAAPTMPFTPGMEAVGVVTAVGPGLTGRKVGDVVAYAGNPMGSYAQEQILPAAVAVPVPPSVDHKQAASVMLKGMTAHVLLRRVFKSRAVEGAVEGSDDNGDIRARIRNAAASARVREGNGNQGWVIGTVEQTRDCSLSVNRGN

SEQ ID NO: 30283 - protein, 448 aa, Picea sitchensis
MAKFGLLSLLLCSCIVIIAASPAQARTASTVSKLSKTDPLNTLLLQGFNWESAKGSSSWYNVLKGIVEDAADAGITDVWFPPPSQSLAPEGYLPQRLYDLNSSKYGSEQELRNAVDAFHQKGIGCVGDMVINHRSGTKQDDKGMWCVFEGGKGDGRLDWGPWAVTVNDKPFACGSGQADTGGDYAAAPDIDHTNPKIQQDLSEWMNWLKSNVGFDGWRFDFAKGYAGNLLAVYLKNTSPKFAVGEVWDDMSYSDGRLAYDQGAHRQRLVDWVHSTGDGAAAFDFTTKGILQEAVKSNELWRLKDSNGKPAGMIGVLPQKAVTFIDNHDTGSTQNIWPFPSDKLLQGYAYILTHPGIPTIFYDHFVDGNLKKEIQNLSAIRKRNNINANSNCRIITAESDLYMAAIDEKIVVKIGSRYDVGNLAPPSPEFRVVASGNGYCVWEKNSSPR

SEQ ID NO: 30284 - protein, 391 aa, Solibacter usitatus Ellin6076
MSYLSIRDLDLKGKRVFIRVDFNVPLQKNDQGAMEITSDKRIKASLPTIQYALEHGAAVILASHLGRPKGKPNTEMSLKPVAARLEQVLKVPVKMAPDCVGPEVQAMLPAPGEVLLLENLRFHAEEEKNDPAFAAQLAALCEIYVNDAFGSAHRAHASTEGMVKLVKQAAAGLLMEKELKYLGMATTNPPRPCVAILGGAKVSDKIEVIQNLGKVVDRLLIGGAMAYTFLKAQGLPTGKSLVEDDKVELAKSLLAELGERLMLPVDHVVVSEIAAGAPFEVVDTIPEGKIAVDIGPKTVEAFSKVVAGAKTVIWNGPMGIFEKPPFDQGTVAVAKAVAGSGATSIVGGGDSEKAIKAAGVSDKISHVSTGGGASLEFLAGDTLPGVAALDR

SEQ ID NO: 30285 - protein, 146 aa, Triticum aestivum
MEEKARQLLLLAAVAGVGAAFGALSTAAVFSFLSRAKRREGYVRKLLESNGGAGGPHAGSTGPGARLHDSSDLLSDEVVAEQLTRNIQFFGVESQKKVTESFVVVVGLGGVGSHAASMLLRSGVGRLLLVDFDQVSLSSLNRHAVA

SEQ ID NO: 30286 - protein, 359 aa, Solibacter usitatus Ellin6076
MRLPRRELPFALLLSALAILAYLLLWPVPIDPIVWRPATVPPISDRYAPNDRLSGIRSLPEAGPGPESVAIDRDGRLYTGLQDGRVMRMLPDGSGRETFVQTGGRPLGMKFDTAGNLVVGDAFRGLLSISPERKISVLADSVNGERMLFTNDLAIAADGSVWFSDASRRFDQHHWTLDFLEGRATGRLLHYEPRTGQVTVVLDRLMFANGVALGPGDQYVLVNETLAARITRYWLAGAKAGQSDVFAGALPGYPDNLTYNDRGVFWVALPSARNSALEALSGLPWLRKVVQRLPARWREQRLERMAWVLGFNTEGQVVHSLQDSRGRYGPVTSVTERSGRLYFGSIDTAAIGWAPAPRN

SEQ ID NO: 30287 - protein, 556 aa, Magnetococcus sp. MC-1
MGKTFDSNRLKELTGHANPLEILNDPYMNKGVAFTEEERDLFHLRGLLPPRVQTMEAQLGRALDNFRCKPNDLEKYIFLTGLQERNETLFYRLVMTNIEEMLPIIYTPTVGKACQTYGHIFRRPQGMFISINDKGRIAELLGNWVHKDVRVIVVTDGSRILGLGDLGAHGMGIPVGKLALYTALAGIPPIHCLPVTLDMGTNNEALRNDPLYVGLPQPRVTGEIYDEMIEEFVLAVQEQFPRAMIQFEDFSNDNAFRLLEKYQDRICTFNDDIQGTAAVALAGILGALRITEADLCTQRYLFMGAGSAGFGIADLILRAMEQKGIPREQGLKQFRFMDSRGLVTRSRTDLRGRKSEFVCDDPPLTDLQQVVERFMPTVLIGVSGQPGVFHQGVVEAMARINPRPIIFALSNPTSKAECSAQQCYQWSDGRAIFASGSPFEPVTIAGQTFVSGQGNNAYCFPGIGLGVIMCEASRVTEEMFLVAAQTLAQMTAQSDLDQGRVYPSMQDIRAISLNIALAVVDLASKRGLAQRDLGEHAKERISAWMCNANYRNYANR

SEQ ID NO: 30288 - protein, 337 aa, Magnetococcus sp. MC-1
MKAILVTGGAGYIGSHVCKVLSQSGFLPITYDNLSEGHPWAVRWGPLVVGGLDDGAKLAGLFAQYQPQAVIHLAGRAYVGESMTDPALYYRNNVQAALVLLECMRQYGCKNIIFSSSCATYGEHRQMPITEAMSQHPINPYGRSKLMFEWMLQDYQVYGLQSVALRYFNASGADLEGEIGEQHQPEPHIIPRLLEAARKGSPFTIYGTDYESEDGTCVRDYIHVSDLAQAHLLALQWLWRGGESRAFNLGNGQGFSIRQLIKVAETVTGKSIAVQLGARRPGDPAVLVGSAEKAREELGWQPQYGTLEIILTSAWRWMQRRQDPPVVDGIEESIGEP

SEQ ID NO: 30289 - protein, 590 aa, Cryptococcus neoformans var. neoformans JEC21
MAPTPIPVPAARPAASHLSKSPPTTNEYTSTAPIPALPPQHTDEGVPSHLYQGLPAHLLIDDAQGQKVPDYLRMILMSKVYAAPLNLKETPLTYAANLSARLGNEIWIKREDLQPVFSFKIRGAYNMMASLSDEEKKKGVITCSAGNHAQGVALSGHALNIPAIVVMPVSTPSIKWRNVQRLGATVLLHGRDFDEAKAECLRLEKEKGLTFVPPYDNPYVVAGQGTVAMEICRQVTDADQIDGIFASVGGGGLAAGIAAYMKRVAKPSVGIYGVETVDGDAMDRSLKAGKRVLLDEVGPFADGTAVRLVGEEPFRVCKNFLDDVVLVNNDEICAAIKDVFEETRSVPEPSGALALAGLKAHIIRNNLQGAGKRFVAVISGGNMNFGRLRFVAERADVGERREVLMSVRVPEKPGSFLKFHSLLGSRAVTEFSYRHSNNSTGYIICSFLLSSSSSSSSGPSPEARANEIHEMVESFKQHGIEAVDLSEDEFAKSHVRHLVGGRSAVEHERIFRFEFPERPGALGNFLKGMKVEWNISMFHYRNHGADVGKVLIGVQVPSQDNPAFDEFLEKLGYPYVEETHNEVYTMFLRS

SEQ ID NO: 30290 - protein, 442 aa, Kineococcus radiotolerans SRS30216
MALMVVGLSHRTASLEVLERAAFDARGAEEVLRALTASPHVEEAFVLSTCNRVELYCDVSRFHGGVADIGDVLCRRIGRGLDELGDQLYVHYEDAGVEHLFKVACGLDSMAVGESQILGQLRLALRGLHERGLAGGTLDRLLQTALRVGKRAHSETRLDAAGASLVDTAMTRAAGVVGELPGRRALVVGAGAMSALVATTLARAGLDVVVANRTPDRAQRLAAAVGGRATGLDDLRAEVAAADLVVSCTGAVGHVLDVATVASALLDRPERPLFLADLALPRDVHPDVATLRGAHLVDLEGLGADLASSAVAQDLRAVRAIVAEEVAAHAASLRAADVAPTVVALRAQARHVVEVEMRRLASRVDLDDTTRSEVDRAVHRIVEKLLHTPTVRVKELAEAPGGVGYAAALRALFDLEVTAQGGALPGDAPLSGTVADAVGHVS

SEQ ID NO: 30291 - protein, 803 aa, Arabidopsis thaliana
MELEPNKSLSADMPSLLSRSSEAFNGGTGYRSSSDLSMFSSSLPTLFHEKLNMTDSDSWLSFDESSPNLNKLVIGNSEKDSLEDVEPDALEILLPEDENELLPGLIDELNFTGLPDELDDLEECDVFCTGGGMELDVESQDNHAVDASGMQISDRGAANAFVPRKRPNTAGRVSVEHPNGEHPSRTLFVRNINSSVEDSELSALFEPFGEIRSLYTACKSRGFVMISYYDIRAAHAAMRALQNTLLRKRTLDIHFSIPKENPSEKDMNQGTLVIFNVDTTVSNDELLQLFGAYGEIREIRETPNRRFHRFIEYYDVRDAETALKALNRSEIGGKCIKLELSRPGGARRLSVPSQSQDLERTEVTNFYNQVGSHVANSPPGNWPIGSPVKGSPSHAFTRPHGLGMVRPVNSDNMPGLASILPAHPSSFHGFSPVSNDQGLLNHSNQTILNKGLMHNISYGQPHSLPEHITGGISNSMRFIAPHSSGFGTSSDHRYRWGSPPQHMNYPGYTGVSSSSSSTERPFTVRHGFPFAERQASLLGKYQHHVGSAPSSIHFNTQMNCYTGSPEIPLGFSDMGINRNYNSAHGKANLGVSLPGNSSEQDFTGFGMSSMPTVPFGGSRGLQSVRPEPFAEQGRIHNHESHNQNQFIDGGRYHIDLDRIASGDEIRTTLIIKNIPNKYTYKMLVAEIDEKHKGDYDFLCLPTDFKNKCNMGHAFINMVSPLHIVPFQQTFNGKIWEKFNSGKVASLAYAEIQGKSALASYMQTPSSMKEQKQLFPEVSYHDDGQDANDHVCLSDTKSHFCFCF

SEQ ID NO: 30292 - protein, 310 aa, Staphylococcus arlettae
GFGRIGRLAFRRIQNVDGIDVVAVNDLTDDEMLAHLLKYDTMQGRFTGEVEVENDGFRVNGQEVKSFSEPDPNKLPWGDLDIDVVLERTGLFADKDKASAHIDAGAKKVLISAPASGDLKTIVFNTNHNELDGSETVVSGASCTTNSLAPVAKVLNDDFGLVEGLMTTIHAYTGDQSTQDAPHRKGDKRRARAAAENIIPNSTGAAKAIGLVIPEIDGKLDGGAQRVPVATGSLTELTVVLDKEVTVEDVNSAMKNASNESFGYTEDEIVSSDVIGMTYGSLFDATQTRVMTVGNQQMVKVAAWYDNEMS

SEQ ID NO: 30293 - protein, 271 aa, Zymomonas mobilis
MSHIHFIGSGQMSEAMIRAIIKHKTASASDITAYDIRPEREKELHDNYGITTFAKPKKNIETLQKADIVVIGVRPQDDLKAVTADIAQNAKEKALIVSIVAGVTLAQFEDLLGKERAIARIIPNTLTDTGLGYSGVVINNQADKALTEKFVSGFGKCLFLEESLIDIFTGFGVCGPNYVYYFIEALVDAGVLAGLPRDIAWETTMENLVGSVKMLEISGKHPRQLLDINNSPAGVGMNSLFALNQSDFTAGLQNSVLAAVKRTTELGQKKD

SEQ ID NO: 30294 - protein, 310 aa, Staphylococcus auricularis
GFGRIGRLAFRRIQNVEGIDVVAVNDLTDDDMLAHLLKYDTMQGRFTSEVEIVEGGFRVNGQEVKSFDEPDPSKLPWKDLDIDVVLECTGLFTDKEKAEAHIDAGAKKVLISAPAKGDVKTVVYNTNHDTLDGTETVVSGASCTTNSLAPVAKVLNDEFGLVEGFMTTIHAYTGDQNTQDAPHKKGDKRRARAAAQNIIPNSTGAAKAIGKVIPEIDGKLDGGAQRVPVATGSLTELTVVLEKDVSIEDVNNAMKNASTESFGYTDDEIVSSDVIGMTYGSLFDATQTRVMTVGDHQLIKVAAWYDNEMS

SEQ ID NO: 30295 - protein, 311 aa, Staphylococcus caprae
GFGRIGRLAFRRIQDVEGLKVVAVNDLTDDEMLAHLLKYDTMQGRFTGEVEVIEGGFRVNGKEIKSFDEPDANKLPWGDLDIDVVLECTGFYTDKDKAQAHIDAGAKKVLISAPATGDLKTIVFNTNHDELDGSETVVSGASCTTNSLAPVAKVLNDEFGLVEGLMTTIHAYTGDQNTQDAPHRKGDKRRARAAAENIIPNSTGAAKAIGKVIPEIDGKLDGGAQRVPVATGSLTELTVVLEKQDVTADQVNEAMKQASDESFGYTEDEIVSSDVVGITYGSLFDATQTRVMTVGDRQLVKVAAWYDNEMS

SEQ ID NO: 30296 - protein, 251 aa, Psychrobacter arcticus 273-4
MNMSSQQAHKHVATNLTNNEVGVQNLTENWQQVKAQVAQACEQALRAPSSVTLLAVSKTKSAEMVATLARQGQYDFGENYLQEAIEKIQLLHEQVECEHIVWHYIGSIQRNKTRDIAEHFDWVQTLERDIIAKRLNNQRPDGMLPLNVLIQINIDNEDTKSGCLPEQLPELIIDIKNYKRLQLRGLMIIPAKANTNAFKRTKQLFDDIKRTHPELSQWDTLSMGMSDDMTDAIANGSTMVRVGTAIFGARA

SEQ ID NO: 30297 - protein, 319 aa, Oryza sativa Japonica Group
MTMNLMSPVLVSFRDRTNEFHAAVESVARYSSVGGPIVWLFTTLLLVSLMLASLPISSAAVAKRTSVFDDPTVEIQELTAVIKKDITALNSAVVDLQVLCNSQNESGNLSKDTTNHSTTVVDNLKNRLMSATKEFKEVLTMRTENLKVHENRRQMFSSSAANNASNPFVRQRPLVTRDGPESSVPPAPWASDSATTPLFQRKKTNGDHGASSSSSQPFMQQQLVQQDSYMQSRAEALQNVESTIHELSNIFTQLATMVSQQGELAIRIDENMDDTLANVEGAQGQLLKYLNSISSNRWLMMKIFFVLMVFLMIFIFFVA

SEQ ID NO: 30298 - protein, 189 aa, Ustilago maydis 521
MLDPVADSTDPMSMLLCGDAPTSSAGHNAAACPTAGNPSCYNCGQQGHISSQCGMEAQPKTCYKCSETGHISRECPTNPAPAAGGPGGECYKCGQHGHIARACPTAGGSSRGGFGGARSGGRSCYNCGGVGHLSRECTSPAGAAAGGQRCYNCNESGHISRECPKPQTKSCYRCGDEGHLSAACPQIAA

SEQ ID NO: 30299 - protein, 251 aa, Zymomonas mobilis
MRFQDKIVVITGGGNGMGKAAAERFSSEGAIVVLADWQIKDAEEVAASLPKDRAWPYKIDVSDPDAVKKMMDDIAAKYGKIDVLVNNAGILIPGKIMDASIEDWKKISSVNIDGVIYCAKFAMPYLVKSKGCIVNTASVSGLGGDWGMVYYCTTKGAVVNFTRALALDSGVNGVRVNSVCPCIVKTKMAANWPESAQAQFKNRVSLGRIPEAEEIASVMAFLASDDARFITGVNLPVDGGATASDGQPHLG

SEQ ID NO: 30300 - protein, 402 aa, Debaryomyces hansenii CBS767
MSYYNRNSSSSSSVLPSSRKTHSEKHKQILKQLLKEHANKTCVDCKTATHPRWASWSLGCFMCIRCSGIHRSMGTHISKVKSVDLDAWTDEQVELMIKWGNEKCNIYWESKLPDGYVPDQLKIDNFIRTKYDLKKWVSSTTIPNPLSIKASGSQNAGLTTAQHTSESHKSKNSDLGSADLLSGHSSKIEPHGSLLDDDFGSFTSSPSPKASTPVTSTRNTTALKSNQQRSNSTTQQKLPTENTSDGAGIQSAQSTGGSFSNTRPDLKKSILSLYSSPKSSSSSFIQPQHNSQAQPNMQASVNSLSNSLSGLDFNNSNTSTNFNVSSIPSRTSLASQSASQQPHARPEAQTTNWNNEWTDANESTASLNNQWPNSGSSGTHGAKTTSLNSTNLDDDLFKNVWS

SEQ ID NO: 30301 - protein, 384 aa, Porphyra yezoensis
MMKRIPAILVLEDGAYYKGWSFQQDKQEITIGEVVFNTGMTGYQEIITDPSYFHQIVAFTYPEIGNTGINNQDIESHSISIKGLIAKNICKISSSWREQQSLVKYLSSNNIPFIFGIDTRSLTQYLRQFGTMNGCISTDNLNHSYLKQKICEIPSMQGLDLIPHVTTRNVYPWDEKSFPNWYLTDNIRVHRVIQLKVIVIDFGVKLNILRRLATLGCQITVVPAHTPLKDILAYQPDGILLSNGPGDPSAVHYGIQTVTNLLDYNVPIFGICMGHQILNLALKAKTFKLKFGHRGINHPSGLNQQVEITSQNHGFAVELTSVFESPVRVTHFNLNDTTIAGTGHNQSPYFSVQYHPESSPGPHDADYLFESFIEIMTKSKNKVS

SEQ ID NO: 30302 - protein, 416 aa, Colwellia psychrerythraea 34H
MTNQIIIPTTGDKITFVDGKLSVPNNPIIPFIEGDGIGVDVTPPMLKVVNAAVAKAYAGEREIAWMEVYAGEKATKMYDSETWLPEETLAILQEYKVSIKGPLTTPVGGGMSSLNVAIRQMLDLYVCQRPVQWFTGVPSPVKRPSEVDMVIFRENTEDIYAGIEYKAGSDKAKAVIEFLTEEMGASNIRFTDNCGIGIKPVSKEGSQRLVRQAIQYAIDNDKDSVTLVHKGNIMKFTEGAFKDWGYELARDEFGASLIDGGPWSTLTNPNTGNEIIIKDVIADAMLQQILLRPAEYSVIATLNLNGDYLSDALAAQVGGIGIAPGANLGDEVAVFEATHGTAPKYAGKNKVNPGSVILSAEMMLRHMGWLEAADLLLKGMSGAIKAKTVTYDFERLMDDATLVSCSAFGDCIIDHM

SEQ ID NO: 30303 - protein, 298 aa, Klebsiella pneumoniae
MNMANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMIARFNETGRSQVLAKRMPGDLSEYSVIQTKEPMVAEGQVARIVEFIEKPDEPQTLDSDLMAVGRYVLSADIWAELERTEPGAWGRIQLTDAIAELAKKQSVDAMLMTGESYDCGKKMGYMQAFVTYGMRNLKEGTKFRESIKKLLA

SEQ ID NO: 30304 - protein, 221 aa, Ralstonia metallidurans CH34
MRVLLVEDDRMIGQVVQDALKDASCAADWVEDGQAALDALDRQHYDVVLLDLGLPRKSGHAVLTSLRARGSAVPVLILTARDALEDRIGGLDAGADDYLVKPFEMDELLARMRAVWRRRSGLASSVLGNGRVSLDLSTRQATLTGGAPQQLTNREFALLQALLARPGAILSRAELEERIYGWGDEVESNAVEFLIHGLRRKLGSTIIRNVRGVGWQVPKEG

SEQ ID NO: 30305 - protein, 911 aa, Magnetococcus sp. MC-1
MSSPVGHKAQDAGLNLTQQSEAFSHAVIEGLSGIFYLFDGQARLIRWNKNFATVTGYDDTTLQGKQALDFIAPCDQALVSSRIQQVFSEGHATIEAALRAHNGQETPYFLSGSLVMIDEQPYLSGTGIDISARKRVEETLQAEQQLTQASLDALPDTYFLFHPETGKALRWNRAFREISGFSDRQIGALPAPSSYYSQSDLSIMATALEQLRKTGTAKLEINLICHNGQTIPFEYAISSLAHQGQNLIISIGRDISERRLAENQLRESEQKFLRLFKEVSIPLVLVNKQGMVTHINDRFTTLLGYSMADIPDLDSWWQRAYPDPRYRAWVKETWTLAVQKAMADGQDIAPLEYQVTCKNGEQREIQISGVTFGEDTLATLIDVTERSRAAKTLQQERDFADSLIHTAQTIILVLDTQGRIMRINPYMEELSGYTLAEVQGKDWWNTFLPQQDHATLRALFAKAVGHIHNQGHVNPILTKDGRLLEIEWYNKTLIDSHDEVMGLLSIGYDITHKRALEAENREALARAESANQAKSEFLAIMSHEIRTPLNVLLGMGDLLHESLLTEEQTGQLELLIKAGKHLVVLIDDILDLSKIEFGGLTLTREPLQPHRLFLLICDIVRLQAQEKGLTFNCDIPTELPPWVLGDEGRLRQIMINLLHNAIKFTQQGHVTLKIAYQPAGSLFSITISDSGIGIAAKHLNHIFDKFSQADSSISRRYGGTGLGLAIARNLVTLMGGHLTVESCVNQGSHFQLTLELPPTQPPIRPSTVALTDLATLKPLNILLAEDSLDNQTLFLTYLKPTPWQVEIAMDGQQAVERVKQGGLDLVLMDLQMPIMDGYRATQAIRHWEQTSGTTPLPILALSAHALRAEQQKSLEAGCNAHLVKPIKKKALIEAIHQNMARTTAKVSHETP

SEQ ID NO: 30306 - protein, 563 aa, Candida glabrata
MSEITLGRYLFERLNQVDVKTIFGLPGDFNLSLLDKIYEVEGMRWAGNANELNAAYAADGYARIKGMSCIITTFGVGELSALNGIAGSYAEHVGVLHVVGVPSISSQAKQLLLHHTLGNGDFTVFHRMSANISETTAMVTDIATAPAEIDRCIRTTYITQRPVYLGLPANLVDLKVPAKLLETPIDLSLKPNDPEAETEVVDTVLELIKAAKNPVILADACASRHDVKAETKKLIDATQFPSFVTPMGKGSIDEQHPRFGGVYVGTLSRPEVKEAVESADLILSVGALLSDFNTGSFSYSYKTKNIVEFHSDYIKIRNATFPGVQMKFALQKLLNAVPEAIKGYKPVPVPARVPENKSCDPATPLKQEWMWNQVSKFLQEGDVVITETGTSAFGINQTPFPNNAYGISQVLWGSIGFTTGACLGAAFAAEEIDPKKRVILFIGDGSLQLTVQEISTMIRWGLKPYLFVLNNDGYTIERLIHGEKAGYNDIQNWDHLALLPTFGAKDYENHRVATTGEWDKLTQDKEFNKNSKIRMIEVMLPVMDAPTSLIEQAKLTASTNAKQ

SEQ ID NO: 30307 - protein, 714 aa, Arabidopsis thaliana
MKRRRLFFSVLLSILTLFINGPLITTAQSPPSSSTSCNRICGGIEIPFPFGIGRRDCFLNDWYEVVCNSTTSGKSLAPFLYKINRELVSITLRSSIDSSYGVVHIKSPVTSSGCSQRPVKPLPLNLTGKGSPFFITDSNRLVSVGCQAKIPADRPQVIGVDLESSGGNTTQGGNCKVAFLTNETYSPANVTEPEQFYTNGFTVIELGWYFDTSDSRLTNPVGCVNLTETGIYTSAPSCVCEYGNFSGFGYSNCYCNQIGYRGNPYLPGGCIDIDECEEGKGLSSCGELTCVNVPGSWRCELNGVGKIKPLFPGLVLGFPLLFLVLGIWGLIKFVKKRRKIIRKRMFFKRNGGLLLKQQLTTRGGNVQSSKIFSSKELEKATDNFNMNRVLGQGGQGTVYKGMLVDGRIVAVKRSKVLDEDKVEEFINEVGVLSQINHRNIVKLMGCCLETEVPILVYEHIPNGDLFKRLHHDSDDYTMTWDVRLRISVEIAGALAYLHSAASTPVYHRDVKTTNILLDEKYRAKVSDFGTSRSINVDQTHLTTLVAGTFGYLDPEYFQTSQFTDKSDVYSFGVVLVELITGEKPFSVMRPEENRGLVSHFNEAMKQNRVLDIVDSRIKEGCTLEQVLAVAKLARRCLSLKGKKRPNMREVSVELERIRSSPEDLELHIEEEDEEECAMEINMDDSWSVDMTAPASLFDLSPKLDVEPLVPQRTW

SEQ ID NO: 30308 - protein, 296 aa, Picea sitchensis
MSWIDWESEAYPSNEDLLMVPVFALFFPSVRFFLDRFIFERLARRFVPGSAKGASQDQQDECNKRHIKFKESAWKCIYYLSAEIIALAVTYNEPWFTNTGNFWVGPGDQVWPDQNVKTKLKALYMYTAGFYTYGIFALIFWETRRSDFGVSMAHHVATVILIILSYLLRFARVGSIVLALHDASDVFLEVGKMFKYNGSNIVPSISFLLFVISWVVLRLIYYPFWILWSTSYEVLHTLDKKKHQKEGPIYYYVFNSLLYCLLFIHIYWWVLMYRVLVKQVKARGKLGEDVRSDSEG

SEQ ID NO: 30309 - protein, 219 aa, Glycine max
MDGDSSWSARLSSASRRYQSALQSRSDMFMGFDENDGDDDIREEFLCPFCSEYFDIVGLCCHIDEEHPMEAKNGVCPVCALRVGVDMVAHITLQHGSIFKMQRKRKSRKGGSYSTLSLLRKELREGNLQSLFGGSSCIVSSSNADPLLSSFILPLANEHASSQPHLHTETRSSKKCSDETVSTRNVETSTLSVKDKEEKEKRCEFVQGLLLSTILDDNL

SEQ ID NO: 30310 - protein, 395 aa, Glycine max
LMPLSPSVSPQPMGSLGSFGPSVGMASHQQQSLYGFGSGSNSYGRGYLPNQGSSFGGTSISNLNDRSFASLENSRRQGRPTASLCNCNGTLDILSEQNRGPRASKLKNQISTENNSVDSSKNSASTAKFQNESLNRSDFATDYKDAKFFVIKSYSEDNVHKSIKYGVWASTPNGNRKLDDAYRQAMEKQDACPIFLFFSVNASAQFCGVAEMVGPVNFDKSVDFWQQDKWSGQFPVKWHIIKDVPNSQFRHIVLENNDNKPVTNSRDTQEVKLTQGVEMLTIFKNYETDVSILDDFDFYEDRQKAMQERKARQQSSMVATGLVGENEHRSSANTTGDFMKQMSKSFALVVRLDENNKEVVVADRDSLVSHGHGPIGNVVKPDDGQSVTASSTQTS

SEQ ID NO: 30311 - protein, 531 aa, Triticum aestivum
  misc_feature (440)..(440): Xaa can be any naturally occurring amino acid
MELLFELLLTAAATLLVAFLLAKLLSGTNDPPRRDRAAGPADVIAEEKAEEAEEERAIEVDEVGAWADVAAPPLAEGWVEVEKAPATVAEGMTEWVAAEEEGVPATLLAPELFLGTVSREQKEEGEVGKKHCDLTAAAEAAVEAKPRDLGDEAAPSEVLDVELEEETAQQHDLGAEGAPSEVPDAGVQKQEVHAMEAVEVKQLHLDVGAAPAEVIDAGPEEKAEGVQAAEVIPRELASETPPADVLDVVIGKQEEQVIEASQHELAPVVAPRVIPDAAAKDEEMKEQSVEEVVQVHNKEEARREAGTDDQQEKLVPKDEPALEKSDDLNVSQEDSSNDKVDVQLPEKDTTLLGMPEDEARASMEFEEWEGIERSEVEKRFGAAAAFAASDAGAAALSKLNSDVQLQLQGLLKVAVDGPCYDAAQPLTLRPSSRAKWVSWXQKLGNMHPEIAMEKYMNLLSEFVPGWMGDTTPSTEKHKVDVDSEGAVLTMTTHTSDPQISQGNEGSTSIDEGPLTSPPNPEKGQSSDVPAE

SEQ ID NO: 30312 - protein, 244 aa, Prochlorococcus marinus str. MIT 9515
MLRNFRSDIEIIRERDPAARGILEIFLCYPGFQSIVMHRLTHKLWLLKVPLIPRILSHLNRLFTGIEIHPGAKIGKKVFIDHGMGVVIGETAEIGNNCLLYQGVTLGGTGKSHGKRHPTLMENVVVGAGAKVLGSIIVGPNTRIGAGSVVVRNVEENSTVVGIPGRVVHQSGVKVNPLAHSALPDAEASVIKNLMDRIDQLENQVLRLNKTLRTLVKTESMDITKIGDAQNIKDKEIIEFLGDN

SEQ ID NO: 30313 - protein, 328 aa, Deinococcus radiodurans R1
MTQRPDNTTPDNANPKRQRVPGVRPSGPGLTTNRALLLGGLALAAVLLFQSVRVVPAGFVGVGFNKLSGQLSTLQEGVHFVVPGIQQLNLYDARLQEVTLSNTARDGDEGAINARSKEGLGITAEVTVQYRIDRNQAAALHKQLGHDYQRTVIRPQVRSKVRDAIGQFGAAELISTERKQVEESVTKALREEFSRNNLMLDSVLLRELKIPDSVAKAIEEKQTAEQQVAVQKNRLQQAQISAQQAVVDAEGKAKAAVATARGEAEALSLRGKALRENPQLIQLTVAEKLSPGIQTVMLPADGNFLLNLQDLGRAANANGQNGNGAGQP

SEQ ID NO: 30314 - protein, 574 aa, Schizosaccharomyces pombe
MPPSSSITQEDKATIRKYIPKSTNKIIAAAVVKLYVAYPDPNKWNYTGLCGALVLSYDTTAKCCWFKLVDVVNNSGIIWDQELYQNMDYRQDRTFFHSFELDKCLAGFSFANETDAQKFYKKVLDKGCHPESIENPVLSFITRKGSSRHAPNNSNIQPPSAAPPVPGKENYNAVGSKSPNEPELLNSLDPSLIDSLMKMGISQDQIAENADFVKAYLNESAGTPTSTSAPPIPPSIPSSRPPERVPSVSAPAPPPIPPPSNGTVSSPPNSPPRPIAPVSMNPAINSTSKPPLPPPSSRVSAAALAANKKRPPPPPPPSRRNRGKPPIGNGSSNSSLPPPPPPPRSNAAGSIPLPPQGRSAPPPPPPRSAPSTGRQPPPLSSSRAVSNPPAPPPAIPGRSAPALPPLGNASRTSTPPVPTPPSLPPSAPPSLPPSAPPSLPMGAPAAPPLPPSAPIAPPLPAGMPAAPPLPPAAPAPPPAPAPAPAAPVASIAELPQQDGRANLMASIRASGGMDLLKSRKVSASPSVASTKTSNPPVEAPPSNNLMDALASALNQRKTKVAQSDEEDEDDDEWD

SEQ ID NO: 30315 - protein, 363 aa, Mycobacterium sp. MCS
MPKPPRVPPQRVVRAVDRVRAGLQRLHRTTAPGNIALLELATGAWTTAALYTAAKLGIADQLAAGPKHSNDVADRVGADHDGVHRLMRALASCGVLTQHADGSFTLTRVGDALRSDAEGSLRDMVLFIGHPIRWADWGNLEHSVRTGKTAFAELHGRPFFEYLETDPEFAAVFNNAMTASSGVTDEVALGAYDFSGFKLVVDVGGGHGSVLSTILRSAPQARGVLYDLPEVVADAGPTFEAAGVADRASATGGSFMDSVPDGGDLYVMKNIIHDWSDDDAATILRNIRTAMAPGGKLLLIEMVLPERANAFIGLLLDLEMLVAAGGRERTRGEYANLLSRTGFRLTHVTGTVTPLSILEAEPV

SEQ ID NO: 30316 - protein, 286 aa, Mycobacterium sp. MCS
MDAAERKDDPLVLREVAEQLAAEAAAFVRTRRGEVFDASSGDAAAGAVAAKSTPTDPVTVVDTETERLLRDRLAEYRPGEQILGEEEGGAADAGAGQLTWVLDPIDGTVNFVYGIEAYAVSVAVQRDGESVAGAVADVAADAVYSAARGRGAQLRRHGTVRPLRCNAPERLAMALLGTGFAYAPERRRRQAELLVELMPRVRDVRRIGSCALDLCMVAAGQLDAYYEDGVNVWDWAAGALVAAEAGAVVSLPTPAGAVGGAGLVIAAAPGIAAELDEALRSVGVRT

SEQ ID NO: 30317 - protein, 310 aa, Staphylococcus chromogenes
GFGRIGRLAFRRIQDVENIEVVAVNDLTDDDMLAHLLKYDTMQGRFTEEVDVIDGGFRVNGKEVKSFSEPEPSKLPWKDLDVDVVLECTGFFTSKEKAEAHIEAGAKKVLISAPGTGDLKTIVYNVNHEELDGSETVVSGASCTTNSLAPVAKTLNDEFGIVEGLMTTIHAYTGDQNTQDSPHRKGDKRRARAAAENIIPNSTGAAKAIGLVIPEIDGKLDGGAQRVPVATGSLTELTVVLDKEVSVEDVNNAMKNATNESFGYTEDEIVSSDVVGMTFGALFDATQTRVMTVGDRQLVKVAAWYDNEMS

SEQ ID NO: 30318 - protein, 232 aa, Legionella pneumophila str. Lens
MIEFQLKKLYYSYKIFNENIMTKQAIIIGISGPSASGKSLLANTIVNELGSEQVVVISEDAYYKDNGHLPFTEREKINYDHPDSFDHALLYEHLRQLRVGNTVQIPIYSHSKHLRLPETRAVGQHAIIVLEGILLFSDKALREIMDIRIFMSTPLDVCLTRRLKRDVVERHRSFESVIHQYETTVRPMYMQFIEPSSRYADIIVPRGGENRIAIEMIQAKMRELLASHTRGS

SEQ ID NO: 30319 - protein, 348 aa, Prochlorococcus marinus str. MIT 9515
MSTVIVAGGAGYIGSHTVRELQNEGFEPIVLDNLVYGHRNIVEDVLAVPLVIGQVGDKPLLKKLFSGEHPLTRGKDIKGIMHFAAYAYVGESVVDPAKYYKNNLVETISLLEALLEDSKKRNSQPIPIVFSSSCATYGIPLEAEIPIIERTPQNPINPYGRSKLMMEKILIDYHKAYELPVSILRYFNAAGADINGDIGEDHNPETHLIPLVLEALSDKEGFLKVNGIDYPTFDGTCIRDYVHVSDLAKAHVLALNKIMNDKSLSIYNLGNGKGYSIMEVIDASKKVTGKEIRILQSKRRQGDPPVLISSPEKAKKELLWKPEFQDLESIIRTAWNWYLFKKKFNSNK

SEQ ID NO: 30320 - protein, 158 aa, Prochlorococcus marinus str. MIT 9515
MAIFEGSFTTASNLKVGIVVARFNDLITNKILSGCLDCLKRHGLDTSETSETLDIVWVPGSFELPIAAKTLLKKSNYDVLISLGAVIRGETSHYDVVISEASKGIAQVSYDYDVPIIFGVLTTDSMQQALERAGIKNNLGWNYALQAIEMGSLIKNLN

SEQ ID NO: 30321 - protein, 310 aa, Staphylococcus epidermidis
GFGRIGRLAFRRIQDVEGLEVVAVNDLTDDDMLAHLLKYDTMQGRFTGEVEVIDGGFRVNGKEVKSFDEPDASKLPWKDLDIDVVLECTGFYTDKDKAQAHVDAGAKKVLISAPATGDLKTIVYNTNHDELDGSETVVSGASCTTNSLAPVAKVLSDEFGLVEGLMTTIHAYTGDQNTQDAPHRRGDKRRARAAAENIIPNSTGAAKAIGKVIPEIDGKLDGGAQRVPVATGSLTELTVVLEKDVTVEQVNEAMKQASDESFGYTEDEIVSSDVVGMTYGSLFDATQTRVMAVGGRQLVKVAAWYDNEMS

SEQ ID NO: 30322 - protein, 310 aa, Staphylococcus gallinarum
GFGRIGRLAFRRIQNVEGIDVVAVNDLTDDEMLAHLLKYDTMQGRFTGEVEVEKDGFRVNGQEVKSFSEPDPSKLPWGDLDIDVVLECTGFFADKTKAEAHINAGAKKVLISAPATGDLKTIVFNTNHNELDGTETVVSGASCTTNSLAPVAKVLNDDFGLVEGLMTTIHAYTGDQNTQDAPHAKGDKRRARAAAENIIPNSTGAAKAIGKVIPEIDGKLDGGAQRVPVATGSLTELTVVLEKDVSVEDVNNAMKNASNESFGYTEDEIVSSDVVGITYGPLFDATQTRVMTVGDRQLVKVAAWYDNEMS

SEQ ID NO: 30323 - protein, 310 aa, Arabidopsis thaliana
MFNFAALLQLPYTLCRGAEKGSILFSLSQSQLKNLTDDKHGIGSSWRQDKGNSSISMQIDLEKQLDCWRENPSWTDQIPVVKVGIPKGSLCNLKAEVNVGLPPDAVYNIVIDPDNRRVFKNIKEVMSRKVLVDDGLRQVVEVEQAALWRFLWWSGTISVHVLVDQDRADHSMKFKQVKSGFMKRFEGSWQVKPLFVDEHMCDRLKPKTLEEYNRCTGGKGRIGSKVTLDQLIQPAIVPPPPISWYLRGITAKTTEMLIHDLLAETARIRAAGVMEDGHSPDEQRIGTPGDIKERWSAHRRTSRRRRNDLC

SEQ ID NO: 30324 - protein, 214 aa, Legionella pneumophila str. Lens
MPGYSDNIIRNASGLIPMVIEQTSRGERSYDIYSRLLKERIIFLLGEVEDHMANLVVAQLLFLESENPEKDISLYINSPGGVVTAGLAIYDTMQFIKPDVSTLCIGQAASAAALLLCAGADGKRFCLPNSRVMIHQPLGGYRGQATDIEIHARETLAVRERLNNIMAKHTKKTPDQIMRDTERDNFMSATQAMEYGLIDKVLYDRQIAGHSTDL

SEQ ID NO: 30325 - protein, 310 aa, Staphylococcus hominis
GFGRIGRLAFRRIQDVEGIEVVAVNDLTDDEMLAHLLKYDTMQGRFNGDVEVVEGGFRVNGKEVKSFEEPDASKLPWGDLDIDVVLECTGFYTEKEKAEAHINAGAKKVLISAPAKGDVKTIVFNTNHKDLDGSETVVSGASCTTNSLAPVAKVLNDEFGIVEGLMTTIHAYTGDQMTQDGPHRKGDKRRARAAAQNIVPNSTGAAKAIGKVIPEIDGKLDGGAQRVPVATGSLTEVTVVLEKEVTVEDVNKAMKNAADESFGYTEDEIVSSDVAGMNFGSLFDATQTRVISVGDKQLVKVAAWYDNEMS

SEQ ID NO: 30326 - protein, 328 aa, Burkholderia sp. 383
MLHVAADHARGAPHTKEETQMETIAVIGSNMVDLVTYVARMPARGETLEAPNFELGCGGKGANQAVAAARLGARVVMVTKVGDDVFADNTIRNFEREGIDTTHVRKVAGVPSGVAPIFVEPDSSNSILIVKGANRHLTPADIDAAAPQLAECALIVLQLEIELDTVYHAIAFGARHGIPVLLNPAPAVADLDFERIRTVEFFVPNETELAIVSGMPVDSRDSAARAAEALVARGLKHVLVTLGSNGSLLVSRDGVRHVPGVPVDARDTTGAGDAYIGCFARCYAASRDALDAMRYASAYAAHSVTGLGTQKSYADTATFERFLRDAGV

SEQ ID NO: 30327 - protein, 568 aa, Oryza sativa
MASSALICDTEQWKGLQAHVGAIQKTHLRDLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLQWSGLSLLLGPDAVAKHMIAVSTNLELVEKFGIDPKNAFAFWDWVGGRYSVCSAVGVLPLSLQYGFPIVQKFLEGAASIDKHFRSSSFEKNIPVLLGLLSVWNVSFLGYPARAILPYSQALEKFAPHIQQLSMESNGKGVSIDGVQLPFESGEIDFGEPGTNGQHSFYQLIHQGRVIPCDFIGVVKSQQPVYLKGEIVSNHDELMSNFFAQPDALAYGKTPEQLHSEKVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLAVEPSTPYNTTTMPKV

SEQ ID NO: 30328 - protein, 311 aa, Staphylococcus intermedius
GFGRIGRLAFRRIQNVEGIEVVAINDLTDAKMLAHLLKYDTTQGRFDGEVEVHDGFFKVNGKEVKVLANRNPEELPWGELGVDIVLECTGFFTAQDKAELHIKAGAKKVVISAPATGDMKTIVYNVNHETLDGTETVISGASCTTNCLAPMAKVLEDKFGVVEGLMTTIHAYTGDQNTLDAPHPKGDFRRARAAAENIIPNTTGAAKAIGEVLPSLKGKLDGAAQRVPVPTGSLTELVTVLNKKVTVDEVNAAMEAASDPETFGYTNDAIVSSDIKGMTFGSLFDETQTKVLTVGDQQLVKTAAWYDNEMS

SEQ ID NO: 30329 - protein, 149 aa, Triticum aestivum
SSAVAVLGYSLILTLLRIFNVKEGATRVMFAAPILAFVTTHILYLNFYELDYGWNMKVCVAMGVVQIVAWAIWAGVTHPPSRLKLWVVVFGGALAMLLEVFDFPPYKGYADAHSLWHASTVPLTYLWWSFIKDDAEFRTSTLTLVKKAR

SEQ ID NO: 30330 - protein, 115 aa, Polaromonas sp. JS666
MTHKGSCHCGRIAFEVDGEPTKVLACNCSICSRKGSLLWFVQRDTLRLLTPDENASTYLFNKHAIRHRFCPTCGIHPYGEGADPSGQRMAAVNVRCLEDIDLAALAVEHFDGRSY

SEQ ID NO: 30331 - protein, 285 aa, Burkholderia sp. 383
MTAYAFRLLNVFAESTFGGNPLCVFEDARGMDDATMRALAVQFNLSETTFVLPSERAHARVRIFTPGYEMAFAGHPTLGTAHVVRDLLGTGNDLALEFKAGVVDVSAHDDVWTFTAPHAGMPKTAPCELPDARIAALLGLTEDDLLAPPIWVDTGADQLLVALKDAAAVRRAQPDSACLDIWPTSSLGRKTAYVFAFDAERPGTVVSRYFFVKQGSVSEDPGTGSACANLGGWLLAMKRGLPAAFQVEQGEAVGRPCLLRLLVSASGEIGVGGRVIELGRGVVNV

SEQ ID NO: 30332 - protein, 534 aa, Arabidopsis thaliana
METPTMKPDTVLILDYGSQYTHLITRRIRSLNVFSLVISGTSSLKSITSYNPRVVILSGGPHSVHALDAPSFPEGFIEWAESNGVPVLGICYGLQLIVQKLGGVVVEGESKEYGKMEIEVKGKSEIFGSESGGEKQMVWMSHGDEAVKLPEGFEVVAQSAQGAVAALENRKKKIYGLQYHPEVTHSPKGMETLRHFLFDVCGVSADWKMEDLMEEEIKVINKTVASDEHVICALSGGVDSTVAATLVHKAIGDRLHCIFVDNGLLRYKEQERVMDTFERDLHLPVTCVDASVRFLSELKGVVDPETKRKIIGKEFINIFDQFAQELEKKYGKKPAFLVQGTLYPDVIESCPPPGTDRTHSHTIKSHHNVGGLPKDMKLKLIEPLKLLFKDEVRELGRILNVPVGFLKRHPFPGPGLAVRVLGDVTQGNALEVLRQVDEIFIQSIRDAGLYDSIWQAFAVFLPVRSVGVQGDKRTHSHVVALRAVTSQDGMTADWFNFEHKFLDDVSRKICNSVQGVNRVVLDITSKPPSTIEWE

SEQ ID NO: 30333 - protein, 162 aa, Debaryomyces hansenii CBS767
MVKYFLKASAELDNVTDLQPIDTTENPFEYTFHIQCTSCRQVHGKPVTINRFEKHEMDGSRGEASFVFRCRECKGEHSASITRTKETVTIEKTGKFVPILEIDARGVEFVEFIPDGQFECRGAETTTRFDDVDLSDGEWYDYDEKANAEVSIIDVKWEVARS

SEQ ID NO: 30334 - protein, 400 aa, Photobacterium sp. SKA34
MKAFTLPDLGEGLAESEIVQWHINIGDTVKTDQVVVTVETAKATVDVPAPYSGKIVHRYGNEGDVINIGQCLLEIDELLTNTTGVQPEKISTCSASNTSSSTTVVGNISQLDKHVDVDPIYDDVNQTVNLHSIANQHHPLIATPSARLLANKLGVNIKEITGSGSKHLIIDNDIYLAYQQQVPGTEILKGSRRNMAKNMTRSHHDVASVTITEEAHLYYWQKNDDITVNLVKAINNACHIEPALNAWFDADTMTRCLHKTVNIGIAVDSSHGLYVPVLHHAEQYHQEGIRRWIDRSAASIRSRKIDRHQLQKATITLSNYGAIAGIYATPVVTPPQVAIIGAGRIMDKVIMEGERVKTIKVLPLSITFDHRACTGGEAARFIKALVNSLESPPCDNIESS

SEQ ID NO: 30335 - protein, 404 aa, Chlorobium tepidum TLS
MFDEIEFDRIKRLPKYVFAAVNELKMAERRAGRDVIDFSMGNPDGPTPQHIVDKLVESVSKPKTHGYSVSKGIYKLRGAIGGWYRDKYNVDLDLDREVVVTMGSKEGYVHLVQAITNPGDLAIVPDPCYPIHSQAFILAGGNVHRMKLEMNEDYTLDEEAFFHNVETALRESSPKPKYLVVNFPNNPTTATVELPFYERLVELARRERFYIISDIAYAEITFDGYVTPSILQVSGAKDVAVESYTLSKTYNMAGWRMGFMVGNAKLVGALEKIKSWLDYGTFTPIQVAATIALTGDQSCVREIREVYRKRRDVLISSFANAGWDIVSPKASMFVWARIPEQMRAMGSLEFSKKLLIEGKVAVSPGIGFGTYGDEYVRVAMIENEERIRQAARNIKRFLKNNAGS

SEQ ID NO: 30336 - protein, 468 aa, Klebsiella pneumoniae
MSKQQIGVVGMAVMGRNLALNIESRGYTVSVFNRSREKTEEVIAENPGKKLVPYYTVQEFVESLETPRRILLMVKAGSGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLTLSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRTDKEGIFHTEWLE

SEQ ID NO: 30337 - protein, 239 aa, Physcomitrella patens subsp. patens
MDRYQRVEKPRPEIPINENEIRITTQGKMRNYITYATTLLQEKGASEIVLKAMGRAINKTVTIAEIIKRRIAGLHQNTSIGSTDITDLWEPLEEGLLPLETTRHVSMITITLSTKELETSSTGYQPPLPADQVKPLAEFEYDGDSPPRGDGGRGRGRGRGRGRGGCEMTTFEYDGGLDGGLVRGRGRGRGRGRGRGGYRGRGREQDAGGFDESNADGPPRDQGNDFSQETSYSGMCTFA

SEQ ID NO: 30338 - protein, 211 aa, Neisseria gonorrhoeae
MPMNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLRHRKELIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPEEN

SEQ ID NO: 30339 - protein, 123 aa, Mycobacterium smegmatis str. MC2 155
MADRIELRGLRVRGNHGVFDHERADGQDFVVDITVWMDLRPAAVSDDLADTLDYGALAQRAADIVAGTPRNLIETVSAEIADGIMTDERLHAVEVVVHKPSAPIPLTFDDVAVVARRSRRGGR

SEQ ID NO: 30340 - protein, 448 aa, Brassica napus
MATHSALAVSRIPVKPRLQSKSAIHSFPAQCSSKRLEVAAFSGLRVSSNGGEASFFDAIAAQITPKAVGTSSPVRGETVAKLKVAINGFGRIGRNFLRCWHGRKDSPLEVVVLNDSGGVKNASHLLKYDSMLGTFKADVKIVDNETISVDGKFIKVVSNRDPLKLPWAELGIDIVIEGTGVFVDGPGAGKHIQAGASKVIITAPAKGADIPTYVVGVNEQDYSHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINVEKKGLTAEDVNEAFRKAAAGPLKGVLEVCDTPLVSCDFRCSDVSTTIDSSLTMVMGDDMVKVVAWYDNEWGYSQRVVDLAHLVAAKWPGEVAAGSGDPLEDFCKTNPADEECKVYEA

SEQ ID NO: 30341 - protein, 586 aa, Prochlorococcus marinus str. MIT 9515
MALLIKKFGGTSVGDITKIKAIAQSIAQSKEAGNDIVVVVSAMGNSTDKLNKLAESISKNPNRRELDMLLSTGEQVSMALLSMSLNEYGIPAISMTGSQVGIITESIHGKARILDIKTERIKNYINQGYVVVIAGFQGSTLSHTGTTEITTLGRGGSDTSAVALSTALGAETCEIYTDVPGVLTTDPRIVSDAKLLDVISCEEMLELASVGASVLHPRAVEIARNYGIKLYVKSSQTLSKGTLLHSNIKPLALKRGGLELTKTVNSLEVLEKQIVFSISKLPDRPGIAAQIFETLSEASINVDLIIQATHDGNSNDIAFTVNQFDLTKTIEQCKLITNQLGGEYNFKTNMTKLSIQGAGIMGRPSVSADLFDTLSQANINVRLIATSEIKVSCVIDIDNIPKAIRFVGEKFKLSDKQIFINPLFEREDQPEVRGIALDKNQVQVSFRNLPDKPGVAASICLALAESNLIFDTIVQSESLTSFKTKDISFTMNKQDRARANKIFYSLTKKLSGAFVEDGPAIAKVSTVGAGMASKVGTAGKIFRALANKNINIEMIATSEIRTSCIVLEKDCDQAVNAIHSYFELDK

SEQ ID NO: 30342 - protein, 224 aa, Oryza sativa Japonica Group
MAMTGYKYQAQELMRDYLLADPLVPYTSVLVGIALCKMLNELVLTEEDLFSDRLKGPITFRNSIISTFALGVSVGYFIADLAMIFWLYPSLGGMEYIVHHTLSLVAIAYTMLSGEGQFYTYMVLISETTTPEINLRWFLDTAGLKKSSAYLVNGILMFVAWLVARILLFIYVFYHIYLHYSQVMQMHAFGYYLTFIVPSVLFVMNTMWFMKILKGVKKTLGKWS

SEQ ID NO: 30343 - protein, 595 aa, Glycine max
MEKNKVDENPEEFNYEMKWVRDSSLDHKGRVPLRASTGSWKASLFIIAIEFSERLSYFGIATSLVIYLTKVLHQDLKTAVKNVNYWSGVTTLIPLLGGFLADAYLGRYTAVIASCIVYLMGLVLLSLSWFLPGFKPCDHPSTCTEPRRIHEVGFFLGIYLISVGTGGHKPSLESSGADQFDDNNAKERSQKMSFFNWWNSGLCSGIILGVTVIVYVQDHVNWGVADIVLTGVMAVSLLIFLIGRSSYRYRTPIGSPLTPMLQVIVAAISKRKLPYPSNPTQLYEVSKSEGNSERFLAHTKKLKFLDKAAILENEGNIAEKQSPWRLATVTKVEELKLIINMIPIWVFTLPFGICASQTSTFFIKQGAIMNRNIGNNGFVVPPASIFTLAAVGMILSVTIYDKLLVPVLRKLTGNDRGISILQRIGIGMVFSVITMIVAALVEKKRLEAVEMNGPLKGSLSMSALWLAPQFMIIGFGDGFALVGLQEYFYDQVPDSMRSLGIALYLSVIGAASFLSSLLITIVDHVTGKIGKSWIGKDLNSSRLDKFYWLLAAITTLNLFMFVIFARKYNYKNVQKVAAADCYEGKSEDDGSETWV

SEQ ID NO: 30344 - protein, 616 aa, Legionella pneumophila str. Lens
MLTLRQITLSRGDKILLDKVNVSLYEKQKIGLIGHNGCGKSTLFDFLLGQLSPDTGEYLINPQLSISHLSQHIPDSNEKALDFVLAGDQQYIKLLKRLSEAEKNGDDAEVLQCHEELSHTGGYSKPAQAAVIMSGLGFSGNQQQEPVNSFSGGWRMRLNLARCLMKPADLLLLDEPTNHLDMEAIFWLERYLKQSPSTIILISHDREFLDAFVTHILHIENRNLTLYSGNYSSFEKIHAQQLALQQAMHEKQQTKIKHMMTFVTRFKAKATKAKQAQSRMKAIEKMEIIAAAQADSPFSFDFFPCPRAGNPLIQCNQVDAGYINHPPILKKIKLSLNPGDRIALLGPNGEGKSTLIKTLTADLSVLSGDIHRSPHLQIGYYAQHQLEQLDCKLSPVETLQTLSPEVREQTIRDFLGGFNFRGDMAVQSIQHFSGGEKARLALARLVWLKPNLLLLDEPTNHLDLGMRSAIELALQTYEGALILISHDRHLLKSSVDNFYLIYQGKVQPFEGDLDDYYLWLQTRNSEKESKLATSPNEYKERKSYQNKLKKLEQLIEHYQNQLRLLDKQLADVSLYEDTKQKNKLDNLLMERDIAHSSLMKTEEEWLGICHALENLE

SEQ ID NO: 30345 - protein, 592 aa, Petunia x hybrida
MMRIAVRYCLNGNPFFSFFAYSIAPRHYSTNTCSISVKGNFGVSNEFENVKCLDDAFSLFRQMVTTKPLPSAVSFSKLLKALVHMKHYSSVVSIFREIHKLRIPVDAFALSTVVNSCCLMHRTDLGFSVLAIHFKKGIPYNEVTFTTLIRGLFAENKVKDAVHLFKKLVRENICEPDEVMYGTVMDGLCKKGHTQKAFDLLRLMEQGITKPDTCIYNIVIDAFCKDGMLDGATSLLNEMKQKNIPPDIITYTSLIDGLGKLSQWEKVRTLFLEMIHLNIYPDVCTFNSVIDGLCKEGKVEDAEEIMTYMIEKGVEPNEITYNVVMDGYCLRGQMGRARRIFDSMIDKGIEPDIISYTALINGYVEKKKMDKAMQLFREISQNGLKPSIVTCSVLLRGLFEVGRTECAKIFFDEMQAAGHIPNLYTHCTLLGGYFKNGLVEEAMSHFHKLERRREDTNIQIYTAVINGLCKNGKLDKAHATFEKLPLIGLHPDVITYTAMISGYCQEGLLDEAKDMLRKMEDNGCLPDNRTYNVIVRGFFRSSKVSEMKAFLKEIAGKSFSFEAATVELLMDIIAEDPSLLNMIPEFHRDNKK

SEQ ID NO: 30346 - protein, 173 aa, Glycine max
MSSPSKRREMDLMKLMMSDYKVEMINDGMQEFYVQFHGPNDSPYHGGVWKVRVELPDAYPYKSPSIGFINKIYHPNVDEMSGSVCLDVINQTWSPMFDLVNVFEVFLPQLLLYPNPSDPLNGEAAALMMRDRPSYEQRVKEYCEKYAKPEDIVEATDYISNVKSYLLKFENFI

SEQ ID NO: 30347 - protein, 449 aa, Mycobacterium smegmatis str. MC2 155
MTVAGQAHPPTRSGAAETRRAIWNTIRGSSGNLVEWYDVYVYTVFATYFEKQFFAEGDENSTVYVYAIFAVTFLTRPIGSWFFGRFADRRGRRAALTFSVSLMALCSLVIAIVPSREVIGAAAPVILILCRLVQGFATGGEYGTSATYMSEAATRERRGFFSSFQYVTLVGGHVLAQFTLLIILTAFTTEQVHDFGWRIGFAIGGVAAIVVFWLRRTMDESLSEEQLEAIKTGKDTSSGSLGELLTRYPKALLMCFLITLGGTIAFYTYSVNAPAIVKTTYKDQAMTATWINLFGLIFLMLLQPVGGLISDKVGRKPLLLWFGFGGVIYTYILITYLPQTHSAIMSFLLVAGGYIILTGYTSINAVVKAELFPSHIRALGVGVGYALANSLVGGTAPVIYQALKERDQVPLFIGYVTVCIAISLVVYLFYLKNKSETYLDREKGAAFVR

SEQ ID NO: 30348 - protein, 568 aa, Saccharomyces cerevisiae
MPLLDKLYNIPNLRWAGNSNELNAAYAADGYSRLKGLGCLITTFGVGELSAINGVAGSYAEHVGILHIVGMPPTSAQTKQLLLHHTLGNGDFTVFHRIASDVACYTTLIIDSELCADEVDKCIKKAWIEQRPVYMGMPVNQVNLPIESARLNTPLDLQLHKNDPDVEKEVISRILSFIYKSQNPAIIVDACTSRQNLIEETKELCNRLKFPVFVTPMGKGTVNETDPQFGGVFTGSISAPEVREVVDFADFIIVIGCMLSEFSTSTFHFQYKTKNCALLYSTSVKLKNATYPDLSIKLLLQKILANLDESKLSYQPSEQPSMMVPRPYPAGNVLLRQEWVWNEISHWFQPGDIIITETGASAFGVNQTRFPVNTLGISQALWGSVGYTMGACLGAEFAVQEINKDKFPATKHRVILFMGDGAFQLTVQELSTIVKWGLTPYIFVMNNQGYSVDRFLHHRSDASYYDIQPWNYLGLLRVFGCTNYETKKIITVGEFRSMISDPNFATNDKIRMIEIMLPPRDVPQALLDRWVVEKEQSKQVQEENENSSAVNTPTPEFQPLLKKNQVGY

SEQ ID NO: 30349 - protein, 591 aa, Petunia x hybrida
MMRISVRYCLNGNPFFSFFAYSIAPRHYSTNTCSISVKGNFGVSNEFQNVKCLDDAFSLFRQMVRTKPLPSVASFSKLLKAMVHMKHYSSVVSLFREIHKLRIPVHEFILSIVVNSCCLMHRTDLGFSVLAIHFKKGIPYNEVTFTTLIRGLFAENKVKDAVHLFKKLVRENICEPNEVMYGTVMNGLCKKGHTQKAFDLLRLMEQGSTKPNTRTYTIVIDAFCKDGMLDGATSLLNEMKQKSIPPDIFTYSTLIDALCKLSQWENVRTLFLEMIHLNIYPNVCTFNSVIDGLCKEGKVEDAEEIMRYMIEKGVDPDVITYNMIIDGYGLRGQVDRAREIFDSMINKSIEPDIISYNILINGYARQKKIDEAMQVCREISQKGLKPSIVTCNVLLHGLFELGRTKSAQNFFDEMLSAGHIPDLYTHCTLLGGYFKNGLVEEAMSHFHKLERRREDTNIQIYTAVIDGLCKNGKLDKAHATFEKLPLIGLHPDVITYTAMISGYCQEGLLDEAKDMLRKMEDNGCLADNRTYNVIVRGFLRSNKVSEMKAFLEEIAGKSFSFEAATVELLMDIIAEDPSITRKMHWIKLHIA

SEQ ID NO: 30350 - protein, 599 aa, Candida albicans SC5314
MTTKEKDEFNIGSLQNSPESSTNMSPDVITTPISKWQAFKDSFKPPEQKPLASSSSSTSSLSASSPHHNDVANDYDIEKSLRPDQQGELKRELKNRHVQMIALGGSVGTGLLIGSGGALHQGGPAALLIAWGITGTMVFCIIHSLGELCVAFPVNGAFSTYANMFVDSSWAFAVGWNYAIMWLIVLPLELVAAAMCITYWNDEINPASWVAIFYVLIVVINIFGVKYYGDAEMYLTIFKIIAIVGFIILGVVLVCGGGPTHEFIGNKYWKQDGAFANGFKGVATTFVTASYSMAGSEMVGLASAEVANPQKSLPKAIRQVFWRIFLFYFLSLTFIGLLVPSNSPQLLGASGTSASPFVIAIKNGGIYALPSIFNACILLSVLSVGNSAVYGCSRTIQSLGAQGLGPKIFAYVDRKGRPLGGLVMSAIFGLLCFLSAYHDEATIFNWLLSVAGLATIFSWFNIGLCHVRFRLALRKQGRSLQELTFTALTGVWGSVYSMIFLCVVLVIQFWTALFPLGSKGKANAENFFQNYLGAVVILIFYVGHKLYTRNWKLCVKLEDIDLDSGRRSFDLDLIRAEIEEEKAANKAKPLYKRLWNYWC

SEQ ID NO: 30351 - protein, 416 aa, Streptococcus thermophilus LMG 18311
MITANDIVKANEVLKNVVERTPLDFDRYLSEKYGATIYIKKENMQKVRSFKLRGAYYAIHQLSDEDKEHGVVCASAGNHAQGVAYTCNEMKIPATIFMPVTTPLQKIGQVRFFGGKFVTIKLVGDTFDESAKAAQEYTKSEGMTFIDPFDDYNVQAGQGTVAYEIYEQAQEEGVSFDSILVPVGGGGLISGVATYIKDVAPSIEVVGVEASGARSMRAAFDHGYPVKLEKIDKFADGIAVQKVGAKTYEVARKYVDRLLGVDEGLISETLIDMYSKVGTIAEPAGAASVAALEVIKDEIKGKTIVCIISGGNNDINRMPEMEERALIYDGIKHYFVINFPQRPGALREFVNDILGPNDDITRFEYIKRANKGKGPVLIGIALSDKNDYDGLLERLSEFDPSYINLNGNETLYNMLV

SEQ ID NO: 30352 - protein, 202 aa, Saccharomyces cerevisiae YJM789
MGIIEEKTLFVTCGATVPFPKLVSCVLSDEFCQELIQYGFVRLIIQFGRNYSSEFEHLVQERGGQRESQKIPIDQFGCGDTARQYVLMNGKLKVIGFDFSTKMQSIIRDYSDLVISHAGTGSILDSLRLNKPLIVCVNDSLMDNHQQQIADKFVELGYVWSCAPTETGLIAGLRASQTEKLKPFPVSHNPSFERLLVETIYS

SEQ ID NO: 30353 - protein, 210 aa, Nostoc sp. PCC 7120
MRISTLQGQYQCIIIDPPWFYRLRSKDKTHRNRIPYQPMRTPEILALPIPDLCDAGGCVLWLWFTNNHMIEAAQCLQRWGFDLKTILTWGKVTKDGTKTHLGVGHWLRNSTEHCALAVRGNVKAFAGQTSTTGGTPTLTNQSTILHSPRREHSRKPPEFFELVEKLCPDMTKLEIFARESRDGWDCWGDQADLFDASDEEILVKAEKVLL

SEQ ID NO: 30354 - protein, 379 aa, Cytophaga hutchinsonii ATCC 33406
MAKRDYYEVLEITKSASADEIKKAYRKLAIKFHPDKNPDNPEAEEKFKEAAEAYEVLSTPEKRQRYDQYGHQAAGGGGYGGGMNMDDIFSQFGDVFGSGGSPFESFFGGGGGGRGRGVRKGSNLRIKLKLNLEEIANGCEKKIKVKRQVACDECSGTGAKNGAVQKCGTCNGTGQVKRVVNTMLGQMMSATTCPTCNGEGTTIKDKCTSCHGQGTVEKEETITIKIPAGVVDGMQLSMSGKGNMPPRGGVAGDLLILIEEIEDEQLKRDGLNIIYELYVTFFDAVFGTSVEVPTVDGKVKIKIEPGTQSGKILRLRSKGLKDVNSYQKGDQLIYVNVWTPQTLSKEEKELLATIKESENFKPNPGKNDKSFFERMKEFF

SEQ ID NO: 30355 - protein, 393 aa, Photobacterium sp. SKA34
MFKSLSPAQLDPILSLSIAYREDPRDNKIDLGVGVYRNSLGETPIMQAVQLAEQRLIKTQTTKSYVSLAGSEVFNQSMMDLLLSDTSAHSRAAAVQTPGASGALRMLADLIQVAQPDTTVWLTNPSYVNHKPVMEAAGLKVKYYPYFEPETKQVNSDAMLKEIAKAGPKDVVLLHGCCHNPTGADITFADWQAITALANKNGFMPFVDMAYLGFGDGLEQDGAGLKYMADNIEEMVVATSCSKNFGLYRERTGAAIIISNSQQEAQKAKGRVLTLARSSYTMPPDHGAALVADILNDQQLTTIWKDELYTMHSRILTLRQGLTQAIRQRGSEQFDFIEQHKGMFSVTGLTPEQILTVRKKYGIYAVGDGRINIAGLQEQHIDHLADALVSVSR

SEQ ID NO: 30356 - protein, 277 aa, Rhodopirellula baltica SH 1
MNSSDGIPIWQVDAFADRPFTGNPAAVCILERYPSDEWMQNVAMEMNLSETAFVVPTDDAGSFHLRWFTPATEVDLCGHATLAAAHTLIEQACVEAGQPIRFQTRSGELVCTPSDSRITLNFPATPPSDDVDPTVAEQTRGALGIREATVLRSKYDLLVIVEDASIVESLRPNFNTIADIDTRGVMVSAAGGSNGTDFVSRFFAPQCGINEDPVTGSAHCCLAPYWAARLGKTSVVGYQASSRGGTVNCEVAGGRVHLAGTAVTVLEGRLLSEPAEG

SEQ ID NO: 30357 - protein, 795 aa, Oryza sativa Indica Group
MEQREDHTKSSVPGKEREYNAQPKDDMFPMMKQPGTNARVADPMDDVAQHLIGNLLPDDEELLAGVIEDFDHVKLRTQVEESEEYDVFRNSGGMELDIDPLESITFGTAKASLVNGTGSSTNQYSIQNGAGTVTGEHPYGEHPSRTLFVRNINSNVEDSELRSLFEPFGDIRSMYTATKHRGFVMISYYDIRHARNAKTALQSKPLRRRKLDIHYSIPKENPSDKDMNQGTLVIFNLEPAVSNEELLQIFGAFGEVREIRETPHKRHHRFIEFYDVRAAESALRSLNKSDIAGKRVKLEPSRPGGARRSFIQHFNHEFEQDETKHNSFQIGSPSANSPPSLWSQLGSPTDENKLNALNETAFNGGMSPLGNNHLSGFSSGYPPMKSPVGKSSYWNNRADNIFHGSPTLHNSHSFPEHHGGIISASPLVSSAASSASTASGFTALTGTSFLWGNNNNLRDHGQPSSIQSQALSNSLFPNNQPQRQSNLYQNLRGSFGASEHFSQFNVGSAPSVFPFESNFGYFSDSPDTSYMRQGKFGGTGPTRVSGSLMTNFGAYPRINVASMQNGSVGFEGLLDRGRNQTVGNSGCQEDSRVQYQLDLEKIIAGKDTRTTLMIKNIPNKYDILELIGVMLCYYSVMRSTFVAHILLNFRYTSNMLLEVIDETHEGTYDFFYLPIDFKNKCNVGYAFINMASPGYIVSFFKAFAGRKWEKFNSEKVVSLAYARIQGKAALVNHFQNSSLMNEDKRCRPMLFDPKHTENNNQVKILLNGTFISMAQQDATQERHDLPENPREDNFS

SEQ ID NO: 30358 - protein, 325 aa, Oryza sativa Indica Group
MARSALDEVTDAGAFDRSPSTFRSSISRDSSARFPAVPGRYHLYVSYACPWASRCLAYLKLKGLDHAIGFTSVKPIFERTRETDDHLGWVFPATGDEEPGADPDPFNGAKTIRELYEIASPNYIGKPTVPVLWDKQLKTVVNNESSEIIRMLNTEFNEIAKNPDLELYPAHLQTSVNEINELVYDAINNGVYKCGFAKKQGPYDEAVTRLYEALDKCEEILSRQRYICGNQLTEADVRLFVTLIRFDEVYAVHFKCNKRLLREYPNLFNYTKDIYQIPGISSTVNMEHIRKHYYGSHPSINPYGIIPAGPNIDYNTPHDRERFSA

SEQ ID NO: 30359 - protein, 125 aa, Brassica napus
MAGRLSGVASRIMGGNGVVARSAASSLRQRAGMGLPVGKHIVPDKPLSVNDELMWDNGTAFPEPCIDRIADTVGKYEALGWLCGGLSFFAALGMLAVLNDKASKVPFSPRVYPYDNLRVELGGEP

SEQ ID NO: 30360 - protein, 595 aa, Prochlorococcus marinus str. MIT 9515
MLNIHKPFHQKYRPSNLDELVGQEFISITLKQALISKKIAPAYLFNGPRGTGKTSSARIFAKSLNCLSCEQPTANPCGKCELCKQIADGNALDIIEIDAASNTGVDNIREIIDGARFTPTQARWKVYVIDECHMLSTAASNALLKTIEEPPERVVFILATTNPERVINTIQSRCQKFDFKRISSNTIFHNLSEIANKESIKFEDQALKLIAKRSNGGMRDAQSLLDQLSLLPNGVTTKNVQNLLGEVSENDLINLINALIYNEPESLLISCNQLYDSGNEPHEILVGLLNITRDLLLKTLNNNYSDIFYTSIDFQNELNKFSKNISKMRIIDWHNKLKNIDYQIKTSDNPKLWLEVHLTSLIENKIEDNIVNNGQSNKETLNQKVINKDELINKTIISKNANQTESEDINKKELINNQDIQPNYENANQTESEDINKKELINNQDIQPNYEHANQTDFLKEKWELILSKLELPSTRMLLSQQAELASIDSNEVLIALSPNWENMIKSRKIIIENAVKKVCGDKVKLNFSSKKININNTAKSQEKIIKKSTSNREIQNTNFQNSNTPIEKPQKEFYDDNSKNLANFFNGEIIDLDE

SEQ ID NO: 30361 - protein, 592 aa, Petunia x hybrida
MMRIAVRYCLNGNPFFSFFAYSIAPRHYSTNTRSISVKGNFGVSNEFENVKCLDDAFSLFRQMVRTKPLPSVVSFSKLLKALVHMKHYSSVVSLFREIHKLRIPVHEFILSIVVNSCCLMHRTDLGFSVLAIHFKKGIPFNQVIFNTLLRGLFAENKVKDAVHLFKKLVRENICEPNEVMYGTVMNGLCKKGHTQKAFDLLRLMEQGSTKPNTCIYSIVIDAFCKDGMLDGATSLLNEMKQKSIPPDIFTYSTLIDALCKLSQWENVRTLFLEMIHLNIYPNVCTFNSVIDGLCKEGKVEDAEEIMRYMIEKGVDPDVITYNMIIDGYGLRGQVDRAREIFDSMINKSIEPNIISYNILINGYARQKKIDEAMQVCREISQKGLKPSIVTCNVLLHGLFELGRTKSAQNFFDEMLSAGHIPDLYTHCTLLGGYFKNGLVEEAMSHFHKLERRREDTNIQIYTAVIDGLCKNGKLDKAHATFEKLPLIGLHPDVITYTAMISGYCQEGLLDEAKDMLRKMEDNGCLADNRTYNVIVRGFLRSNKVSEMKAFLEEIAGKSFSFEAATVELLMDIIAEDPSLLNMIPEFHRDNKK

SEQ ID NO: 30362 - protein, 638 aa, Mycobacterium sp. MCS
MLEQIRGPADLQHLSQSALSELAGEIRQFLIHKVAATGGHLGPNLGVVELTLALHRVFDSPHDPLIFDTGHQAYVHKMLTGRSHEFDSLRKKDGLSGYPSRSESEHDWVESSHASAALSYADGLAKAFELTGHRNRHVVAVVGDGALTGGMCWEALNNIAAARRPVVIVVNDNGRSYAPTIGGFADHLAALRLQPGYERVLEEGRKAVRGLPVIGEFCYQCMHSVKAGIKDALSPQVMFTDLGLKYVGPIDGHDEHAVESALRHARGFNAPVIVHVVTRKGMGYAPAENDEAEQMHACGVIDVATGRATKVAAPGWTSSFSEALIDYGAKRRDIVAITAAMPGPTGLSAFRDRFPDRFFDVGIAEQHAMTSAAGLAMGGLHPVVAIYSTFLNRAFDQLMMDVALHKLPVTLVLDRSGVTGPDGASHNGMWDLSVLGIVPGMRVAAPRDGARLREELGEALDVNDAPTAIRFPKGDVGEDIPAVRRHRGVDVLAEPADGLSDDVLLVAVGPFASMALTVAERLRKQGIGVTVVDPRWVLPVPEVLTEFAAAHKLVVTVEDNGLHGGIGSSVSAALRHAEVDVPCRDVGLPQQFFDHASRGEVLADVGVTDRNISRQITGWVAALGATPADADEVSERLD

SEQ ID NO: 30363 - protein, 1022 aa, Cryptococcus neoformans var. neoformans JEC21
MPSSANAHDGAARQATVTRKRTNGSSTRDEKQYIGQWRIGRTIGKGSSGRVKIAKHAVTGKYAAIKIVPKGLILNSRMSMSEAGAKADKVLLGIEREIVIMKLIDHPNVLNLYDVWETSSELYLIMEYVPGGELFDYLVKRGRLPVSEALHYFQQIIYAVDYCHRFNICHRDLKPENLLLDKDKNIKVADFGMAAWEAGERMLETSCGSPHYASPEIVAGKAYHGSSSDIWSCGIILFALLTGRLPFDDDNIRSLLQKVKIGIFEMPDEIKDPARDLLRRMLERDPERRITMPEILSHPFFISRPPRPIPGRSLVSPPSLDEVERPVNSVDEIDPDIMGNLKTLWSGVSDEEIIKALMCKDKTWEKTIYHLLIKYRNKHLENYNMEEEEYAEARERRQARKQLQSSSSPARRKGVPAQDQSARLAPLGENETVANTPVKRPQAPTPNKASRKAPPECPTPTKQVSQARSPAGPRPANSRGNSGASNSSQAPAIVLQGATPTKELPPPHTTSSHPRPEMITTPTSPAPLSVPRVEDANLQTFLNQIADQMNRFSVRSSVASQSSTSSSAVLGSDYQACLAFAAGVTPSANPSSSVTESVIEEQGQFEDAADDQTDTEVASIHSGFTASIAPQSPLAGLGLGAPSAAVRPGLHPVAGPNQQRWSYASSAGSSYQGSSVGSYAPVESPQYIHSPLEVQAPVLQAERSAPRPPPRATRPAPPPISRPLPFSPAQQTYSEPTESLLPRDTSYVIIDNSELPSDASLSSWGSKSSGFKAHRGLDGFGMLKKKKLNVEPVPYSYGNLGSSATSPLNSPKRSWFNNLFNFKPATCTLLSRDNVANTRERVRKILLSIGVRTAVTEIDGHKALKCRLDEVRDNGNVTTKGVRFRVEFTRASTSQTYSTLVTLTQEKGAESSFRACFAELKHFMDSQPSAPTTLSLNRPSVEQSRSVNSSNLLPAHSYQQQRYSSTSADTPAGAPTSPLLSAPPIRYTASAPTTPVIESSPRFTSPYLQLPVSPQSLQMPSY

SEQ ID NO: 30364 - protein, 312 aa, Brucella suis 1330
MANDNGIKHFIDLSTVPATELRAILEDAKARKARLKAGEVERPYAGKVLAMIFEKPSTRTRVSFDVGMRQLGGETIMLTGSEMQLGRSEAIADTAKVLSRYVDAIMIRTTAHERMLELAEYATVPVINALTDDTHPCQIMADVLTYEEHRGPIKGKTFAWMGDGNNVLHSLVEAAARFDFNVNIATPKGSEPKSQYIDWARANGAGIMSTTDPEKAASGADCIVTDTWVSMGQEDHARGHNVFIPYQVNANLMAKADPKALFMHCLPAHRGEEVTDEVIDGPQSVVFDEAENRLHAQKAILAWCLQDRGLGA

SEQ ID NO: 30365 - protein, 249 aa, Pseudomonas aeruginosa UCBPP-PA14
METRRLFDQGSAAYASARPRYPDALYRHLAGLCGQRRRAWDCATGTGQAALGLAQHFGEVLASDTSAQQIEHAVIHPGIRYSVQDAEATDYPDAAFDLVCVAQAWHWFDHSRFNRELLRVLRPGGVFAAWGYGWFSIDAQIDAAIDEEYLRPIGPYWAQQNRLLWNAYRDVELPLGELPAPAFVIEQQWSLARLFDYMATWSASRLCREAQGNAFVRQALQRVAALWGEPTSTRRVRMPLALRIARKDA

SEQ ID NO: 30366 - protein, 158 aa, Oryza sativa Japonica Group
MQFLRGGGGGSGGGGAGGMAWEVLKRHFSRKRAVDVRRINPKVPKEEAVAISGRLLQIFTDHGPLTVGNTWNHAKDAGISGLNSKTHMKILLKWMTGRRIVKLNCVGTGNSKKFLYSPYSADADKSEEAAAEELSKAAASQGGKATKGQQKKRATALH

SEQ ID NO: 30367 - protein, 194 aa, Acinetobacter sp. ADP1
MLLMIDNYDSFTYNIVQYFGELNQDVKVVRNDQVTLEDIERWQPKYLVVGPGPCSPTEAGISIPAIHHFAGRIPLLGVCLGHQAIGQAFGGNIIRAKTVMHGRLSDMYHTDKGIFSNLPSPFSATRYHSLVIEQESLPECLEVTCWTNQNDGSIEEIMGVKHKTLPVEGVQFHPESILSQHGHQIFKNFLEIYA

SEQ ID NO: 30368 - protein, 362 aa, Zea mays
  misc_feature (34)..(34): Xaa can be any naturally occurring amino acid
  misc_feature (64)..(64): Xaa can be any naturally occurring amino acid
  misc_feature (82)..(82): Xaa can be any naturally occurring amino acid
MPEAEWNDEHTRIVCELFEEQVRAGNRPNTHLNXIGYRQVAAKFQQRTEPLYTKLQLKNKWDKXKNDYIPWRKLLVEGKGFXWDTAKGTFVADEEWWKKINKELPGARKFRHGGLHHEDKLNVMFDYITSNGVDPSPPAPESPKNGVNHSPPAATGLPSAPDCALNGVDHSPVTAHGLPSGPYSPMNGMDQLPLPAHDLRSVQEIPMNGVNLDGLDNNTEDNDDIYQEPVFQYTSNRKKRPISFSATKKNKKNKAETALLMQAHLYRITELAQKAQDTFKKFSSQADLVPWPSIQDVMTLVWECGARCGSNEHFIATELFVSREQREMFLTMETAEERFQWLRRKYIVKYLSGTTGTNLGTR

SEQ ID NO: 30369 - protein, 170 aa, Brassica rapa
MSRSDAQLHDVFVYGSFQEPDIVNIMLERTPEIISVTLPGFKRFRLKGRLYPCIVPSEAGEVHGKVLMGLTDKELSNLDAVEGNEYEKVTVEVVRKENSAKMIVKTYIWINKNDPDMYGEWDFEEWKQLHMPKFMETIKEIIEINKNHQGKGVEDYTQILHKNLGDAPLS

SEQ ID NO: 30370 - protein, 122 aa, Zea mays
  misc_feature (70)..(70): Xaa can be any naturally occurring amino acid
  misc_feature (83)..(83): Xaa can be any naturally occurring amino acid
  misc_feature (86)..(86): Xaa can be any naturally occurring amino acid
MYGPVHSQPSPDMATVTRTLLPAILMSLHAFVARGLSTEKADGADDVADRHTAKWMQDTRKKSPMELINXAPPINVDGRIAAXNDXSERDELGHPIENICLDLQAPNARKYCALRYDQVHHH

SEQ ID NO: 30371 - protein, 161 aa, Antirrhinum majus
LKTKKITLRSSDGEVFEVEESLALESQTIKHMIEDDCADNVIPLPNVTGKILSKVIEYCKRHVDAAAAKADDKLASTGTSDDELKAFDADFVKVDQATLFDLILAANYLNIKTLLDLTCQTVADMIKGKTPEEIRKTFNIKNDFTPEEEEEVRRENQWAFE

SEQ ID NO: 30372 - protein, 193 aa, Oryza sativa
RTRGRTRGRTRGRTRGRTRGLDLYTGFDAASTVVDVGGGVGATVAAVVSRHPHIRGINYDLPHVISEAPPFPGVEHVGGDMFASVPRGGDAILMKWILHDWSDEHCARLLKNCYDALPEHGKVVVVECVLPESSDATAREQGVFHVDMIMLAHNPGGKERYEREFRELARAAGFTGFKATYIYANAWAIEFTK

SEQ ID NO: 30373 - protein, 315 aa, Photobacterium sp. SKA34
MSASAQCNIVFFGECMVEISGSPLTKKYGGDTLNTALYLSRLTQHTDLSVHYATGLGRDELSQNMMNSWQLEGIQTHLVERIANKLPGLYMVETDGAGERHFHYWRNDAAVKYYFQFDGLNKFEIALIDNRVDAVYISGISIAILNDASRERLLKAINLFSNQGGKVIFDNNYRPQLWTTEQAQHWYAKFLPFVDIALITEDDDLLVWGNFESVQQRCLRLGCQEIVIKRGCEPCKLVHAKEGIIEESYVSAIPVPNVVDTCAAGDSFAAGYLAAHFNGESAREAADLGHRLASTVIQYSGAIIPVSAMNHLIKK

SEQ ID NO: 30374 - protein, 428 aa, Solibacter usitatus Ellin6076
MSPFARRRLARAKGYDWESFLGDCSGGAIAALIALPYGLAMASLMGLPPVLGVFTSILTAPVIAALGRNPVLIGGTASATVPFIALAVRGQGIGGAAKVSIVASVIMMGFCVIRLGRHIMRVPHAVVTGFSCGIGAMMLILQLDVILGVDSVATRSAGSTILQLGAVIERIGSTRLAPLALGVVVMVGATLSARWSSRAPAPLIGVALAIVLAKFMGFHEREIGALRAGMPPFVGFSWNPQDVLTVLPSAFALAFVSSVNILTTSRVVEHFRGRHQRMKTSDADAELGAYGIANLCAGMFGAPLSVGIPARSLAVVRCGGTTRIANLLHAVFLGAILWLGSGVVAHVPLPALAGVTAWMGLCLLDWSTWRRLPKMSRTDAAAFLVTALSVLAVNAVLAVALGCSIYGVRAAYARWVRPAAQVPDLQVD

SEQ ID NO: 30375 - protein, 714 aa, Moritella sp. PE36
MIYQAEQLSVTLLEDGIAELKYDAKGPVNKFDQATLQALTEAVKVLQTNSDIKGLIQTSGKGAFIVGADITEFLELFKLPDAELLGWLEQANAVFNAIEDLPYPTISAVNGHALGGGCEAILATDFRVADTTARIGLPETKLGIMPGFGGTVRLPRLIGADNAVEWITTGKDYKALAALKFGTVDAVVAPEKLRDAALSMVKDAIAGKLDWQSRRAQKQAPLGLNKIEATMSFSTALGMVYAKAGKHYPAPTAAVKAIEAAARMDRTGALGVEAATFIKLAKTDAAQALVGLFLSDQALKAGAKKAAKAGKVTNKAAVLGAGIMGGGIAYQSAVKGTPVIMKDINDAALDLGMATASGLLTTQLKRGRIDGTKLAKVISSITPTLSYNSIDEADIIVEAVVENPKIKAAVLAELEDNVSADTVITSNTSTIPINVLAKNLKRPEQFCGMHFFNPVHKMPLVEIIRGEKSSDETIATTVAYAAKMGKTPIVVNDCPGFFVNRVLFPYFFGFSKLIADGADFVAVDKVMEKQFGWPMGPAYLLDVVGIDTGHHAAAVMADGFPERMAKTGKDSIDVMFEATRYGQKNGVGFYTYAKDRRGRMQKTPDAKSYELLAEVASEKAEFSKDDIIARCMIPMINEVVRCLEEGIVATPGDADMALIYGIGFPPFRGGVFRYLDTMGLDKYIELADSFADLGPLYQVTDGLRQRAADGKTFY

SEQ ID NO: 30376 - protein, 136 aa, Mycobacterium sp. MCS
MSAPKVQLTDDEWRQKLSPEEFAVLRRAGTERPFTGEYTDTETKGVYQCRACGAELFRSSEKFESHCGWPSFFDPADSDAVILRPDDSLGMRRVEVVCANCHSHLGHVFEGEGYPTPTDQRYCINSISLRLVPAGG

SEQ ID NO: 30377 - protein, 300 aa, Mycobacterium smegmatis str. MC2 155
MTSTWSPDRLGDLGDKRIIVTGATNGVGLGTTRALVRAGAHVILAVRNTDLGARRAAEVGGTTTVVEVDLADMSSVRAFPGRLTAAGIDDVDILINNAGALTQRRTETVDGFETTLGTNLLGPFALTNLLLGRVRSQVIIVGSDAHRMATLRLDDMHLRRNRWTPLGAYGRAKLAVMLWGLELDRRQRVARSPVVTHLTHPGWVASNLPNVSQTRLMSVIQRGVTTVADRFAASIDEGAAPTLYCISEPIPPGSYVGVEGRLGLRGAPVLIGRSAVACDYETAAAVVDFAERETGTAIPY

SEQ ID NO: 30378 - protein, 621 aa, Citrus unshiu
MKTKVWALCLILVVHSSWLASANMEGDALHSLRSNLIDPNNVLHSWDPYPCQSLHMVSCYMQMNNSVILVDLENAALSGQLVSQLGLLKNLQYLELYSNNITGPIPSDLGNLTSLVSLDLYLNSFTGPIPDTLGKLSKLRFLRLNNNSLSGPIPMSLTNISSLQVLDLSNNRLSGVVPDNGSFSLFTPISFANNLDLCGPVTGRPCPGSPPFSPPPPFIPPPPISSPGGNSATGAIAGGVAAGAALLFAAPAIAFAWWRRRKPQEFFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSQLPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLQNNYVEAEVEQLIQVALLCTQGSPMDRPKMSEVVRMLEGDGLAERWDEWQKVEVLRQEVELAPHPNSDWIVDSTENLHAVELSGPR

SEQ ID NO: 30379 - protein, 424 aa, Pseudomonas aeruginosa UCBPP-PA14
MLDLVAAFIALTTLLTYVNYRFIRLPPTIGVMATALVFSLIVQGLSELGYPILEVEMQEIIRRIDFSEVLMTWFLPALLFAGALHVDLSDLRSYKWPIGLLATAGVLIATFVIGGLAYYTFPLFGWQVDFIYCLLFGALISPTDPIAVLGILKSAGAPKPLATTIVGESLFNDGTAVVVFAIILGILQLGEAPTVSATAILFVQEAIGGVLFGAVLGYGVFVMMRGIDQYQVEVMLTLALVIGGAALAARLHVSAPIAMVVAGLIIGNHGRHYAMSDETRRYVDKFWELIDEILNALLFALIGLELLLLPFSWLHVAAAFALGGAVLVSRLLTVGPAILVLRRFRGANRQVPAGTIRILVWGGLRGGVSVALALSLPLGPERDLILSLTYIVVLVSILLQGLSIGPLVRRIYAGQPLEKSEGAH

SEQ ID NO: 30380 - protein, 165 aa, Antirrhinum majus
SSSDNASKKITLRSSDGEVFEVDEAIALLSQTIKHMIEDDCADNVIPLPNVTGKILSKVIEYCKRHVDADAAKSEEKVAAAAAGDDDLKAFDADFVKVDQATLFDLILAANYLNIKTLLDLTCQTVADMIKGKTPEEIRKTFNIKNDFTPEEEEEVRRENQWAFE

SEQ ID NO: 30381 - protein, 536 aa, Psychrobacter arcticus 273-4
MSAIITSKLSPNAAEFQQNSAAMQEVVDDLYQHLRKVVQGGSERARAKHLARGKLLPRERVERLLDVGTPFLEVAPMAAHDMYGEDIPAAGVIAGIGRINGTECMIVCNDATVKGGTYYPITVKKHLRAQEIAQENHLPCIYLVDSGGANLPNQDEVFPDKEHFGRIFFNQANLSAAGIPQIAVVMGSCTAGGAYVPAMSDESIIVKDQGTIFLGGPPLVKAATGEEVTAEDLGGGDVHTRLSGVVDHLAQNDTHALSIARNIVSHLNRPAKQIPNQIKPRPPRYDAKELYGVIPTDKRKPFDIREIITRIVDDSAFDEFKVRFGTTLVCGFAHIEGMPVGIIANNGILFSESAQKGTHFIELCCKRKIPLIFLQNITGFMVGRKYENEGIARHGAKMVMAVANAKVPKFTVIVGGSFGAGNYGMCGRAYSPRFLWMWPNARISVMGGEQAASVLATVKRDNFDRKGEAWSDEDEAAFKAPIREMYEKQGHPYYATARLWDDGVIDPADTRNVLALALSAAHNAPIEETTFGVFRM

SEQ ID NO: 30382 - protein, 119 aa, Antirrhinum majus
TIIPVPNVTSKILAKVIEYCKRHVEAAAKTDADDGQGDRDALKVFDAEFVKVDQGTLFDLILAANYLNIKSLLDLTCQTVADMIKGKTPEEIRKTFNIKNDFTPDEEEEVRRENAWAFE

SEQ ID NO: 30383 - protein, 410 aa, Streptococcus thermophilus LMG 18311
MSALDAYKIRQDFAILDQVVNDEPLVYLDNAATTQKPQVVLDTLMAYYREENANVHRGVHTLAERATAAYEASREKIRQFISAKSTKEILFTRGTTTGLNWVGRFAEQVLEPGDEVVISIMEHHSNIIPWQEACKKAGAKLVYAYLKDGQLDMEDLANKISEKTKFVSLAQVSNVLGCINPVKEIAQMAHRVGAYMVVDGAQSAPHMAIDVQDLDCDFFILSGHKMLGPTGIGVLYGKEEILNQMNPIEFGGEMIDFVYEQEATWKELPWKFEAGTPNIAGAIALGTAVDYLSALGMENVHAYEQELVDYVLPKLQAIEGLTVYGPEDSGKHAGVIAFNINGLHPHDVATALDYEGVAVRAGHHCAQPLINHLGISSAARASFYIYNTKEDCDKLVEAILATKEFFNGTL

SEQ ID NO: 30384 - protein, 417 aa, Magnaporthe grisea 70-15
MTKPRRGAPPTPQAQAVADYEKKKANFITRTLWTFVMIAIFFGALFMGHIYIILIITAIQIISFKEVIAIANVPSKARSLSSAKSLNWYWLASTMYFLYGESVIYYFKHIVLVDKVLLPLATHHRFISFILYVFGFVFFVMSLQAGHYKFQFTNFAWTHMALYLIVVQAHFVMNNIFEGMIWFFLPAALVITNDIWAYICGITFGRTQLIKLSPKKTVEGFVGAWVMTVLFGILLTHFLTRSKYFICPVNDLGANVFTGLSCDPNPAFLPTTWTMPDFVFLPRDFGKLSITMAPVQLHTLILSTFASLIAPFGGFFASGLKRTFKIKDFGDSIPGHGGMTDRMDCQFTMGFFTYVYYHTFIATHKMGLGGIMEDAITGLTPDEQIELIRGMGRYLANQGIVGADVLSCLDSALPMRR

SEQ ID NO: 30385 - protein, 410 aa, Glycine max
MTKPNTFFHNLIKPFKFSSSKEGQTEENEIQNLAAQEQKIFPYETLVAATNKFHILNKLGEGGFGPVYKGKLNDGREIAVKKLSHRSNQGKTQFVNEAKLLARVQHRNVVNLFGYCTHGSEKLLVYEYVRRESLDKLLFKSQKKEQLDWKRRFDIITGVARGLLYLHEDSHNCIIHRDIKASNILLDEKWVPKIADFGLARLFPEDQTHVNTRVAGTNGYLAPEYLMHGHLSVKADVFSYGVLVLELVSGLRNSSFDMDVSAQNLLDWAYRLYKKGRALEIVDPTLASTAVTEQAEMCIQLGLLCTQGDLNLRPTMGRVIVVLSKKPPGHMEEPTRPGIPGSRYRRVSRRPYAMSSGEVDDDSNLHTFDSSRNCGTNTTTSATTPTTSSNTTAEVDRRGKRPMQRLVLRD

SEQ ID NO: 30386 - protein, 456 aa, Triticum aestivum
  misc_feature (256)..(256): Xaa can be any naturally occurring amino acid
  misc_feature (273)..(273): Xaa can be any naturally occurring amino acid
  misc_feature (297)..(297): Xaa can be any naturally occurring amino acid
MALTRIGLAGLAVMGQNLALNIAEKGFPISVYNRTTSKVDETTVQRAKLEGNLPLYGFHDPASFVNSIQKPRVVIMLVKAGAPVDQTIATLAAHLEQGDCIVDGGNEWYENTERREKAMEERGLLYLGMGVSGGEEGARHGPSMMPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFRHQGMTRDEGYLXTRLLDKTGMKGTGKWTXQQAAELSVAAPTIEASLDSRFLSXGLKDERVAASKIFQGDYSSGETVDKAQLIEDVRKALYASKICSYAQGMNIIRASFLDRIKKAYDRNGELANLLIDPEFAQEIMDRQAAWRRVVCLAINNGVSTPGMSASLAYFDSYRRDRLPANLVQAQRDYFGAHTYERVDMPGSFHTEWYKIANSKI

SEQ ID NO: 30387 - protein, 267 aa, Ralstonia metallidurans CH34
MSIPSFGVGTFRLTGQVVVDSVRNALDVGYRAIDTAQIYGNEADVGQAIAESGVERGELFVTTKIWTANYAADKLVPSLRESLDKLRTDYVDLTLIHWPAPGNGVALSEYMAALAEAKALGLTRQIGVSNFNIELTRQAIEAVGKGEIATNQIELSPYLQSRKLTAFLKEQGIAVTSYMTLAYGKVLKDPVLGQIAAKHHATVAQVALAWALQLGYAVIPSSTKRENLASNLLARDLKLDADDMALIASLERNGREVSPEGLAPVWD

SEQ ID NO: 30388 - protein, 433 aa, Salmonella enterica subsp. arizonae serovar 62:z4,z23:--
MKNELMQCLRLKYPPPDGYRRWGRIQDISATLLNAWLPGVFMGELCCIKPGGEFAEVVGINGSKALLSPFTSTVGLHCGQQVMALRRRHQVPVGEVLLGRVIDGFGRPLDGSELPEVCWKDYDAMPPPAMVRRPMTQPLMTGIRAIDSVATCGEGQRVGIFSAPGVGKSTLLAMLCNAPGADVNVLVLIGERGREVREFIDFTLTKESRKRCVIVVATSDRPALERVRALFVATTIAEFFRDHGKRVVLLADSLTRYARAAREIALAAGETAVSGEYPPGVFSALPRLLERTGMGEKGSITAFYTVLVEGDDMNEPLADEVRSLLDGHIVLSRRLAEMGHYPAIDVLATLSRVFPAVTSPEHRQLATTLRRHLALYQDVELLIRIGEYQRGVDAAADKAIDTYPNICTFLRQSKDEVCGPELLIEKLQQILTE

SEQ ID NO: 30389 - protein, 756 aa, Chlamydomonas reinhardtii
MNALLLRNLGGLRRSSSLVSFAEYKQSEASNPQMSSVTSEGTLLEYETLELRIHPPNVVIDNETYEDVTVITIDSANRPGTLIEVVQCLTELGLSIRCARISSDGGWFVDEFFVTETPKGKILDQRKINIIRKVLSIETDAERTARDKELCTVFELAGRDRHGLLAAVLQLLVVNGCEVLSAAVWTFHDRVALVISATERGAPVVDPPKLDRLEQILYDMLGGGDAVVNSEMVRGDVHHERRLHHLLLLEELKAWEQQYVAQAVTPTHGASTHGSTVPTSNGHSALPPASTAGSAAAAATDAYAAQAAAVAAAAAAVTADAGLAAPAFGRTSIHAGTPVIAAAGPVGLPPRAPSPAPASAFAGGANAAPGASTLQAEGSGNLANSGISAHGYTSAGFPQADEGGAACPHGAAGTGSAGANAGLGPGGLPAVVGPDGIPLSPQATADGTVFGRAPPGGGAGASGEIQRATSSNALTGMGSGGGGLVAGSAVVGVPPGLPPLMPSRQTSTRTMTVTGEEGETGQAVPPPAPTAVPPSLGGAADQLAPLRRSEVRIQHSTLLNYWLVTIRCRDRNKLFFDTVCTLADMNYDIYHATIDSEGDAASQLFYVRPRYGECVWDERRAAKLRYMLESAVQRRFPRGTKVCVQSGDRSSLVALFSALSSGGFWITRADVRAHGHDNAVFEFTITDTRGQLPEQTHVQRICEAVGGVLTPDVYAPVGGTQNGNTSSRMTAGRAGGGPGGGVMQGTFRFSILERRW

SEQ ID NO: 30390 - protein, 360 aa, Mycobacterium smegmatis str. MC2 155
MSAAKAAVHQPWPGLIEAYRDRLPIGDDWTTVTLLEGGTPLIHAKRISELTGCTVHLKVEGLNPTGSFKDRGMTVAVTESLARGQQAVLCASTGNTSASAAAYAARAGITCAVLIPQGKIAMGKLAQAVMHGAKIIQVDGNFDDCLELARKLTADFPTIALVNSVNPYRIEGQKTAAFEIVDALGTAPDVHALPVGNAGNITAYWKGYSEYHRDGVSDRLPRMLGTQAAGAAPLVTGAPVKDPETIATAIRIGSPASWNSAVEAQQQSDGRFLAATDEEILAAYHLVARTEGVFVEPASAASIAGLLKSVEDGWVKRGSTVVCTVTGNGLKDPDTALKGMPQVTPVPVDPSAVVAELGLS

SEQ ID NO: 30391 - protein, 182 aa, Physcomitrella patens subsp. patens
MAFGIGRGISTPLLALNFCMYIATGAIAGWALNKNIDSSAGAGGYVGNAATFYFLPMVLIASVVGLASTLAGIHHLREWRIESLAAAASAALIAWTLTLLAFGVACKEIHIGGPRSRKLKVVEALIIVLALFELLYLLSLHAGVLGGDRFGPAYSNTGAGGANMVLVQAGEKHHGIPAAAAV

SEQ ID NO: 30392 - protein, 651 aa, Oryza sativa Japonica Group
MAAPLSTAAAASWLSDSASSPPRVRLLIGGEFVESRADEHVDVTNPATQEVVSRIPLTTADEFRAAVDAARTAFPGWRNTPVTTRQRIMLKYQELIRANMDKLAENITTEQGKTLKDAWGDVFRGLEVVEHACGMGTLQMGEYVSNVSNGIDTFSIREPLGVCAGICPFNFPAMIPLWMFPIAVTCGNTFVLKPSEKDPGAAMMLAELAMEAGLPKGVLNNCSWYPCTDVVNNICDDEDIKAVSFVGSNIAGMHIYSRASAKGKRVQSNMGAKNHAIILPDADRDATLNALIAAGFGAAGQRCMALSTAVFVGGSEPWIRPGIREDELVKRASSLVVNSGMASDADLGPVISKQDVVNNICDDEDIKAVSFVGSNIAGMHIYSRASAKGKRVQSNMGAKNHAIILPDADRDATLNALIAAGFGAAGQRCMALSTAVFVGGSEPWIRPGIREDELVKRASSLVVNSGMASDADLGPVISKQAKERICKLIQSGADNGARVLLDGRDIVVPNFENGNFVGPTLLADVKSEMECYKEEIFGPVLLLMKAESLDDAIQIVNRNKYGNGASIFTTSGVSARKFQTDIEAGQVGINVPIPVPLPFFSFTGSKASFAGDLNFYGKAGVQFFTQIKTVTQQWKESPAQRVSLSMPTSQK

SEQ ID NO: 30393 - protein, 468 aa, Raoultella planticola
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQKAGIANLLLAPYFKQIADDYQQALRDVVAYAVQNGIPVPTFSAAIAYYDSYRSAVLPANLIQAQRDYFGAHTYKRTDKEGVFHTEWLE

SEQ ID NO: 30394 - protein, 108 aa, Zea mays
VWMRTAALPTFRKLYGRIETDIMENDELTVVIQNNYNTYSFGGSKALVLSTTSWIGGKNNFIGFAYLIVGGFCLFLALVFVVLYMIKPRTLGDTSFLSWNRGTMDYPS

SEQ ID NO: 30395 - protein, 129 aa, Oryza sativa
  misc_feature (13)..(13): Xaa can be any naturally occurring amino acid
RTSPIGWMVLTRXALFDHSYNSPKNSELNMEAYNKAKEADLEFYRDASSLQYGKVSWVPEENIDRMVNELKERDEKRKAFSRRRKFHEDKDIDSINDRNEHFNKKVERAFGKYTLEIKNNLERGTALPD

SEQ ID NO: 30396 - protein, 76 aa, Haemophilus influenzae Rd KW20
MSIEERVKKIIVEQLGVKEEDVKPEASFVEDLGADSLDTVELVMALEEEFDIEIPDEEAEKITTVQSAIDYVQNNQ

SEQ ID NO: 30397 - protein, 270 aa, Hyacinthus orientalis
KCWYYSDLYRAKDVFEAFYKKDLAKRLLMGKSASIDAEKSIISKLKTECGSQFTNKLEGMFKDIELSKEINYSFKQSSQARTKLPSGIEMSVLVLTTGYWPTYPPMDVKLPHELNVYQDIFKEFYLSKYSGRRLMWQNSLGHCVLKVDFPKGKKELAVSFFQTVVLMLFNDTQKLSFQDIKDSTSIDDKELRRTLQSLACGKFRVLQKYPKGREVDDDDSFVFNEEFSAPLYRINVNAIHMNETVEENTSPTETVFQDRQSQVDAAIVSN

SEQ ID NO: 30398 - protein, 242 aa, Haemophilus influenzae Rd KW20
MQGKIALVTGSTRGIGRAIAEELSSKGAFVIGTATSEKGAEAISAYLGDKGKGLVLNVTDKESIETLLEQIKNDFGDIDILVNNAGITRDNLLMRMKDEEWFDIMQTNLTSVYHLSKAMLRSMMKKRFGRIINIGSVVGSTGNPGQTNYCAAKAGVVGFSKSLAKEVAARGITVNVVAPGFIATDMTEVLTDEQKAGILSNVPAGRLGEAKDIAKAVAFLASDDAGYITGTTLHVNGGLYLS

SEQ ID NO: 30399 - protein, 291 aa, Mycobacterium smegmatis str. MC2 155
MDGAGLAMSATTPSRRIRDADRTAQLTAALGAARARLARAAESAGRNVGEIELLPVTKFFPGSDIVILNQLGCLSFGESREQEAANKIAEVRAELPDAPIRWHMIGRIQRNKARAVAGWAYAAHSVDNARLIAALDRGAADALGRGVRSEPLRVYLQISLDGDAERGGVDIGDPDLVDELCAAIDGADGLTFTGLMAIPPLGADADEAFARLAAERDRVQKAYPQRLEMSAGMSNDLESAVKHGSTCVRVGTALMGPRPLTSPPVVTPVTSSSQTSELPRSAEGSPDEHTA

SEQ ID NO: 30400 - protein, 641 aa, Oryza sativa Japonica Group
MSAAVGGAEFHGFRGGGGGAAQLQRSRMLGRPLRVATPHAAAPAGGGGSSSASIRAVSAPLKKDASEVKRSKVEIIKEKSNFLRYPLNEELVSEAPNINDSAVQLIKFHGSYQQTDRDVRGQKNYSFMLRTKNPCGKVPNQLYLAMDTLADEFGIGTLRLTTRQTFQLHGVLKKNLKTVISTVIKNMGSSLGACGDLNRNVLAPAAPYVRKDILFAQETAENIAALLTPQSGAYYDLWVDGEKIMSAEEPPEVTKARNDNTYGTNFPDSPEPIYGTQYLPRKFKIAVTVAGDNSVDILTNDIGVVVVSDSAGEPVGFNIYVGGGMGRTHRVETTFPRLADPLGYVPKEDILYAIKAIVVTQRENGRRDDRRYSRMKYLIDNWGIEKFRAEVEKYYGKKFEDSRPLPEWQFNSYLGWQEQGDGKLFYGVHVDNGRVAGQAKKTLREIIEKYNLEVSITPNQNLILCGIDQAWKDPITAALAQSGLLEPKDVDPLNITSMACPALPLCPLAQTEAERGILPILKRIRAVFDKVGIKDHESVVVRITGCPNGCARPYMAEVGFVGDGPNSYQIWLGGTPNQSTLAETFMNKVKLQDIEKVLEPLFSYWNSTRQEGESFGSFTRRTGFDKLKEVVNKWAESASAA

SEQ ID NO: 30401 - protein, 601 aa, Legionella pneumophila str. Lens
MNGHLLLNVFIFLAAASIMVPLASRFRLGSVIGYLTVGMLIGPFGLKLIGNAEQIMHFAEFGVVMMLFLIGLELEPIMLWKLRKLIVGLGGLQVLLTTIALSSAAVMMGYNLRASVAVSMALALSSTALVLQMLQEKNLLKTAEGETSFAVLLFQDIAVIPILVILPLLGNHHGINVAINPHTAASIAQLPKWLHAIVVAGIIGSIVLAGHYLSRYLFLIIAKTNIREVFTAFSLSLVVGITLLMETIGVSPALGAFIAGMVLANSQYKRTVEADIQPFKGLLLGLFFISVGMGINFNLLFSQMAVIIPIVLGLITIKALILFTLGKIFQLTKIQALGFALGLSQGGEFAFVLFQYSSTLKVISPEISSFFTLVVALSMLATPFLMLLYHRFMMPKLISKLPEREYDSIHEKNNIIIAGYGRFGQIIGRFLSGENIKVTVLEKNPEQVELLRKFGYTGYFGDANRLDLLKSAGAAHAQLLIVTVGNPDTNLEIVKLAKEEFPQLKIFARARNRRHAYELHKAGVHYFKRELFDSSLTMTKEILKFLGYKPEEIEKKANAFQKHDEETLIKSFDFFEEEANLINFSRQAKGELERILQNNNP

SEQ ID NO: 30402 - protein, 456 aa, Haemophilus influenzae Rd KW20
MTKHYDYIAIGGGSGGIASLNRAASYGKKCAIIEAKHLGGTCVNVGCVPKKVMFYGAHIAEAINNYAPDYGFDVEVKKFDFSKLIESRQAYISRIHTSYNNVLAKNNIDVINGFGKFVDAHTIEVTLADGTKEQVTADHILIATGGRPYRPNIKGQEYGIDSDGFFALTELPKRAAVIGAGYIAVELSGVLNSLGVETHLLVRRHAPMRNQDPLIVETLVEVLAQDGIQLHTNSTPSEIVKNADGSLTVRCDGQSDVTVDCVIWAAGRVPTTDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVVGLHGIGFGVDEMIQGFAVAIKMGATKADFDNTVAIHPTGSEEFVTMR

SEQ ID NO: 30403 - protein, 484 aa, Chlamydophila pneumoniae J138
MITRTKIICTIGPATNSPEMLAKLLDAGMNVARLNFSHGSHETHGQAIGFLKELREQKRVPLAIMLDTKGPEIRLGNIPQPISVSQGQKLRLVSSDIDGSAEGGVSLYPKGIFPFVPEGADVLIDDGYIHAVVVSSEADSLELEFMNSGLLKSHKSLSIRGVDVALPFMTEKDIADLKFGVEQNMDVNAASFVRYGEDIETMRKCLADLGNPKMPIIAKIENRLGVENFSKIAKLADGIMIARGDLGIELSVVEVPNLQKMMAKVSRETGHFCVTATQMLESMIRNVLPTRAEVSDIANAIYDGSSAVMLSGETASGAHPVAAVKIMRSVILETEKNLSHDSFLKLDDSNSALQVSPYLSAIGLAGIQIAERADAKALIVYTESGSSPMFLSKYRPKFPIIAVTPSTSVYYRLALEWGVYPMLTQESDRAVWRHQACIYGIEQGILSNYDRILVLSRGACMEETNNLTLTIVNDILTGSEFPET

SEQ ID NO: 30404 - protein, 242 aa, Brassica napus
MQSIVSSHHLCLAPPPPPPVLCQRLLCHRVPSIRLPSRRSTTSLRLFPCAAVSRESEMAAKEDGQDPRIPKIASSIRVIPDFPKPGIMFQDITTLLLDTEAFKDTIDIFVERYKCKGISVVAGVEARGFIFGPPIALAIGAKFVPMRKPKKLPGKVISEEYSLEYGTDKIEMHVGAVEPGERAIIIDDLIATGGTLAAAIRLLERVGVKIVECACVIELPELKGREKLGEAPLFILVTSDAA

SEQ ID NO: 30405 - protein, 140 aa, Glycine max
  misc_feature (97)..(97): Xaa can be any naturally occurring amino acid
GTRNSNSFAFMDDFNRNCTLSTTQRLYGFAICFASGLTCTLLSMLVFFKPIKFAIAFTLGNLLSLGSTAFLIGPKRQVTMMLDPARIYATAIYIASXNKLLTLLAIILEFGALVWYSLSYIPFARAMVSKIMVSCFDTEF

SEQ ID NO: 30406 - protein, 432 aa, Brassica rapa
MAEGEVTPPPRKVLIISAGASHSVALLSGEVVCSWGRGEDGQLGHGDAEDRSSPTQLSALDEHQIVSVTCGADHTVAYSQSRLEVYSWGWGDFGRLGHGNSSDLFTPLPIKALHGVMIKQIACGDSHCLAVTMDGEVQSWGRNQNGQLGLGNTEDSLVPQKIQAFEGIRIKMVAAGAEHTAAVTEDGDLYGWDGKIWKFGISDRNDRLFLKEYLCCVRDVDGAVMQPHISFLLWSIIYLWMEQIWPTRTWRLGGSPCFLTNWKRSATAFFSQISGGWRHTMPLTSDGKLYGWGWNKFGQVGVGNNLDQCSPVQVRFPDDQKVVQVSCGWRHTLAVTERNNVFAWGRGTNGQLGIGESLDRNSPNIIEALSVDGASGQHIESSSFDPSSGKSWVSPSERYAVVPGETGQTDSTSKGNGGDISVPQTDAKRVRL

SEQ ID NO: 30407 - protein, 298 aa, Klebsiella pneumoniae
MNMANLKAVIPVAGLGMHMLPATKAIPKEMLPIVDKPMIQYIVDEIVAAGIKEIVLVTHSSKNAVENHFDTSYELEALLEQRVKRQLLAEVQAICPPGVTIMNVRQAQPLGLGHSILCARPVVGDNPFVVVLPDIILDGGTADPLRYNLAAMIARFNETGRSQVLAKRMPGDLSEYSVIQTKEPMVAEGQVARIVEFIEKPDEPQTLDSDLMAVGRYVLSADIWTELERTEPGAWGRIQLTDAIAELAKKQSVDAMLMTGESYDCGKKIGYMQAFVTYGMRNLKEGTKFRESIKKMLA

SEQ ID NO: 30408 - protein, 283 aa, Bradyrhizobium japonicum USDA 110
MRLFILGFGYSARHFVRRFGGTFSHIAGTVRDPAKRDDLAGIEVHPFSGSRPARETAERISDADVLLISIPPGSAGDPAIAACADVLAGGRQRKIIYLSTIGVYGDHAGSWVDESTPPQAALDRTRMRLAAEQAWTDIGRGDVAILRLAGIYGPGRNALVTLRAGTARRIIKPGQVFNRIHTDDIASAIMAAVRHQGSGTWNVCDDEPAPPQDVIAYAAQLMGVAPPPEEAFETAEMSAMARSFYASSARVSNAKLKRELGVTLAYPTYRHALDALWRAGEGR

SEQ ID NO: 30409 - protein, 551 aa, Bacillus cereus G9241
MSFAIASGVKPEYGIYTTCIAGILISLFGGSKYQIGGPTGAFVPILLGIVITYGYEDLLLAGLLAGIILCLMGIFKLGSLIKFIPRPVTIGFTSGIAVIIFTGQIASFLGLTGIKKHEEFIANLQEIFTHINTTNFYSVITALICFLVILITPKILPKVPGSLVGIMVSTIIATVFFSDHVPTIGTAYGTIPSTLPQFGIPEITVERIKQLIGPAFVIAVLGGIESLLSAVVADGMTNSKHNSNKELIGQGIANIVTPLFGGIPATGAIARTATNIRSGAVSPMSGVIHGGFVLFTLLLLAPYASHIPLASMSPILMVIAWNMSERKHFIHILKMKTGDSFVLLVTFLLTVFTSLTTAVEIGLILAVILFTKRMSNMLVISKVLPDHTRKNEKLLPHVVNKAHDCPQISIYTIEGPLFFGAAQTFEQNILATIHYKPKVLILRMGKVPFIDTTGESYFRNIVQHFKKQGGVILVSGIQSELKTTLDKNGLYAEIGEENFFDHTGEAINCALRQLNTNKCIGCKHFAFHECTELAQQSQDMNAIKNKANALD

SEQ ID NO: 30410 - protein, 391 aa, Arabidopsis thaliana
MSDLPRDLLAEILSRVPLASLRSVRFTCKKWNDLSKDRSFLKKQIVEAKKKQLKSKEFEVIMMRNFRVYLTSVDLHNDVNPSFTPKGTLTSFSDDANQHQVDNVSSVFHCDGLLLCITKDLNFRLVVWNPYFGQTRWIQPRNSYHIKDIYAIGYDENKNHKILRLKDQYYDYDSHPRARICEFELYSFESNSWKVVLDVSPDWYIHSYHRGLSVKGNTYWYATEKHGYVNFLICFDFTTEKFGPRLPLPFNATESFTYDDVVTLSSVGEEQLALLFQSDATLMMEIWVTSKVDPTEVLWNKLFLAVDHDMIEFDYELKFVADAGSFFIDQKKNVVVVFDKDMNEHTHRGMAYIVGKNGYFKRVDIGEEAYTSCFPLVCSYVPSSVQIRQLT

SEQ ID NO: 30411 - protein, 540 aa, Rhodopirellula baltica SH 1
MDWGDWAAVEPEDGVAEVADIVEISRQTSNKRFGRFATRYRSSRSPFFPSVTKMNGYATPWASGRTIANTMRPTPMAASWSAPTQGQLTSEQRSSAARKRLMAANSLSTGPQSNHDNPKRVAGSDDMATAEIDLSQTDNLVDGRESSSSDAGESFDPEDRAAARARIEAVLLIAKSPLNYRRLAALADVEDATSARTLVGELNELYERLGRGIRIEQVAGGQRMMTRSVVAPWLRRLGFLAPAIRLSWPMMETLAVVAYRQDVTRADVEAVRGVACGEILRQLMQLDLVRISGRSEELGRPYLYGTTKRFLKICGLASIKSLPPIDWHASCDDVSQSADGEVENIADELTADELKSRDHSQLESHPRRESSDAETSDTNPSETEHLHPTKESDVSVAAIETLATEFTVSLDADQSGAVAVLDAPASDADAASSNDPSAVIEDEEDDLYENGYELDDEEDDDFDDDDWDDDDEDSDDDDDEDEDDEDEDEDDEDSDDSDDDDDDLDGTDDWEEVDDDEADEDWDDEDEEDDLDEEEEEWED

SEQ ID NO: 30412 - protein, 470 aa, Escherichia coli CFT073
MVDQVKVVADDQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLSVIILLLVLNLATVKMFGEMEFWFAMIKIVAIVSLIVVGLVMVAMHFQSPTGVEASFAHLWNDGGWFPKGLSGFFAGFQIAVFAFVGIELVGTTAAETKDPEKSLPRAINSIPIRIIMFYVFSLIVIMSVTPWSSVVPEKSPFVELFVLVGLPAAASVINFVVLTSAASSANSGVFSTSRMLFGLAQEGVAPKAFAKLSKRAVPAKGLTFSCICLLGGVVMLYVNPSVIGAFTMITTVSAILFMFVWTIILCSYLVYRKQRPHLHEKSIYKMPLGKLMCWVCMAFFVFVLVLLTLEDDTRQALLVTPLWFIALGLGWLFIGKKRAAELRK

SEQ ID NO: 30413 - protein, 101 aa, Oryza sativa
SVTPAFFTPPSSSSTSMVPPASSMMPTAPPLHPTSASAQRATYGTPLLQPFPPPTPPPSLTPSYNEGPIISRDKVKEALLRLVQNDQFIDLVYRELQNAHM

SEQ ID NO: 30414 - protein, 287 aa, Moritella sp. PE36
MSVLDAFFTKLWQQYSVISPQAVDIHQLFEHRGEELVNDHVAFRTFADSHIGIDILEDEVLALGYRHLDSYQFDVKKLDARCYVHNNSPTKIFISELRWQSLSDASQVIIQDIIEQTKATLKSPLLEQSSRGLSPLLSAGRLWQLPSYADYQTLASESEYAAWLSVWGLRANHFTIFVNHLKNTPELTDVVALLQQQGYQLNEAGGVIKGAPSDLLIQASTMADTCIVNFNDAGEQAISSCYYEFAQRFNQENGELYQGFVPMSADKIFESTNMKSILGSTTPDNEN

SEQ ID NO: 30415 - protein, 1146 aa, Ashbya gossypii ATCC 10895
MEFERQENTSLPRASIQAIGALSVATDDLPKKHIDYPTREPGKYPLRADEESKIGYASYDSEKPSEGADVSCTNESSGDAEHASDRPAESNADKTASEVKSANAGEGFASDRVPDSREGEKLKGKRLNSDLQPTTAVDSSHADGLTNFPLVQEQEVAKNEPPTTPGPPKGTDSIGLAAREVSQASHGGEKEDLKPDGSAYMEVAGSGDAPITPTPNSTPLKNIPKPAGSIGTDDTRLMASDMEQGQDQQELLNRLQRPSMSYGPNTRRRSSLILKEHDSKTPDIRAASTLQTTELKLELPENLDHEDFSKLFKLDAKNDDDLFSAEDLLAHGIGSQRRSSEDDAAATRHKLDIEQSPRGSVSLTPEILDNKHMCTKTEDTNTSNEEGLSPRQHVAAKKTGDSSQQLSISNNSMANPHTVKSSTHDGSVKFNYTTHLENTPASIIQGKNHLFYARRHNSLTPMVSQPTNKHSPATFKPSPESERQTSTDINAGNHTEHSDGHILPAGQFMTSSHGSNLAEEQSKISAYACLDFQNFTFYVQTLQVIIGRRSENDFAHKVDVNLGPSKSISRRHAKIFYNFGTERFELSIMGKNGAFVDDTFVERGITVPLRNKSKIQIGQIPFQFVLPEQEGKEKHVIPSKIKDTPTVKTESVKDPLDSQIKAPDISVTSKKKEKKPSKPPKPPKKVYSLEEIPPEYRTKPTCSYSNLITTCLRKYSSPKGMSLSEIYAGIRELYPYYKYCPDGWQSSVRHNLSLNKSFRKVSKEGKGWLWGLDEEYIAEREKQRKKQAEAQAAKAKAAELKQLQLQARKQATVSNNLASFTKQPNISQTLAANRSEKRILQDDNQRTMKYLQQQLILLTKDRKGLEKPVMAQILTQALAMTINQVTQAAKNKGITGNPLTALIDKNPQHLNLILTAAVNAATVKVTDGKVKKLVNMSPVSQVSAQNPALIAKQGSSKRASPPALRNILQKPPTPSIANPTSSSTLKAGEPFDPTSLSKFFQPKQPVRLSVAGTPGHAGSRSNNGNLLPRKRSASDTESSDDDSDTSVNEDSSDEDSGDSSDDNTGSSDSGTAGDDTSSSSTSDNGDDDDDDDDDDDDDDDDDDDDDDDDDDDDEDDDDDDEDDDDDDQSSNIIDYRRGYDYTVPNS

SEQ ID NO: 30416 - protein, 564 aa, Bacillus licheniformis ATCC 14580
MRRTKEGHLETSLRGKDVLSIPTLNKGVAFSLEERKNLGLEGLLPPTVLSLDQQAERAYEQFSRQPDRLRQNVYLNDLQNRNEVLFYKLLQNHLREMLPVVYTPTVGEAIQEYSHEYRRPHGVYLSIDDMDGIETAFKNLQASADDIDLIVATDSESILGIGDWGVGGINIAIGKLAVYTAAAGIDPSRVIPVVLDVGTNNEKLLNDPLYIGNRHPRVEGERYEQFIDAYVETALKLFPNALLHWEDFGNKNARNIMSKYNHKIATFNDDIQGTGAITLAAILAAVKKTGTSLKDHRVVIFGPGSAGIGIADQIRDTMVLEGLSEEEANRAFWTVDYRGLLTTGMDQIMDFQEPYLRDTEEVKDWKRNEKGEISFEEVIRQVKPTILIGTSGVAGAFSEEIIKEMAAHTERPVILPMSNPTHLAEAVPEDLFKWTDGKALVATGSPFEAVEYNGVKHEIGQSNNAFVFPGLGLGTIVAKAKVITNGMFAASANAVANMVDHEKPGAGLLPKIDDLQDVSVQVAIDVVKAAIKDGVAQVQPEDVEKAVREAMWRPEYKTIVAKQD

SEQ ID NO: 30417 - protein, 210 aa, Chromobacterium violaceum ATCC 12472
MKSMMEPQGLGLVPMVVEQSGRGERAYDIYSRLLKERIVFLVGPVTDESANLVVAQMLFLESENPDKDIHFYINSPGGSITAGMSIYDTMNFIKPDVSTLCIGQAASMGAFLLAAGTHGKRFALENSRVMIHQPLLYGGGLSGQVTDIEIHARELVKVKAKMNELLAKHSGQTLERVQSDTERDNFMSAEEARAYGMIDKVLSSRRDVTA

SEQ ID NO: 30418 - protein, 282 aa, Streptomyces hygroscopicus subsp. ascomyceticus
MDHQLIVLGAGVMGTGITTLALRHGVPVTLVDTSEEILTAARARIATELRTAQLVAGPAEADPGVLRTATSALPAIGTATAVIEAVVEDAEVKAEVLATVSAAAPGIPVITNTSSIPVDELADSVARPEDLLGTHFMNPSYLIPTVEVIRGPRTGEKAMAAAGDLLAALRRKPIVVRDAPGFVTSRLLHPMINDAARIVQEGTASVEDVDALMTGCLGHPTGPLRTADLIGIDNLVDALWVLHKRTGDERSRPCDLLLGKVREGHHGRKTGRGFYEYEKVFS

SEQ ID NO: 30419 - protein, 517 aa, Oryza sativa
MSGGSGDSSPASGRASFSSLSDLKDLELSSESGCLSIVVLGASGDLAKKKTFPALFHLFQQGFLLSGEVHIFGYARSNISDDGLRERIRGYLKGASDEHISQFLQLIKYVSGSYNSGEGFESLNNAISENETSKNNKPGSSRRLFYLALPPSVYPSVCKMIRSYCMNPSSHSGWTRVIVEKPFGKDLESAEELSAQLGELFNEQQLYRIDHYLGKELVQNLLVLRFANRLFLPLWNRDNIANVQIVFREDFGTEGRGGYFDQYGIIRDIIQNHLLQVFCLVAMEKPVSLKPEHIRDEKVKVLQSVTPIKHDEVVLGQYDGYKDDSTVPDDSNTPTFASLVLRVNNERWEGVPFILKAGKALNNRKAEIRVQFKDAPGDIFKCKKQGRNEFVIRLQPSEAMYMKLTVKKPGLEMATEQSELDLSYGLRYQDVKIPEAYERLILDTIRGDQQHFVRRDELKAAWEIFTPLLHDIDDGKVKALPYKPGTRGPPEADELSKRMGYVQTHGYVWIPPTLSKF

SEQ ID NO: 30420 - protein, 425 aa, Thiobacillus denitrificans ATCC 25259
MNIGRYEIIDGIGQGAMGTVYRARDPLIERTVAIKTVPIAQLQAEGADAESRFLREAQSAGRLSHPNIVTIYDVGEADGIAYIAMEYLPGATLRDLMNKGPMPLDLVLDTALQMLEALAFAHEHGVIHRDIKPANVVVVGHRGRIKLTDFGIAHLANSGQTQLGQMLGSPRYMSPEQAMGREVNGRSDIFSLGAVLYEMLTGRYAFDGDSLPTIVYRVIHDPPAPIASLRPQIPPALVTLVGQMLNKNPAARPDARTLVSAFHGLMPTVPQRLQAACGKDVSPVLRVLAFTAPIGVFLLIGVSVIVIERFLGLPGTSGPPQARAPAAAQVASVGPPPPALPELAPNDRAAPPDRATDENGASAPATDAYLEGLDRKRVELRIKRAELLLKYTRQHPDVVQIDAQLDRLRAERNRHLRQLQKQAAD

SEQ ID NO: 30421 - protein, 198 aa, Chlamydomonas reinhardtii
MVAKIGAPAPKFKAQAVVNGEIKEISLDDYKGKYVVLFFYPLDFTFVCPTEIVAFSDRVEEFRAINTEVIGASIDSQFTHLAFSNTPRTKGGLGGCKYPLVADLTKQIAKDYGVLIEDGPDAGVTLRGLFIISPTGVLRQITINDLPVGRSVDETLRLVKAFQFTDEHGEVCPANWNPGAKTMKADPTKSLEYFSTLS

SEQ ID NO: 30422 - protein, 298 aa, Debaryomyces hansenii CBS767
MDTSEPQESPKSLLNVKHIILILSGKGGVGKSSVTTQTALTLVNKGFNTGVLDIDLTGPSLPRMFGVETKQVHQSSAGWVPVSVYNNGQEKNEENKRGNLSLMSLGFLIGNRNSSVVWRGPKKTAMIRQFLKDVVWSGGENNVPLDYLLIDTPPGTSDEHIAIAEELRWANPDGAIIVTTPQQVATADVRKEINFCKKVNFDVLGVVENMSGFICPHCSECTNIFLSGGGKELSEKLDLQFLGNIPIDPSFVEMVEMQDNDQNDGKKKLVDLYDDCELKGIMEGIVDKVLEQQHPARF

SEQ ID NO: 30423 - protein, 246 aa, Escherichia coli CFT073
MLDQVCQLARNAGDAIMQVYDGTKPMDVVSKADNSPVTAADIAAHTVIMDGLRTLTPDIPVLSEEDPPGWEVRQHWQRYWLVDPLDGTKEFIKRNGEFTVNIALIDHGKPILGVVYAPVMNVMYSAAEGKAWKEECGVRKQIQVRDARPPLVVISRSHADAELKEYLQQLGEHQTTSIGSSLKFCLVAEGQAQLYPRFGPTNIWDTAAGHAVAAAAGAHVHDWQGKPLDYTPRESFLNPGFRVSIY

SEQ ID NO: 30424 - protein, 714 aa, Silicibacter pomeroyi DSS-3
MGDFHYAKDADGIVTVTMNMDGPVNAMNAEFWPLFAATMDRIEAEPELKGVIWTSAKDTFFAGGDLKMLKSIEPDGVEALFRSVEATKAVMRRMEKQPVPHVAAINGAALGGGFEICLACNHRIAADNPKTKIGLPEVTLGLLPGGGGTVRLTWLLGLEGAMPFLLEGRQVSPDKALKAGLIHQVVPADQLLTRAKEYILSVQGDAAAVTQPWDTKGYKIPGGPSTAPHNMTRIAGAAAMLFKKTRGLMPAPTRILDIMTEAAGKVDFDTATRYESRRFVSLTPLASTKNMIETLFFGMNKVNGGASRPKGVPTSKVQRLGILGAGMMGQGIAFSAATAGLPVVLKDQTLEAAERGKAYTATLLDKRVKQGRMSAEEREAVLALITPTDKADDLKGCDLIIEAVFEKIDIKDAVLAEHEALLAENGIWGSNTSTLPITRLATGATRPENFVGLHFFSPVDKMPLLEIIAGEKTSDETLARAFDFARQIRKTPIIVGDSTGFYTSRTIGTKIIEAVELVAEGHDPLRVDNLSRLTGMPTGMLSLLDEVQIKLVTDIYNTQVEMGLLDPDKEQNPAARAMLAEMISQHGRHGRATGKGFYDYDGQGKTIWPGLAAWRKEGADIPDADIKDRILFRAVLESLRCLEEGVLRTVEDGNIGSILGIGAPVHTGGYLQYVNTYGPARFLARCEELAGKYGDRFAPPEILRTHVAEGRALA

SEQ ID NO: 30425 - protein, 468 aa, Klebsiella pneumoniae
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRTDKEGVFHTEWLE

SEQ ID NO: 30426 - protein, 373 aa, Cichorium intybus
VLELGFFRTPSSSRWYLGMWYKKLSERTYVWVANRDNPLSCSIGTLKISNMNLVLLDHSNKSVWSTNHTRGNERSPVVAELLANGNFVLRDSNKNDRSGFLWQSFDYPTDTLLPEMKLGYDLRTGLNRFLTSWRSSDDPSSGDFSYKLQTRRLPEFYLFKDDFLVHRSGPWNGVGFSGMPEDQKLSYMVYNFTQNSEEVAYTFLMTNNSIYSRLTISSSGYFERLTWTPSSGMWNVFWSSPEDFQCDVYKICGAYSYCDVNTSPVCNCIQRFDPSNVQEWGLRAWSGGCRRRTRLSCSGDGFTRMKKMKLPETTMAIVDRSIGLKECEKRCLSDCNCTAFANADIRNGGTGCVIWTGQLEDIRTYFANGQDLY

SEQ ID NO: 30427 - protein, 236 aa, Hyacinthus orientalis
MATGAEEVKLLGMWASPYAMRPRIAMNLKGVGYEFLPETYGAKSDLLLKSNPVHKKIPVLIHNGKPVCESMIIVEYIDEVWSAGAAPILPAAPYDRAVARFWAAYIDDKLFPSLRAVTAEAKADAVSQVHALLQLLEEAFQKCSQGKGFFGGDTIGYLDIALGCYAGWIKAAETMSRTKLLDEENTPLLAGWSEPFCADARSERGDAGDRQAGGSWPIYVWLRFTDAPPCSMRGLF

SEQ ID NO: 30428 - protein, 260 aa, Desulfitobacterium hafniense Y51
MRRILMQHKFSRTELLIGKSALAKLSQSTVIIFGIGGVGSYTAEALARAGVGHLILVDYDEICLTNINRQLHALHSTIGKAKVDVMKNRILDINPKAKVDAVKEFFSAENAESFLGQKPDYVVDAIDTVSGKVALAKECSQRNIPLIASMGAGNRLSAENYRITDLSKTSGDPLAKAVRKLLRKEGITKGIKVVYSPDLPLTPLDTEADCRSNCICPGGDAHCALKRQIPGSISFVPPVSGLLMAGQVVNDLIADCPREA

SEQ ID NO: 30429 - protein, 214 aa, Moritella sp. PE36
MNNISNSCVIIAIAGASASGKSLLSSTIYNELVAEFGESQIAVITEDCYYRDQSHLEMEERVKTNYDHPQAMDHKLLCSHLQDLSDGKAVEIPTYSYTEHTRLAETIKLTPKKVIILEGILLLTDPNIREIIHASVFMETPLDICFIRRLQRDVAERGRTMESVIEQYNETVRPMFLQFIEPSKQYADLIVPRGGKNRFAIDTLKAKICQLLND

SEQ ID NO: 30430 - protein, 132 aa, Hyacinthus orientalis
PKGKKGSFLAVPGAFTPTCSEKHLRGFVEKAGELKAKGVDTIACISVNDAFVMKAWKEDLKVGDEVLLLSDGNGDFTRALGVQLDLSDQPVGLGVRSRRYALLAEDGVVKVVNLEEGGAFTFSSADDMLKAL

SEQ ID NO: 30431 - protein, 381 aa, Zea mays
MPDVKSAAATVAKAVAGDSPSPAATPPAPAVASSNGTPQKPPPIPAATFDMPKPNLRGLNKPKCIQCGNVARPRRPFQCCKSCCYKAQNPCHIHVLKQSNTLPDKPSPATASSTEQPSTNLPATSSASRLAALQKLPQHFLKSLQTKKSLTKKDAVAINKWRFMKLREHMQGDIDDENEAYERYTQNVRLLEETFYPMEYADVEPEAEAPSSDEERMDLLVSEAKVRLKSDNEIADRFKERVAAILDQKLKKLLESQSADEDDKLSDPDQDDHLNPAKFSAKQKAERSASLNELLGKLTRARSEDDLKPCRDLIEQLFGKEKGSSTDRPAGVEMEQRDQESAAAAVAQPYSVPELCARMEVDEDFAAKISDEFSLSQVAQL

SEQ ID NO: 30432 - protein, 483 aa, Mycoplasma mobile 163K
MNVLEKEKGVNLTDKRSKMIATIGPSSQNKEILKQMMLKGMTTVRANFSHGDHAEQLNKFVLAKEVAKELNLPMSLMLDTKGPEIRVGKMKDGSQKIEVGKIITVLTDEVSYKTFEGIPTKFTVSHRMDKDVKVGSYILFDDGKLTTIVTGVKSGIVEVKTINSHVLKSNKRINIPGAQLSLEFLSKKDKEDIIFGIKNDVNYIAASFVNSKQDVLDLRKLLKDNNGEHIQIISKIESVFGIENIDEIIEASDGIMIARGDLGLEIPYFEVPFYEKQIIRKCRNVGKPVIVATQMLDSMEKLPQPTRAEVSDVYWATELGADATMLSGESANGDFPVESVEVMSTINRRAEKEFYNKLYYPAHLETLIQNPVGVHSKLASEVALKVMNGDYKFSVILSETGRLLKEIARFRPNTVIIGVINNDKLIHGFGITHSVFMSVDSKAVKSEIEKNLTKAREVLKPFFPKKGDKYLVVENNKISEYIY

SEQ ID NO: 30433 - protein, 130 aa, Cryptococcus gattii
FCVALSEYDQVLLEESGQNRMQESLVLFESVINSRWFLRTSVILFLNKIDLFKQKLPKVPLVQYFPEYTGGADINKAAKYILWRFTQTNRARLSVYPHLTQATDTSNIRLVFAAVKETILQNALRDSGIL

SEQ ID NO: 30434 - protein, 464 aa, Burkholderia xenovorans LB400
MNDELIAARIDRLPVSRFHRRLLLLVSLPFFFDISDIFTFSYAAPALVKEWGLTMSSIAMLTSAGFFGMFLGATLGGMLSDKIGRKRALICYVIAYSVFSLANALAPDIPMLMITRVLTGVGISSATAVVMAYIAELFPAKTRGTWQSWAMVIALMGIPITSWVARLVVPSGPDGWRWIFVWGALGIVFLVFTKHFPESPRWLARQGRMEEADRTLSLIEAEVVRTTGPLPEAVAINRPAEVRAPWTSMFKGQYIGRTMTLWAIWIFQTLGFYGFQAWVPTLLVQHGITIVHSLTYITLINIGAVPGALIAVFLADRFERKFSIAGAAALIAVFGLLYGLSFQPVLIVSFGFLVGMLIQTFAALCYAYTPEQYPTDIRNTGAGFAYGMGRLANVGNSFIVAGIFMNFGYVWVFVYIAGAWLATAAVTLLFGARTTGRRLESINPVLAQAADNPLDAPILRPGDR

SEQ ID NO: 30435 - protein, 241 aa, Oceanobacter sp. RED65
MDRKIAVVTGASRGIGHAIAQQLKEDGFFVVGTATSESGVDKVKEALADQGTAIVLRQDDVESCDGFIKAVAELGPVSVLVNNAGITRDNLMLRMKQDDWDAVLNTNLSGVYRICKGFLKPLMKQRGGRIINISSVVGSMGNPGQANYCASKAGIEGFTRSLAVEIGSRNITVNAVAPGFIATDMTEELSDEQRQVMLNNIPLGRYGDAKEVAAAVSFLASDASSYITGQVIQVNGGLFMG

SEQ ID NO: 30436 - protein, 215 aa, Xanthomonas axonopodis pv. citri str. 306
MSEAKRLAAEKAIDYVEDGMIVGVGTGSTVAYFIDALGRIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQVTDPVGLERSLNQIPGVVCVGLFARRPADVVIVGGEPPQVI

SEQ ID NO: 30437 - protein, 77 aa, Oceanobacter sp. RED65
MSSIEERVKKVVCEQLGVKEEEAKGTARFVEDLGADSLDTVELVMALEEEFETEIPDEDAEKLTTVQEAIDYIIAHL

SEQ ID NO: 30438 - protein, 744 aa, Saccharomyces cerevisiae YJM789
MITNKKIKISVPEKLGLSGESFEESWETVKYAVDHIYSDDMAELSFEQVYKTIYTIVLNKKGPILYNRLKDYLIQKLALLRETIVKDNTHDYEFLGTMARLWDVECHCFKITGDLMMYMDKVYCKPNRCMEVYDMCLDLFRIEILQKCSSSLISALISDIERIRNLGSVDSEHTSLWKVLIGMMETLHDNRDSFFLTDFEPVLITATEEYYNKAIDIELLTPIESLEKIRKLRQFESMLDSSFLNVDSLNKLKTVLENVLIWGKLSDIIEDLTHEAMVISNGKLLQEIYDLSNEEKYRVTVIESIKSYINKNAINIPFNEGNRKKGQNAITWSSEIVELYRSQHSFLESIDFGSVRLNNLTGDVSNAILGDVFSMYFSKEGALPSEYLSTYVDHCMKRTKEKDAEIVKIKQDLLDSTKLIGLLTEKDIFEKIYKKQLSRRLLQQRSLVEIEKWMVQMIKKVLGTFFTSKLEIMLRDISLSSEMYQAFQHSTTNSIEYLSFAPQVLTRTSWPFQSTNPIDEGISLPPRMSQILAGFEGYYSLKYKERVLKWAHHLSVIEIGCQFNSGYYEISFSVYAGVIFLLFEDYEELTLGEIYELTHIPIDDVKSLVMSMSTIPRCKILKKSSSSGNMKFSVNYFFSSPNRKVKVPVIACPLPSQKSDNLATASSVDTYDNEIVMELSAIIVRIMKTEGKLSHQQLLERTTKRTQSRLSLTPSIFKRSIQLLIEKEYIQRNADDPSYYHYLS

SEQ ID NO: 30439 - protein, 458 aa, Nostoc punctiforme PCC 73102
MAALLSDALVFFGITSDLAYKKIFPALQAMIQRGHFDIPIIGVGRRDWSIEQLQSYVRKSLEEQASVDEAAFQKLCSLLYYIFGDYSDRATYDKLCQVLQIAEAPLYYLAIPPSLFATVVEGLGQSSCVKNGRVMVEKPFGRDLESARMLNCILHSIFPESHIFRIDHYLGKEPVQNLLYTRFANSLLEPIWHRVSIASIQITMAEKFGIDARGQFYEETGAIRDVVQNHLLQVTACLMMDPPINEQHEAIRDERARLLKSIDPIEPSNVVRGQYKGYASEPGVAPDSKVETFAAVKLNIDTWRWASVPIYIRAGKCLPSTTTEVVVRLKRPPQDVFGERAFGLANYFYFRLSPNVLTAIGIRSKTPGDGMVGSEVGLVAQVEHGNEMNPYERLFEDAMKGDSMLFARQDEVEAQWQIVAPILDRATPVYEYAPHTWGPPLADHMIPPDGGWHNPNAT

SEQ ID NO: 30440 - protein, 482 aa, Onion yellows phytoplasma OY-M
MQMLSVREIIIQTLKNAIRYQKINHCYLFSGNKGTGKTTLAKIFAKAINCLLPNQGDVCFSCHYCQNFTKANTDITEIDGASYNGVDEIRELQDKAQYKAHTGKYKVYIIDEVHVLTPNAFNALLKILEEPPEHVVFILITTEIYKIPDTIFSRAQSFAFENLNLKNITAQLTKIAALENMFITEDAIKSIACHSEGGMRNALSLLDQVSAYQNNLITSEDVANIKGTVSASIIKKLFQNLLKKEAIKALQLLHKVIDSGKNIDLLILDLIDAIKDYLIWNAKNKKDSKTSPLSQDQKILLLEETNHIDHFLRILIKLQQDLKKSDQKKSLVEIAFLQICSLHSFQFQANLQETQQFVTNKTNIYNNEQASLALDETNAKENYEPTKITQKNTEKKTFDKTEKIKPTKLASIANEKPPKPPKTEYLHPVQDLQSQNNFSQKTPNNSTTSELTQQNNLPSQNSQETKSPTKKTLIFPILLFVI

SEQ ID NO: 30441 - protein, 362 aa, Oryza sativa Japonica Group
MECWEKKPRNLGGSLPVPNVQDLAARPDHLTPTLLRRYLRPHHLSLPADDHHAMAMIPVVDFARLIDHHEEAAKLRHACEEWGFFQVINHGIADETVEEMKRDVMAFFNLPLADKAAFAQQPEWIEGYGQAFVTSEDQTLDWSDLYFLTTQPPSYRDLRFWPPETSSTFRRSMDRYSLETQRVATELLRAMARNLGLRDADKMTRLAAAQSMRMNYYPPCPAKERDRVLGVSPHSDAVGLTLLLQVSPVKGLQIRRGDDWIPVDPIPGALVANVGDVVEMVTNGRYKSIEHRVVVDAAQERVSVAAFHNATFGSTYGPLEEMVGGGEARYRSISVEDYVRLVVSSKLQGKNILDAVKIITTT

SEQ ID NO: 30442 - protein, 769 aa, Xanthomonas axonopodis pv. citri str. 306
MSTDDFKQAALDYHRQQPAGKIKVTATKPMLTQRDLSLAYSPGVAFACEAIVEDATQASELTARGNLVAVITNGTAVLGLGNIGPLASKPVMEGKGVLFQKFAGIDVFDIEINENDPDKLVDIIASLEPTFGGINLEDIKAPECFIVERKLRERMNIPVFHDDQHGTAIIVGAAVLNALVVTGKKIEEVKLATTGMGAAGISCVNMLVSLGLKPENILALDRDGVIHTGRTDLDPDKQRYARDTDKRTLAEIVEGADIFLGLSAAGILKPEMVASMARQPVIFALANPNPEITPEAAKAVRPDCIIGTGRSDYPNQINNVLCFPYLFRGALDVGATGINEEMKIACVKAIAAMARREASDLGAAYGGETPSFGPEYLIPRPLDPRLLVELSSAVAQAAMDSGVATRPITDMEAYRDKLGQFVYRTSLMMKPVYDRARADKQRVVYAEGEEEVVLRAVQNVVDEGLAFPILIGRPDVIEARIERMGLRLTAGVDFEITNILDDPRFNDYWQYYHALTERRGVTVTAAKELMRSRPTLIAAVMVARGEADAMLSGVVGRFHKKLGYARSVIPLEPRVSSTSAMTGVINQLGVFFFLDTHVQEDPTVEQVVEATLQAAYRLKLFGIEPNIALLSHSNFGSHDSRDALKMRQVREALLKRKPELNIDGEMQGDTAWDEALRKQIMPNSTLKGRANLFVLPNLEAANIAYNLVRVFTDGVAIGPILMGISKPVHILTTSATSRRVMNMTAIAAVDAQIRRQRDAEKAAADKGND

SEQ ID NO: 30443 - protein, 379 aa, Prochlorococcus marinus str. MIT 9313
MIASSRNSALLMLADGTVLEGEAFGHCGDAMGEVVFNTGMTGYQEVLTDPSYSGQLVTFTYPELGNTGVNLDDQESSRPHARGVIARQLSPTPSSWRCQQSLQTWLEEKRVVGISGVDTRALVRHLREVGAMNGVISSNGSTPKQLMELLQQAPSMEGLNLADQVSTKDPYRWRSTCAVGFDQRLKQQIDSPYHVVAIDFGIKRAILDRLVAHGCEVTVLPASSDLATVLSSQPEGVFLSNGPGDPAAVTGGIALVKDLLNKVDIPLFGICLGHQIIGLAMGGRTFKLAYGHRGLNHPCGTTGQVEITSQNHGFALDASSLSQVNVVVTHLNLNDRTVAAIAHRDRPVFGVQYHPEASPGPHDADHHFAHFVELMADRR

SEQ ID NO: 30444 - protein, 364 aa, Silicibacter pomeroyi DSS-3
MQKIRAAVCHEFNAPLVIEEVLLAPPGTGEVEVTLDAVAICHSDISYADGAWGGHLPAVYGHEAAGTVSAVGPGVEGFAPGDPVVVTLIRACGTCANCAGGQPTICDTPYDGVKQGPLRTADEGPLLQAMACGAFAEKVVVSQRQIVRIPADMGRDVACLLSCGVITGVGAAVNAARLRAGQDVVVIGAGGVGLNAIQGARIAGARRIVAVDMTEEKLDIAREFGATHGVLATSPKPWRAAYKALGGRGADAVLVTVGAVRAYDEAPKYLGWGGRAVMIGMPHAGAMAQYEPMSASFQGHGLIGSKMGDVVIQRDIPWMIDLYQQGRLKLDELISGRWSLDQINEAIADTRTGSAKRNVILFNH

SEQ ID NO: 30445 - protein, 303 aa, Bacillus cereus G9241
MKRWQMEWLLVSVALVWGANYTIGKYGVAYMSSIQFNSLRFLVASPVLLLITFLMERSLRIERKDWLRLVAVGIVGTAMYQTMFMLSVKYTSATNASLLIAMSPIFTGILAVLHKQERFSMKVQIGSIVAFIGAAFVLLTGHTGGATYEYAWLGNIIGLVAAIAWGWYPILAQPLITKYSAMRVTSWSTLIGIVPLVIYCLFNVNTLTWPVDMPSWGSLAYSIVFATIFGLAMWYVGISQIGSTKVMVYMYLVPLFAVIFAAVTIGEQINMMQLVGGLIIFIGLYVVKKGGIKKPALNLKKVS

SEQ ID NO: 30446 - protein, 176 aa, Escherichia coli CFT073
MSLLNVPAGKDLPEDIYVVIEIPANADPIKYEIDKESGALFVDRFMSTAMFYPCNYGYINHTLSLDGDPVDVLVPTPYPLQPGSVIRCRPVGVLKMTDEAGEDAKLIAVPHTKLSKEYDHIKDVNDLPELLKAQIAHFFEHYKDLEKGKWVKVEGWENAEAAKAEIVASFERAKNK

SEQ ID NO: 30447 - protein, 261 aa, Acinetobacter sp. ADP1
MSKQLDTKVAFITGSASGIGLEIAKKFAAEGAKVVISDVNAEKCEDAVKQLKQQGFDALAAPCDVTDEQAYQAAIELTQKHFGTVDILINNAGFQHVAAIEDFPTEVFQKLIAVMLTGAFIGIKHVFPIMKAQKSGRIINMASINGLIGFAGKAGYNSAKHGVIGLTKVAALESAKDGITVNALCPGYVDTPLVRGQIADLAKTRNVSETTALEDVILAMVPQKRLLTVEEIADYAIFLCSDKAGGVTGQAVVMDGGYTAQ

SEQ ID NO: 30448 - protein, 384 aa, Prochlorococcus marinus str. NATL1A
MFFDTDSSAILLLEDGTYFEGLSFGAVGTISGEVVFNTGMTGYQEVITDPSYFGQLITFTYPEIGNTGVNYEDNESSHPSVKGVIARQISKTPSNWRHEISFENWLKDENVVGIHGIDTRLLVRHIRESGSLNGIISSESKYSIAELFSLLKKSPSMSGLNLVDKVTTKSAFNANSSCPVAFDMRIKNTQTIPYKVVAIDFGIKQSILDRLVAHGCEVTVLPASAEMTDVLALSPEGVFLSNGPGDPSTVDSGINLAKDLIEYKKLPVFGICLGHQILGLALGGKTFKLSYGHRGLNHPCGLNGKVEITSQNHGFALNSESLNSEKIKITRLNLNDQTVAAISVIDRPFFGVQYHPEASPGPHDADHHFNHFVTLIEERRRIVD

SEQ ID NO: 30449 - protein, 662 aa, Gibberella zeae PH-1
MASFMSSFFPGGKAANASGENSTSRPATPSTKLDNFLNPVSTPQGSPSKKTNPPGAHDLPSAFESALNLNNPTIEPPLRLGRPQSVVTPLAPGKTKTQPLDESSPNVDESVVHKSRPGSPNKKQGQENTPPTSRLATLESPHQHSHAAVTRQQLYEQRDRPTTPATKRFNTHRGLTAEEREILQKPNVKRLVNVTQLYFLDYYFDLLTYVGARQNRLQAFKNEYPPPPETDEQTHNQMWAKYAGRERANLRKRRVRLRHGDFQILTQVGQGGYGQVFLAQKKDTREVCALKVMSKKLLFKLDEVRHVLTERDILTTAQSEWLVRLLYSFQDERSIYLAMEYVPGGDFRTLLNNTGVLSNRHARFYIAEMFCSVDALHQLGYIHRDLKPENFLVDSTGHIKLTDFGLAAGVLAPSKIESMRVKLEKASESSVPFGKPMDQRTVAERRESYRTMRENDVNYAKSIVGSPDYMAPEVLRGEEYDFTVDYWSLGCMLFEALTGFPPFAGATPDETWRNLKHWKEVLKRPVWEDPNYFLSNRTWNFICTCINSRSRRFSNITDIFAHQYFAEVEWDVLRQTRAPFVPELDSETDAGYFDDFTNEADMAKYKEVHDKQQALETMAEREDQMSKSLFVGFTFRHRKPATEDGASPRKRIPTDESFGTMF

SEQ ID NO: 30450 - protein, 353 aa, Escherichia coli CFT073
MGLFVKIVAVALLHKHCRESFMKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 30451 - protein, 310 aa, Alteromonadales bacterium TW-7
MLENFLTGLELDQQGALNLLKLARDLKAKPEKYSQVLAGKSVVTLFEKQSLRTRLSFDIGINRLGGHAVYLDQQNGAMGARESVKDFALNISTWADGIVARVNEHSTLTTLGEYSSVPVVNSLCDLYHPCQALADFLTLQEVHGDVSELKVAYLGEGNNVTHSLMLLAATLGTDFVAVTPKGSSPDSQILKKAEQIAAMNGASVMVSDRVEAAVGANVVYADTWVSMGDVTPLEQVKEKYMPYQLNQALLDQTGATTVLHCQPAHREFEITSEVMDGPASKIIQQAENRMHAQNALLVTLLNPNFVKEHL

SEQ ID NO: 30452 - protein, 251 aa, Moritella sp. PE36
MKSMLITMIVFYIGICVVLFVFQRNFLYFPQPAAPVNDVAAISFDSDGEQLRGWVVNEGRAKALMYYGGNAENIENNIDFFKDVLPDYSVYLIPYRGYGNSTGSPTEEHLYHDALSVFDRVTVNHEQITLMGRSLGTGVATYVAANRQVTKLVLITPFDSIVNVAKSVYWMFPVNLLLKDKYLSINRVDKITAQTYIFIAEHDQVIPRARAESLIAQFAEQLVATILITGASHNDISQYPQYVTELKRALD

SEQ ID NO: 30453 - protein, 378 aa, Haemophilus influenzae Rd KW20
MEIKQINSTIKSRAAVAFAPNQPLQIVEIDVEMPRKGEVLIRNTHTGVCHTDAFTLSGSDPEGVFPVVLGHEGAGVVVAVGEGVLSVKPGDHVIPLYTAECGECEFCRSGKTNLCVSVRDTQGKGLMPDCTTRFSYQGQPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFELAKQFGATDCLNPNDYDKPIKDVLLDINKWGIDHTFECIGNVNVMRQALESAHRGWGQSIIIGVAGAGQEISTRPFQLVTGRVWKGSAFGGVKGRSELPQMVEDSMKGDIQLEPFVTHTMPLDKINEAFELMHEGKSIRTVIHY

SEQ ID NO: 30454 - protein, 683 aa, Zea mays
  misc_feature (120)..(120): Xaa can be any naturally occurring amino acid
  misc_feature (146)..(146): Xaa can be any naturally occurring amino acid
MGMSAASHLCASSSLRALTVLFVLAAFVSDVEGRHRRHVCPPYFSCGGLSNISYPFRRQGDPSGCGVQSYELVCTDTDATIRIGSGTYKVLSINSTYSYFWVVDADLDIQSSCPLPRWDXLLVGSIATHIVGGLSSAIIISILLFXTVSRWAIFVNCSQPIENNDICNNIYDDDVYGPVSCLSNSSFIYLLVTDNWDVISAGDLEPSCGYLAKTPLGGPGMTVPSNTSYPDVVKFMRNGFALGFPFSIRSYPTIRECLAENMRTFHKEPRNSTGIRQQILDILTFETLWFCVIEQLGSTNNGVKSVLIDIIQQIPYVLSSLKSAHVICRFVLMPLAVFVFLAYKYWKTQITIDAVEKFLRMQNMLVPMRYAYTNIIAITGHFRDKLGQGGYGTVYKGVLLPGEIHVAVKMLGNSNCNGEEFISEVATIGKIHHVNVVRLIGFCSEENIRALIYEFMPRGSLDKYIFSSEKTFSWDKLNEIALGIARGLNYLHHGCDMQIVHFDIKPHNILLDSNFVPKVADFGLAKLFPRDDSFVPLSAMRGTIGYIAPEMVSRSFGIISSKSDVYSFGMLLLEMTGGRRNADPHAGSSSQAYYPSLVYRQLSQGDANRISEGVDMHELEKKLCIIGLWCIQMKPQDRPTMSEVIEMLEAGVDGIQMPPRPYFCDEEGDSSYSTISELDTIEE

SEQ ID NO: 30455 - protein, 255 aa, Alteromonadales bacterium TW-7
MAKKTWIIKLGGAVLNIENAAHALFDVLSNQPSHNFVIVHGGGALVDTWLKEAGFVSAKHQGLRISPAEQMPHIVGALAGCANKQLMAQAIAAGHKPVGLSLYEAGVTASQKLKALCLVGKCESNNDSIINDLLNVGRLPIVSSIGFDEQGLWYNVNADEAAAAIANNLNAELIFMTDVEAVLDANKQPLHQLDTKHIETLIAEGVIVGGMEVKVKTSLHAALHLRRGVYISSWQKPENLTALLQGEHVGTKITP

SEQ ID NO: 30456 - protein, 209 aa, Arabidopsis thaliana
MAIHTLLFVSLLIFSLIESSSGGKKDRLFTDLQNSIEVTAKPVKDSGVLEAGKDMVTITWKLKSSSAKVDTDTAFKTIQVKLCYAPISQVDRPWRKTDNKLFKDRSCPHEIVSKAYDKTPQSLDWTIGLDIPTGTYFVRAYGIDGDGHEVAYGQSTDEGRTTNLFSVHAISGHHVGLDIASTFFSVFSVVSLFVFFVMEKRKAKLEQRE

SEQ ID NO: 30457 - protein, 449 aa, Haemophilus influenzae Rd KW20
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMAELYRHVGADTDVPAGDIGVGGREVGYLAGYMKKLSNQSACVFTGRGLSFGGSLIRPEATGYGLIYFAQAMLAEKGDSFAGKVVSVSGSGNVAQYAIEKALSLGAKVVTCSDSSGYVYDPNGFTTEKLAALFDIKNTKRGRVKDYAEQFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 30458 - protein, 510 aa, Mycoplasma mobile 163K
MKKTVILSVIDGLGLREEKQGNAFKLAKTPNFDKLFNEYPNSVIQASGDYVGLPDDQMGNSEVGHLNIGAGQIVYTGLSLINKDIKDNKFKQNAKFIAAFNAVKKNNETNTLHLMGLLSDGGVHSHEEHLFKLIEAAHENGLKNVSVHVFGDGRDVAPRSILTSIKKLEAITKKYNYAIGSIMGRFYAMDRDQIFTRNEQALEVMMGKTTNYFTNASEYIKAQYQKDISDEFFIPAINKDYLAKKLNLKDNDAVIFYNFRPDRARQLSHLLIQSNLYNYQSKNQVKLSNFTSMMKYEGLDTNIAYEEMKITNPLGNILAKNGLSQLRIAETQKYAHVTFFFDGGNDVLYENEERILIDSVKADSFADYPEMSAAGITDTLIANLGKYDVIILNYANPDMVGHTGNLKATIKALEFLDFQYGKILKAIEKTNHTLFITADHGNAEITEDENGNPATKHTTSPVMLIVTDKNLKLNSGTLANIAPTILDYLKIPKPKNMLDSLIMNNKRTSK

SEQ ID NO: 30459 - protein, 311 aa, Arabidopsis thaliana
MGSAARQPLFSFGVIADVQYADISDGRSFLGVPRYYRNSILVLQRAVETWNQHGNLKFVINMGDIVDGFCPKDQSLAATKKLVHEFEKFNGPVYHMIGNHCLYNLPREELLPLLKIPGRDGNAYYDFSPTPEYRVVVLDGYDISAVGWPQEHPNTIAALKILEEKNPNTDKNSPAGLEDVARRFVKYNGGVGEKQLQWLDSVLQDASNSNQRVIVCGHVPMSPGVASKAALLWNFDEVMNIIHKYDSVKVCLSGHDHKGGYFVDSHGVHHRSLEAALECPPGTYSFGYIDVYDNKLSLVGTDRMQSTDFEN

SEQ ID NO: 30460 - protein, 255 aa, Burkholderia xenovorans LB400
MTKRPEEIALMAESGQLLADVFGYLDQMSLIGMSTMQVNDLVDSLIVNELNACPASKGQYGYAYALNSSRNNVVCHGVPSTTDILQSGDIVNFDITLEKNGYIADSSKTYLVGEVSPLAKRLVQVTYEAMWKGIKTVRPGARLGDVGHAIERHARRNGYSVVREYCGHGIGREMHEEPQVLHWGKPRTGLLLREGMVFTIEPMINQGRHSVRTEEDGWTVVTRDGQLSAQFEHTVAVTRNGVQVLTLRSEERVPN

SEQ ID NO: 30461 - protein, 536 aa, Oceanobacter sp. RED65
MKLQAAMSDQPISESPQQTIEQLSEQWDLVVIGGGITGMGVAREAARQGLRVLVLEQKDFAWGTSSRSSKMVHGGLRYLASGNLRLTSHSVKERERLMNEAPGLVDLMAYSWPHYKKQFPGPFIFNALLALYDMFAGKKYRKFLSPEETSYVLPHIRRDALIGSTQFADAVTDDTRLVMRVMDEAKADGAVCLNYTRVIDVIKQDELVKGVQCVDECSGKTYSFFAKAVVSATGAWADQLRRNQGAKKKIRPQRGSHLVIPHWRFPVAQAITLKHPEDDRSMFIYPWEGTTVIGTTDLDHPEADLKEPHIHEFEIHYLLKAANALFPGSRLEKEDVIATWAGVRPIVSSGKSLNPSSEKRDHSIWDDNGLVSVSGGKLTTFRLIALDVLKMLKKYVPDIQYKDTGARIFTNLEQEPEELEQLDGFWKKRLVGFYGCHIDRFFDCAKPGELAVIPGTQSLWAQLRYSCRYESVVHLDDLLLRRTRIGLLLANGGGDFKDQIKMICQSELPWNEEQWQQEWQRYQDIWHAYYSVTPEK

SEQ ID NO: 30462 - protein, 68 aa, Picea sitchensis
MTTSRRLADRKSAKFQKNILKRGAVPETTVKKASSYPVGPIVLGFFVFVVIGSSIFQIIRTASSGGMA

SEQ ID NO: 30463 - protein, 493 aa, Oryza sativa Japonica Group
MFSHGADSAHDAGAVSTGASGVPTRFVWPYGGKRVYLTGSFTRWTEHLPMSPVEGCPTVFQAICSLSPGIHQYKFCVDGEWRHDERQPTITGDYGVVNTLCLTRDFDQINTILSPSTPGSRMNMDVDNDNFQRTVSLSDGIIQEGPQRISEAAIQISRCRVADFLNGQTGYDLLPDSGKVIALDVNLPVKQSFHILHEQGIPVAPLWDSFRGQFVGLLSPLDFILILRELETHGSNLTEEQLETHTISAWKEAKRQTYARNEGSWRANHHLVHATPYESLREIAMKILQNGVSTVPIMFSSSPDGSYPQLLHLASLSGILKCICRYFKNSQGNLPILSQPVCTIPLGTWVPKIGDPNGRPLAMLRPNTSLSAALNLLVQAGVSSIPIVDDNDSLLDTYSRSDITALAKDKVYTHIRLDEMTIHQALQLGQDANSPFGFFNGQRCQMCLRSDTLLKVMERLANPGVRRVFIVEAGSKRVEGIISLSDIFKFLLS

SEQ ID NO: 30464 - protein, 181 aa, Brassica napus
MFFSSITSMPDKVKQETSRMAELQPGNDNNQQPNGGVPPSLPSTSAEALAGSKRLRRPSVRLGEIGGEQYQAAYDSQVRKPKKDMSKSSTRTRALTNLSSGYDNLGDEREVNVDSFGVGSWRVKKRVGPSTKRVRSNWVSRIGEMDHGDELEGGYRDFSREDSESPIKDESLVRDGGGYYG

SEQ ID NO: 30465 - protein, 601 aa, Escherichia coli CFT073
MEGSDFLLAGVLFLFAAVAAVPLASRLGIGAVLGYLLAGIAIGPWGLGFISDVDEILHFSELGVVFLMFIIGLELNPSKLWQLRRSIFGVGAAQVLLSAALLAGLLMLTHFSWQAAVVGGIGLAMSSTAMALQLMREKGMNRSESGQLGFSVLLFQDLAVIPALALVPLLAGSADEHFDWMKIGMKVLAFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMALLLVTVTLSMMTTPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERRQLDGWDEFE

SEQ ID NO: 30466 - protein, 311 aa, Chlamydomonas reinhardtii
MKGKAIQQKEPGGEGADVRLVLMDLADLSSVRRGAEQLLKELSSDASPGTQTGAQEQQQQQQVVEGGSGGSGSAVLHMLILNAGVVAAPMPHTAQGLEPQTGINHIAHFYLTQQLLPALTGHGTPARVVVVASKAHGAFGDDVLDADDLNWEKRTAAGKYGMWAAYAQSKLCNVLFALELADRLKDTPVRVFSLHPGVIFTSLESNLPLLLRAVMRMVLWPMSKSVKQGAATSVYAATAPELEPPHLSGSYLEDCGPGKTSAPGRDKELARRVWAASEQLLSKALKGDAEGVEGAAAGGAGGGAIASVAEH

SEQ ID NO: 30467 - protein, 266 aa, Chlamydomonas reinhardtii
MQRKYWTLSDYNIIRKMYTGYASTVYQAMCKKSLEMVALKVYHMQNLCELNHYQVFREIRVHSSLQHQNIIHLIAAFQEGTDVVLVQEYAEGGDLYRLLHKNGGRLSERQAVEMVLHPFLLALHYLHTRGIMHRDIKPENVLFTEHRVLKLADFGLAIDLTEERAVTRAGTLDYMAPEENKNNPYLHYNNSVDAWAVGVFAYELVVGFPPFAGETQLDSVDRIMHSVPEFPAKISEFAKDFICQCLRKHPGDRPTVMELLHHPWVR

SEQ ID NO: 30468 - protein, 488 aa, Bacillus cereus G9241
MNSATNQTTSQTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCIIVILGQNYGAFMGESIDWNGVLVSYIGLPLFLVLWLGYKFTKKTKVIPLDKCELK

SEQ ID NO: 30469 - protein, 168 aa, Brassica rapa
MDHDKTGCQSPPEGPKLCINNCGFFGSAATMNMCSKCHKTILFQQEQGAKLASAVSGSPSNILKETFTAALVDAETKSIEPVAVSVQAVAEVVAPEEAAAKPKEGPSRCTTCNKRVGLTGFKCRCGDLFCGTHRYADVHNCSFDYHVAAQEAIAKANPVVKADKLDKI

SEQ ID NO: 30470 - protein, 589 aa, Blastopirellula marina DSM 3645
MAFSARYAAKFSIGRVCEKNVQFSQTEQGTSQRKASMADSNRSTAGLSIGEYLIRRLQDYGLQDIFGIPGDYILSFYSMLEQSPINMVGCTREDNAGFAADAYARVHGLGAVCVTYCVGGLSICNSIAGAYAEKSPVVVLTGSPGLRERINNPLLHHMVREYSTQKDVFEKLCVATAELADPVTAFREIDRVLDAAARFKRPVYLELPRDMVNVVPHISHTFQEPTTTSDPHALVEAAAEAARLMASAERPMIIAGVELHRFELQDELVQLAEATGIPVAATILGKSVIRETHPLYVGLYEGAMGREEVTEFVEESDLILLLGTFMTDINLGIFTANLDPSKCIYATSEQLRVRHHHYHGVTLPDFMQALAAQKPHPPKRLIPPGLAMQQAPVGVTTDEPLTIRRMVPMINELLDDDVIVIADIGDSLFSATELVTRGRSEFLSPAYYTSMGFAVPATLGVQTAKPKARVISIIGDGAFQMTGMELSTIVRHGYDPVIIVLDNHGYGTERWLHAGKWEYNEIHPWKYSKLPDILGGGTGYEVRTEKEFYNALQSAWNDRDGMSVIHAHLSDQDASETLNRLASRMGRNI

SEQ ID NO: 30471 - protein, 230 aa, Arabidopsis thaliana
MKIMMMIKLCFFSMSLICIAPADAQTEGVVFGYKGKNGPNQWGHLNPHFTTCAVGKLQSPIDIQRRQIFYNHKLNSIHREYYFTNATLVNHVCNVAMFFGEGAGDVIIENKNYTLLQMHWHTPSEHHLHGVQYAAELHMVHQAKDGSFAVVASLFKIGTEEPFLSQMKEKLVKLKEERLKGNHTAQVEVGRIDTRHIERKTRKYYRYIGSLTTPPCSENVSWTILGKVIF

SEQ ID NO: 30472 - protein, 177 aa, Picea sitchensis
MEFRPRRFGGMQELATLNGPDCLADSNVRVRQRSGIHRDMSQRQVICPEPRRLPIVPSLADDHEIHKSGRRLHSHSAMQTEGEACREILDIFFSKSGYGDQANVNSSLPYFCGSPPSRSHNPLIHDVKFIKKELAPPPVNVSQKSSCGASFGANTSVRVEGFFCSSSEKHCIVSALA

SEQ ID NO: 30473 - protein, 396 aa, Escherichia coli
MFENITTAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRVNYSSPPAHGASVVATILSNDALRAIWEQELTDMRQRIQRMRQLFVNTLQEKGANRDFSFTIKQNGMFFFGGLTKEQVLRLREEFGVYAVASGRLNVAGMTPDNLAPLCEAIVAVL

SEQ ID NO: 30474 - protein, 352 aa, Zea mays
MVSRLLFGLVVLPLSLQYSSSALSNPPEEFGGGGLQQPSPPPTSSGLRVGFYQYTCPNAEAIVRDEMAKIISRVPSLAGPLLRMHFHDCFVNGCDGSVLLNSTVPGLPSEKEAIPNLTLRGFGTVDRVKAKLEQACPGVVSCADILALVARDVVVLTKGPHWDVPTGRRDGRRSVKQDALDNLPAPFFDAGRNLYQFFIPKGLDAKDQVVLLGAHTLGTSHCSSFADRLYNFSGTTAADPSLDRRYLPRLKSKCGSPGDTTTLVEMDPGSFRTFDASYYRRVARGRSLFASDQTLMNDPAARAYVQRQAGAGAGAYPAEFFADFAKSMVKMGAVQVLTGAQGEVRRHCAAVN

SEQ ID NO: 30475 - protein, 396 aa, Escherichia coli
MFENITTAPADPILGLADLLRADERPGKIDLGMGVYNDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRVNYSSPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 30476 - protein, 280 aa, Brassica napus
  misc_feature (131)..(131): Xaa can be any naturally occurring amino acid
MATSASALLAPTTFSTVISQKNPNSISFHGLRPLRLGGSSSALPKLSTTSGRRSSSSAVVRAELSPSVVISLSTGLSLFLGRFVFFNFQRENVAKQVPEQNGKTHFEAGLSVGSSLVEEDKLELATSLLAXAKAKGVSLLLPTDVVVADKFAPDANSKVVPASGIEDGWMGLDIGPDSIKTFNEALDTTQTVIWNGPMGVFEMEKFAAGTEAVANKLAELSEKGVTTIIGGGDSVAAVEKVGVAGVMSHISTGGGASLELLEGKVLPGVIALDEAITVTV

SEQ ID NO: 30477 - protein, 396 aa, Escherichia coli
MFENITTAPADPILGLADLLRADERPGKIDLGMGVYNDETGKTPVLTSVKKAEQYLLENETTKNYLGIDGIPEFGRCTQELLFGKGSALINDKRARTAQTPGGTGALRVAADFLAKNTSVKRVWVSNPGWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRVNYSSPPAHGASVVATILSNDALRAIWEQELTDMRQRIQRMRQLFVNTLQEKGANRDFSFTIKQNGMFFFGGLTKEQVLRLREEFGVYAVASGRLNVAGMTPDNLAPLCEAIVAVL

SEQ ID NO: 30478 - protein, 69 aa, Glycine max
MASSMISSPAVTTVNRAGAGMVAPFTGLKSMAGFPTRKTNNDITSLASNGGRVQCIQVSSEARCLRGSQ

SEQ ID NO: 30479 - protein, 173 aa, Zea mays
LASYSCYSRRARSSDSDCNEEGEEMVGSGADGGGGGDDARSKEAAGMMALHEALRNVCLDSDWTYSVFWTIRPRPRCRGGNGCMVGDDNGSLMLMWEDGFCRPRVAECLADMSGGEDPVRKAFIKMSIQLYNYGEGWVLYWVGAVQVQVQAVEFGRSRVVCNFFPTFQSPLPA

SEQ ID NO: 30480 - protein, 393 aa, Idiomarina loihiensis L2TR
MSVIAMTDLDLSNKRVLIREDLNVPVKNGKVTSDARLKAALPSIQQALKAGAKVMVMSHLGRPTEGEYDEEFSLQPVVDYLQEVLDCPVRLCKDYLDGIELKAGELVVFENVRFNVGEKKNNDELAKKLASLCDVYVMDAFGTAHRAQASTHGVAKYAPVACAGPLLAGELEALGKALENPKRPLVAIVGGSKVSTKLTVLESLSGVVDQLIVGGGIANTFVAAAGHNVGKSLYEADLTDEANRLMAQAKAKGGDIPLPVDVVTGKEFSAEAKAETKAVNAVADDDMIFDIGPDTAEQLAAMLKNAGTIVWNGPVGVFEFEQFGHGTKTIAEAIAQSDAFSIAGGGDTLAAIDQYAIADKISYISTGGGAFLEFLEGKTLPAVAILQERANDA

SEQ ID NO: 30481 - protein, 396 aa, Escherichia coli
MFENITTAPADPILGLADLLRADERPGKIDLGMGVYNDETGKTPVLTSVKKAEQYLLENETTKNYLGIDGIPEFGRCTQELLFGKGSALINDKRARTAQTPGGTGALRVAADFLAKNTSVKRVWVSNPGWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRVNYSSPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 30482 - protein, 341 aa, Idiomarina loihiensis L2TR
MSEPARIAINGFGRIGRSFLRALYENGYRDSVQVVLINEPAASEAIAHLLKYDSSHGRFGEKVTQSGDALTVAGDNIALTHQTEIEAIDWRAHEVDFVVDCTGVFGSQADGQLYLQQGVKRVLFSHPGKPDVDFTAIYGVNEKELTVDHKVVSNGSCTTNCIVPVIKVLDDAFGIDSGAITTIHSAMHDQQVIDAYHPDLRRTRAAGRSIIPVDTRLARGIERILPHLEGRFEAIAVRVPTTNVTAMDLSVTLNSDATIEQINQVLREQSERQLAGILDYTEEPLVSIDFNHDPHSSIVDGTQTRVSHKRLVKLLCWCDNEWGFANRLLDTAKTMAEQTEH

SEQ ID NO: 30483 - protein, 181 aa, Mycoplasma mobile 163K
MLKFIKSSTKESEWLKNPKNEICFVGRSNVGKSSLINALFKTRVVKVGKTPGKTKLINFFEDERGNSVVDLPGYGYAKLSKEAQSEISDMIFEFLTKRVEIKKLFLLIDSRLGFTPIDQEFYDFLKEAPFEIIIVATKRDKLNQSQTYQIKKSLDELKVKYFLVSITKKEFLQDLVNNLFN

SEQ ID NO: 30484 - protein, 176 aa, Desulfitobacterium hafniense Y51
MLYSYLDKRPTLGKDVFIADGAKIIGDVHIDEGASIWYNSVIRGDIASIYIGKGTNIQDLSVIHVNTNVPVIIEDDVSIGHSVTLHGCTIKKGTMVGMGSTILNGAIIEEGSMVAAGSLITENKQFPPHVLIMGSPAKVVRELTSDEVNALKETAERYSQKAREHRENSPLPIAKC

SEQ ID NO: 30485 - protein, 434 aa, Dechloromonas aromatica RCB
MNIPDSARIQAQDLLDFIDASPSPWHAVQTCETRLQAAGFSRLEELDRWTLSAGGRHYVVRGGSSIIAFIIGRQSAAETGLRMIGAHTDSPGLRLKPKPAEDVAGMVRLGVEVYGGPILATFADRDLSLAGRVNVRTPGGFTTRLVHFAEPLLRLPNLAVHMNREVNENGLKFNKQTELPLLLGVSEDGTKAEARFRQPIADRLGVEPGDLLTWELNAYDTQKGSFWGVDREFVANSQLDNLASCHAGLSALLATKEPNATCLCAFFDHEEVGSESAAGAGGSFVSDVISRLAANAGLDGEDQRRMLARSFFISADMAHGWHPNFPAAYEPCHHATVNAGPVIKSNANQRYSTNADTAARFMAICAKAGVPCQQYAHRTDLGCGSTIGPIVASRLGIPSVDVGSPMWAMHSIRESAGVLDHAYMISALTTSFTD

SEQ ID NO: 30486 - protein, 1055 aa, Aspergillus nidulans FGSC A4
MSRKRGLDCDYPQSGDADGQLPLTPQGSNQHNDTLTSSEGWSAQTRMLEMKLFHHYTVEASFTLRQDVLEAGHFQVAVPRLATSNPFLLDILLAFAALHLAFLEQGDSKWLEIALKYQSRACSAFSRVLADLAPETLGPAFICSIFIMLCAFAYPCVSQNRDTFDPLLQVLEINRLLTGCAFLFEQLDSVEQPEEIKAWFIYKRRVVLLKQGQVEDAQEDPGLEQLQRDLLKSLNHLRSSIDSTESPHKAIYLSTWDTLQEMVKEWPRGRNQGGILAFPIHISKEFMARLQEGDWIARILFLHYGVGMHLLSNKWYVGTWGRRLVATGLGPQEEVPEVWQETVQWARQAVAYTVPYDGERQKEKSEMGLRNPDLVSAVLKIGDGHAATRVLVSRPYQPLTLSLALCLSMSTSGYDGNAQDVEKQPLLPSLDNELQVSFSLQNQTRNSGSTMSPSPSLSLSRLLRLSVCTTLCLVLVVFHVPSVLPSPLDSYDRYTRAHKYERSAEAHDGKRGAVASESAICSRHGTDIILMGGNAADALGRLLIPVDGSDDALCWGRCIDLGMYHSGIGGGGFMLVKSPDGSFEYIDFRETAPAAAYETMFNNLTDASTLGGLASGVPGELRGLELLHSKYGSLPWSVLVQPAINTARNGFPVGQDLVRYMDSAVGDGEDFLVNDPSFAVDFAPNGERVKLGDTITRKRYAKTLETIAAEGPDAFYSGPIAEYTIKALQAANGTMTLEDLRNYTAVVRDYSQINYRGYQVTSTTTPSSGSVAMNILKVLDTYEPLFTPENVNLSTHRLDEAMRFAYGLRTVLGDPGFVDGMSEYERDMISQQTADEIHSKISDLRTQNVSAYDPAGIESLETPGTSHIATIDRSGLAVSAITTINLLFGSRIVVPETGVIMNNEMDDFSVPGSSNSFGYIPSEANYIRPGKRPLSSCTPAIVTHPNGTTFFIAGSAGGSRIITATVQNIIHAVDEGLSAAEALARPRLHDQLIPNQVAFEYAYDNSTVAFMAARGHNVTWMAPGTSTAQAIRVLPNGTFEAAGEPRQLDAGGFAV

SEQ ID NO: 30487 - protein, 262 aa, Burkholderia xenovorans LB400
MDTEQHQLASSQDAPLPPVVLITGALAGIGRATALAFARLGSRVVVSGRRPDAGEALAEELRALGAEARFVAADVRSEEDVSKLVEQAVESFGRLDVAVNNAGTEGTPGPLTGQTLESYDSVFDTNVRGTLLPMKYELRVMQRQGFGSIVNISSTMGERGAGNMSIYVGSKHAVEGITKSAAIEAAAYGVRVNAVAPGPTETAMLDRLTNTPAGKAAFYATVPLRRAGTPEEIAEAIVFVASEKASFITGQIVRVNGGRTAS

SEQ ID NO: 30488 - protein, 395 aa, Musa acuminata
MALQASFLPSALSARKEGKVACTVKESAFLGSSILEHHKSHPVLRTKRESNHSVGVVKAQTTAVAAPGLNQSAVHGKKVLRKGVVVITGASSGLGLAAAKALAETEKWHVVMACRDFLKAEKAAQSAGMAKENYSIMHLDLASLDSVRQFVHAFRQSGRPLDVLVCNAAIYRPTARTPTYTADGYEMSVGVNHLGHFLLANMLLEDLKKSDYPSRRLIILGSITGNTNTLAGNVPPKAGLGDLRGLAGGLDGRNSSAMIDGGAFDGAKAYKDSKICNMLTMQELHRRFHEDTGITFASLYPGCIATTGLFREHIPLFRLLFPPFQKFITKGFVSEDESGQRLAQVVGDPSLLKSGVYWSWNNNSASFENQLSEEASDAVKAQKLWEISEKLVGLA

SEQ ID NO: 30489 - protein, 678 aa, Pseudomonas aeruginosa UCBPP-PA14
MQERIPDELTLPELTLRGLILGALITVVFTASNVYLGLKVGLTFASSIPAAVISMAVLRYFSGANILENNMVQTQASAAGTLSSIIFILPGLLMIGYWSGFPFWQTAAICSIGGILGVLYTIPLRRVMVVQSELPYPEGVAAAEILRVGSDGAEDEEDARAPRAAGNAPGLYDILGGGLVAALFSLWSSGFKVLAEGFSVWLSAGQAAFRLSTGFSLALVGAGYLMGITAGIAILIGVVISWGVAVPLLTVNSVPADGQSLSDLATQLWSSQVRFLGAGTIGVAALWTLATLFKPMVRGVWASLGAVRGNSQASSLRTELDMPAKWILLIAGILLVSLFVVFSHFLGAAAPDMASPQFWSLVAVCVVFAFFFGFLIAAACGYMAGLVGSSSSPISGIGIIAVILVSLLILGFGSIEGGLLDRQNGKLAIALALFTTSVVLAIAAISNDNLQDLKTGYLVGATPWRQQVALIVGCIVGALVIPPVLELLYSAYGFTGALPREGMDPGQALAAPQATLMTAIASGIFHDALNWNMILIGVALGIALILVDLLLRRTGKACLPVLAVGLGIYLPPTIGMTLVVGALISWLLENALKKRAAAAGVDEETYAEEPKRRGVLLASGLIVGESLMGILLAGVIGATGEDAPLALAGAGFAGIAQWLGLVVFVAICVLFYRRVLAR

SEQ ID NO: 30490 - protein, 512 aa, Oryza sativa
  misc_feature (501)..(501): Xaa can be any naturally occurring amino acid
MANIDMGKILAGLENDDARVPKTKLVCTLGPASRSVPMLEKLLRAGMNVARFNFSHGTHEYHQETLDNLRQAMHNTGVLCAVMLDTKGPEIRTGFLKDGKPIKLTKGQELTVTTDYEIKGDENMITMSYKKLPVDVKPGNVILCADGTISLTVLSCDPKAGTVRCRCENTAMLGERKNCNLPGIVVDLPTLTEKDKEDILGWGVPNDIDMIALSFVRKGSDLVTVRQLLGQHAKRIKLMSKVENQEGVVNFDEILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNEAVFKEMIRSAPLPMSPLESLASSAVRTANKAKAALIVVLTRGGTTAKLVAKYRPRVPILSVVVPVLTTDSFDWTISSEGPARHSLIYRGLVPLLAEGSAKATDSESTEVILDAALKSAVQKQLCKPGDAVVALHRIGXVASVIKICIVK

SEQ ID NO: 30491 - protein, 637 aa, Escherichia coli CFT073
MIVFSSLQIRRGVRVLLDNATATINPGQKVGLVGKNGCGKSTLLALLKNEISADGGSYTFPGSWQLAWVNQETPALPQAALEYVIDGDREYRQLEAQLHDANERNDGHAIATIHGKLDAIDAWSIRSRAASLLHGLGFSNEQLERPVSDFSGGWRMRLNLAQALICRSDLLLLDEPTNHLDLDAVIWLEKWLKSYQGTLILISHDRDFLDPIVDKIIHIEQQSMFEYTGNYSSFEVQRATRLAQQQAMYESQQERVAHLQSYIDRFRAKATKAKQAQSRIKMLERMELIAPAHVDNPFRFSFRAPESLPNPLLKMEKVSAGYGDRIILDSIKLNLVPGSRIGLLGRNGAGKSTLIKLLAGELAPVSGEIGLAKGIKLGYFAQHQLEYLRADESPLQHLARLAPQELEQKLRDYLGGFGFQGDKVTEETRRFSGGEKARLVLALIVWQRPNLLLLDEPTNHLDLDMRQALTEALIEFEGALVVVSHDRHLLRSTTDDLYLVHDRKVEPFDGDLEDYQQWLSDVQKQENQTDEAPKENANSAQARKDQKRREAELRAQTQPLRKEIARLEKEMEKLNAQLAQAEEKLGDSELYDQNRKAELTACLQQQASAKSGLEECEMAWLEAQEQLEQMLLEGQSN

SEQ ID NO: 30492 - protein, 263 aa, Oceanobacter sp. RED65
MHVHALHTYPIKSCAGLTHHRLNIAQQGPEYDRMFMLVDDDGKFVTQRKHSIMAQIHVDVLDNQLHCWFQDRHCAVRIDDTQADGVTAQVWKDVVEAQVFSSEINAWFSEILGKSVRLVVQSKSASRFIDPEFSSDQKTIRFADGFPILLTTMSSLQFVNQNLGAVVDMQRFRPNLVIGGLDEPFAEDNWRVLLINGIEFEVVKPCTRCVIPSIELQTLEKQSRITKLLKQYRKTPEGIIFGQNVIHRGVGQITVGDEVEVLK

SEQ ID NO: 30493 - protein, 289 aa, Escherichia coli CFT073
  misc_feature (24)..(24): Xaa can be any naturally occurring amino acid
  misc_feature (37)..(37): Xaa can be any naturally occurring amino acid
MSAKHPVIAVTGSSGAGTTTTSLXFRKIFAQLNLHAXEVEGDSFHRYTRPEMDMAIRKARDAGRHISYFGPEANDFGLLEQTFIEYGQSGKGKSRKYLHTYDEAVPWNQVPGTFTPWQSLPEPTDVLFYEGLHGGVVTPQHNVAQHVDLLVGVVPIVNLEWIQKLIRDTSERGHSREAVMDSVVRSMEDYINYITPQFSRTHLNFQRVPTVDTSNPFAAKGIPSLDESFVVIHFRNLEGIDFPWLLAMLQGSFISHINTLVVPGGKMGLAMELIMLPLVQRLMEGKKIE

SEQ ID NO: 30494 - protein, 492 aa, Burkholderia xenovorans LB400
MEKFLVGDEWRSGNGESFESINPIDGSVAATLAQASESDVDDAVRAARQALETPAWRDMKVHERGKLLHRFADLIDQNAETLAQIQTRDNGKTISESRFQSKSAADMFRYFAAVCETTESSVIPSRGNYFCFSSFEPVGVVAAIAPWNSPITLEAQKLAPALAAGNAIVLKSSEVTPCIGLQYGRLAMEAGFPPGILNVVTGFGASVGRALVAHPGVDMVTFTGGTKSGREIAKVAGERLIPCILELGGKSPNIVFDDADIEQAVTGMLFGIFSNAGQSCIAGSRILIQEGIYDAFVARLTSATRALKVGSPYDADTAVAPVSSFHHRDHIEHFVERALSQGAVALCGGSRPSGGILDKGAYVQPTLLEVTDERSSVAHEEIFGPVACVMKFQDEEDLYRIANNTAYGLACGIWTADYKKAFRAARRIKAGTVWVNTYKIAEVNVPFGGFKQSGLGRECGIEGMREYMLEKSTYLNLADGPIPWPPRAANAV

SEQ ID NO: 30495 - protein, 715 aa, Oceanobacter sp. RED65
MIYEGKAITVKLLEDGIAELNFDLQGESVNKFNRETLEDLKASVEALKGNSDVKGLLVTSGKDCFIVGADITEFGDNFKQDEEVIIEWILEANKIFNAVEDLPFPSITAINGIALGGGFEMCLSTDYRIMSEKAKVGLPEVKLGIYPGFGGTVRLPRVIGADNAIEWICMGAENRADKALKFGAVDAVVKAEALQEQAIAMLKEAIAGELNWEAKREEKTSKLKLNPMEQMMVFETAKGFVAGQTKGQYPAPIEAIKTMQKAANFGRDKALEVEAKGFAKLAKTTESQALIGLFNNDQLLKKKAKEFDKIAKPTKKAAVLGAGIMGGGIAFQSALKGTPILMKDIAEAGIELGLNEANKLLAKRVERKKMKPAQMGEALNRIRPTLSYAEFGDVDVVVEAVVENPKVKKIVLAEVEDVVREDAVVASNTSTISIDLLAEDLKRPENFLGMHFFNPVHMMPLVEVIRGSKTSEEAVATTVAYAKQMGKTPIVVNDCPGFLVNRVLFPYFGGFAALMRDGADFRQVDKVMEKFGFPMGPAYLMDVVGIDTGKHANDVMAEGFPERMKADFKSAMEVLYENEYYGQKNKKGFYKYEEDKKGKPKKVFDESVLELLKPVCADQKDFDADDIIARCMIPMCIETVRCLEEGIVDTAAEADMGLIFGIGFPPFRGGALRYIDTIGLDKFVELADKYKDLGPLYHVTDKMRDMAAKGEKYHG

SEQ ID NO: 30496 - protein, 145 aa, Prochlorococcus marinus str. NATL1A
MLNISHYKIIAIGKIRKKWIQEGIEMYLKRLPGLEVKEIKDSTQLKEEHTIKEIISKNEFLVTLNENGQSFTSKQLATKLLNSHNQNITFVIGGASGLTSSLNNLASWQLSLSPLTFPHEIARLLLIEQLYRAKTITQGGPYHKE

SEQ ID NO: 30497 - protein, 298 aa, Neisseria gonorrhoeae FA 1090
MNPTNDLKAWQQRAQAQTELLLERFLPSGNEIPHTLHEAMRYAALDGGKRLRPMLVLAASELGGAMADAVGQAMAAIEMIHVYSLVHDDMPAMDNDSLRRGKPTCHIKYGEATALLTGDALQTQAFDVLSRPTELPAARQLAMLSVLAKAGGSAGMAGGQAIDLANVGKQMVQADLERMHSLKTGALIRAAVLLGATACPDLSDAELAVLDAYAAKLGLAFQVIDDVLDCEADTATLGKTAGKDADNDKPTYVKLMGLEAARSYAHKLVAEAVALLEPFGDKALRLRQLAEFAVARKY

SEQ ID NO: 30498 - protein, 484 aa, Ralstonia eutropha JMP134
MKQFRNFINGEFVATNKTFENRAPVDNRVIGRVHEAGQAEVDAAVAAARAALHGDWGRMPVARRVELLHAVADEINRRFDDFLEAELADTGKPRSLAAHIDIPRGAANFKVFADIVKNAPTESFEMTTPDGGTAISYALRAPLGVVAVVCPWNLPLLLMTWKVGPALACGNTVIVKPSEETPATATLLGEVMEKVGVPKGVYNVLHGFGPGSAGEFLTRHPGVNGITFTGETRTGEAIMAAAAKGVRPVSFELGGKNAGIVFADADFDKAVAGIARSAFENCGQVCLGTERVYVQRPIFDRFVQALKEKAESLRIGPSDAPGVGLGPLISAEHKAKVMSYYDVARSEGATVVTGGGAPSMPPELAEGHWVQPTIWTGLPESARVIREEIFGPCCHIAPFDTEEEAIALANATDYGLATTVWTQDLGTAHRMARAIDVGLCWINSWFLRDLRTAFGGAKASGIGREGGVHSLEFYTELRNVMVKL

SEQ ID NO: 30499 - protein, 575 aa, Glycine max
MGLKALFVWCIIWLGLAHLSLGGRVRHYKFDVEYMIRKPDCLEHVVMGINGQFPGPTIRAEVGDILDIALTNKLFTEGTVIHWHGIRQVGTPWADGTAAISQCAINPGETFHYRFTVDRPGTYFYHGHHGMQRSAGLYGSLIVDLPKGQNEPFHYDGEFNLLLSDLWHTSSHEQEVGLSSKPFKWIGEPQTLLINGKGQFNCSLASKFINTTLPQCQLKGGEECAPQILHVEPNKTYRIRIASTTALASLNLAISNHKLVVVEADGNYVSPFAVDDIDIYSGESYSVLLRTDQDPNKNYWLSIGVRGRRAPNTPQGLTILNYKPISASIFPISPPPITPIWNDFERSKAFTKKIIAKMGTPQPPKRSDRTIFLLNTQNLLDGFTKWAINNVSLTLPPTPYLGSIKFKINNAFDKTPPPVTFPQDYDIFNPPVNPNTTIGNGVYMFNLNEVVDVILQNANQLSGSGSEIHPWHLHGHDFWVLGYGEGKFKPSDEKKFNLTHAPLRNTAVIFPYGWTALRFKADNPGVWAFHCHIEPHLHMGMGVIFAEGVHKVGKIPRDALTCGLTGNKLVGNRHY

SEQ ID NO: 30500 - protein, 568 aa, Deinococcus radiodurans R1
MPPGLFSAQDSGAPTPDAGRFLGQPSSPAAGGGCDFCPYVLLSLPRFFMSDPRPAPAPAPLPGTLDGMDVLRLALTSQVYGAATETPLSPAPRLSERSGNRVLLKREDQQPIFSFKLRGAYNKMSQLSAEERARGVICASAGNHAQGVAFAGEKLGIPAVIVMPATTPDIKVQACRARGAEVILHGDSFSDAETFALALQQERGLTFVHPYDDPLVLAGQGTIALELLRQVEEDDYAVFVPVGGGGLIAGVASILKALKPGVRVIGVEPDDSDAMYQSLQAGERVRLDTVGIFVDGVAVKQVGAYTFDLTRRYVDDWVRVNTDEVCAAIKDVFDDTRAVLEPAGALSVAGLKKYAATHGLHDRTLVALTCGANINFDRLRHVAERTEIGEQREAILAVTIPERPGAFLEFIELIGSRAITEFNYRYAPREDARIFVGVQLGQPGERQELLTLLRGRGYAVLDLTEDELAKVHVRHMVGGRAPEAVNERVYAFTFPERPGALHDFLTQLQGEWNISLFHYRNHGSAHGRVLAGVQVPDAALTRFGDFLAGLGYPAHDVTSNPAYRLFLT

SEQ ID NO: 30501 - protein, 321 aa, Gossypium hirsutum
ALVLLGLHKLLPFTQTTACDVYCANLKTCFIIDIVFLLSITITAITTVKETPITRKEAGDEEDNEGRSSGRAFFAELVMAFKTLKKPMWFLLLVTCLNWMAWFPFLLYDTDWMGAEVYGGKVKGSASQQKLYDEGVRAGALGLMINSIVLAFASLGLEPVSRLIGGVKNMWGVVNLILAACLAATVWVTKVAEAWRGEHGPQILTPPPTSIKTSALALFGLLGIPLAVTFSIPFALASIYCSEEGGGQGLSLGVLNLSIVIPQMIISVISGPIDAAFGGGNLPAFVLGSILAAISALLAIFALPNPKTQLPLNSTGMAGAH

SEQ ID NO: 30502 - protein, 401 aa, Arabidopsis thaliana
  misc_feature (180)..(180): Xaa can be any naturally occurring amino acid
  misc_feature (216)..(216): Xaa can be any naturally occurring amino acid
MASATFSVAKPSLQGFSEFSGLRNSSALPFAKRSSSDEFVSFVSFQTSAMRSNGGYRKGVTEAKIKVAINGFGRIGRNFLRCWHGRKDSPLDVVVINDTGGVKQASHLLKYDSTLGIFDADVKPSGDSALSVDGKIIKIVSDRNPSNLPWGELGIDLVIEGTGVFVDRDGAGKHLQAGAXKKVLITAPGKGDIPTYVVGVNAELYSHEDTIISNAXSCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDAAEKELKGILDVCDEPLVSVDFRCSDVSSTIDSSLTMVMGDDMVKVIAWYDNEWGYSQRVVDLADIVANNWK

SEQ ID NO: 30503 - protein, 478 aa, Moritella sp. PE36
MLRRTKIVTTLGPATDRDNNLEKIILAGANMVRMNFSHGNAEDHIKRAKDVRAIAKKHNKHVAILGDLQGPKIRVSKFTDGKIQLNLGDKFCLDADFDKTAGNQERVSIDYPELSKDVFAGDVLLLDDGRVQLKVIEIKGQQIHTEVTVAGPLSNNKGINKQGGGLSAEALTDKDKADILTAAKIDVDFIAVSFPRNGSDINYARELVRAAGSNAKICAKVERAETVATEESMVDIILASDAIMVARGDLGVEIGDAALVGVQKSLINLSRKYNRVVITATQMMESMITSPMPTRAEVMDVANAVLDGTDAVMLSAETAAGDFPVETVKAMAEVCLGAETHPSINVSNHRIEYTFDSIEETIAMSTMYAANHLKGVKAIVALSESGTTPLLMSRISSGLPIFCLSPHQKTLNATALYRGVTPLQFCTEGLSQEQIVEGTYAVLKETGQVKAGDIILLTLGDKMDTVGSTNTCKILTIK

SEQ ID NO: 30504 - protein, 1310 aa, Petunia x hybrida
MESETQTIAYRQPSMLQRILSASMPMLLIAIGYVDPGKWAAMVDGGARFGFDLIMLALLFNFAAILCQYLSACIALVTDQDLAQICSEEYGKVTCIFLGIQAEVSMIALDLTMVLGTAHGLNVVFGVDLFSCVFLAATGAILFPLLASLLDNGSAKFICIGWASSILLSYVFGVVISQPESPFSIGGMLNKFSGESAFALMSLLGASIMPHNFYLHSSIVQQGKESTNLSRGALCQDHFFAIVFVFSGIFLVNYAIMNSAANVSFSTGLLLLTFQDSLSLLDQVFRSSVAPFSIMLVTFISNQITPLTWDLGRQAVVHDLFGMDIPGWLHHVTIRVISVVPALYCVWNSGAEGLYQLLIVTQVVVALVLPSSVIPLFRVASSRSIMGIHKISQLMEFLSLGTFIGLLGLKIIFVIEMIFGNSDWVNNLKWSIGSGVSTPYVFLLIAASLSLCLMLWLAVTPLKSASSRFDAQAFLQTPMPESYREHNQVDVSDTTFGLERSTQKQEPAFHVEKSLGSHPDLSTSDPDEILPESLLDFEKVHHLTTIDESKSETTFSTPSFSCPEVSASAGETAKSVLNEVSGGESVDTRDFNAASVDVVEKTLRIEGDTPTDKDDDGDSWEPDDVPKDVSENTQSYTSDGPESFKSLSVRSEDTGSGTGSLSRLAGLGRAARRQLTVVLDEFWGQLFDYHGMPTSQAKFKKLDVILGLDTKVDPKPAPVSLKLENSRGDSNAYIPSGSARVPESWINSNIYSPKQQCASGALDSGYRVPKEPASWSSHMKLLDAYVQSSSGNTLDSGERRYSSMRIPASSAGYDQQPATVHGYQISAYLSQIAKGRGSDYLNGQLESASPRSVSSLTSNHAEPLARALGQKPQSGVSSRAPPGFGSVPARNNSMQPVNTSTDLSSTENAESVAGSANSKKYYSLPDISGRYVPRQDSSLPDGRAQWYNSMGYGQSIGRSAYEQPYMTGPMRAGGPPRFEHSPSKVCRDAFTLQYSSNSGTGSLWSRQPFEQFGVAGKADVSSDHGTVQSSSTQESTSLVDLEAKLLQSFRSCIVKLLKLEGSEWLFRQDDGADEDLIDRIAAREKFLYEAETREISRLTNIGESQFSSNRKPGSAQKPEEMDYTKFLVMSVPHCGEGCVWKVDLVVSFGVWCIHRILELSLMESRPELWGKYTYCLNRLQGIVDLAFSKPRSPTSHCFCLQIPIGRQQKSSPTPISNGSLPPQAKQGRGKCTTAPMLLDMIKDVEMAISCRKGRTGTAAGDVAFPKGKENLASVLKRYKRRLSNKPVGNQEAGGGPQRKVTSPSSTSFGL

SEQ ID NO: 30505 - protein, 443 aa, Candida glabrata CBS 138
MNNTEDMFRDVENASQNMASTVNTSRMDQRQRRALTDLTSQKVNRIHTSKTIKDIPAYLSNYTADGENKNIDQAFNHSNDQDIGLVNQINSGYANVENEPGKETDHIFIDQDDLSDLDIVQEDSLREQLEEFEHDFENFVEPLSPIFNDEIQDTLDRAFKEYYRATPDMEDDDTFDAVMVTEYGSDIFRYMRKLELKYRPNPYYMAGQPELKWEYRKTVIDWIVQVHERFQLLPETLYLTINIIDRFLSRKNITLNRFQLVSATALLIASKYEEINCPTIKDIVYMVDNTYSRDDIIEAEKYMIDALDFEVSWPGPMSFLRRISKADDYEYRTRNLAKYLLETTLMESSLISALPSWLAAGAYFLSRIILGYEEWTLKHVYYSGYTHEQLYPLATLILDNCQNYEESHQAIWTKYSQPQYHQVSILVTKFLGRVSSDDMSEIY

SEQ ID NO: 30506 - protein, 481 aa, Brucella suis 1330
MPAIGFIIDGKESGGASGKTFERKDPITGKVATVAAAASLADVDTVAEAAAKAFESWSETGPNARRALLNKAADLMDSRTAEFTRLMLEETGATAPWAGFNVHLGANILREAAALTTQITGEIIPSDKPGIMSMAVRQPVGVVLGMAPWNAPVILGVRAVAAALACGNTVILRSSETCPGVHHLIIKILNDAGFPAGVANVISNAPDDAPEIVAALIAHPAIRRINFTGSTQVGRIIARRAAGHLKPVLLELGGKAPFIVLEDADLDQAVDAAAFGAFMNQGQICMSTERFIVHEKVADAFAEKLAAKARSLPAGDPRGNVVLGSLVDLKSAQRMDALIADAVAKGGRVLAGGKRDGAVVEATIIDGVTPQMDIYTQESFGPVKPIIRVKSAEEAIRVANDTEYGLSSAIFSQNVKRALALSRKLETGICHINGPTVADEAQVPFGGVKSSDYGRFGGKAAINEFTELRWITIEGPQHYPF

SEQ ID NO: 30507 - protein, 209 aa, Pyrococcus horikoshii
MGSSHHHHHHSSGLVPRGSHMMIVIMDNGGQYVHRIWRTLRYLGVETKIIPNTTPLEEIKAMNPKGIIFSGGPSLENTGNCEKVLEHYDEFNVPILGICLGHQLIAKFFGGKVGRGEKAEYSLVEIEIIDEDEIFKGLPKRLKVWESHMDEVKELPPKFKILARSETCPIEAMKHEELPIYGVQFHPEVAHTEKGEEILRNFAKLCGEL

SEQ ID NO: 30508 - protein, 350 aa, Glycine max
MVTSSQKILVTGGAGFIGTHTVVQLLKGGFSVSIIDNFDNSVVEAVDRVRQVVGPQLSQNLEFTQGDLRNRDDLEKLFSRTTFDAVIHFAGLKAVAESVSKPRRYFDFNLVGTINLYQVMAKYNCRKMVFSSSATVYGQPEKIPCEEDFRLQAMNPYGRTKLFLEEIARDIQKAEPEWKIILLRYFNPVGAHESGKLGEDPKGIPNNLMPYIQQVAVGRLPELNVYGHDYPTRDGSAIRDYIHVMDLADGHIAALRKLFTTENIGCTAYNLGTGRGTSVLEMVTAFEKASGKKIPVKLCPRRPGDATEVYASTERAEKELGWKAKYGVDEMCRDQWNWAKNNPQGYTGKP

SEQ ID NO: 30509 - protein, 857 aa, Aspergillus nidulans FGSC A4
MNCPSRTDDTLPHCDWNQNPPFLAPDLTTRQDLNGISNVREFKDAGTGVITMQHCLHDADLLSRYKRESEVLRQMHPRASLTQSVLATAVLISASGFVDWLTGTVVPFRQTTTASVGHLVLDKETMQVRRYAKRQACASGGVDGSEYNTSLHVGALFIILGVSTLACALPILVIRFSRLRIPPAFLFFVRHFGTGVLIATAFVHLLPTAFTLLGDPCLSNFWTTDYPAMPGAISLGGIFLVTLIEMVFSPVRQATRKVSKQTDQESAPPAGTDHLSGGNHEQSCDCDRSPHIRPKGPLVGRAASFSRAIHRIGEESDRIHRISSAPEASPLPRVSEVKRFTHRQGSVDEFQLSEKQKYNKDVMQVFMLEVGILFHSVFIGMSLSVSVGNEFVVLLIAIVFHQTFEGLALGSRIASLEWPDKAIQPWLMSLAYGCTYVPQSYMVTFTEQVSTPIGQAIGIATHSLYSPDSEVGLLLVGTMNAISAGLLIFASLIELLSEDFLSDESWRVLRGRRRVIACALVFLGAFCMSLVGAWALVSYSLSSLSHCASSLFTWPQMSASLPGDRELPHSQYDLNTYWGRVRHAADISDPRYEPYYWLTVLLADLCLLIDTGEPVFLPFRMSCYVLSNLVVTAGMLTPGLKTTGTLLWQIANQSLNVAINNANSNKSTPLSVSQMAKSYLMAVSASCSVALGLNALVPRLKNVSPNTKLILGRLVPFAAVSSASALNVFLMRSEEIRQGIDVYPVPEKEGEPVQSLGRSKVAAKIAVGETAISRVLNATPIMVVPPLILVQLEKRKLLSPRMVLPANLGLVLATSLFALPLALGAFPQRQAISAASLEEEFWNRGGKDGKVEFNRGM

SEQ ID NO: 30510 - protein, 341 aa, Alteromonadales bacterium TW-7
MKALSKLKAEPGIWMTDAPKPEVGHNDLLIKIRKTAICGTDVHIYKWDEWASKTIPTPMVVGHEYVGEVVDMGQEVRGFSVGDRVSGEGHITCGHCRNCRAGRVHLCRNTTGVGVNREGAFAEYLVIPAFNAFKIPDNISDELASIFDPFGNAVHTALSFDLVGEDVLITGAGPIGIMAAAVAKHVGARHVVITDVNEYRLELARKMGATRAVNVANEKLEDVMTDLGMTEGFDIGLEMSGVPSAFNSMLNNMNHGGKIAMLGIPPSDMAVDWNQVIFKGLVIKGIYGREMFETWYKMASLIQSGLNLSPIITHQYSVDDFQAGFDMMISGQSGKVILNWD

SEQ ID NO: 30511 - protein, 375 aa, Burkholderia xenovorans LB400
MPGLLPDVDREGLLEYSVVYTDRSLNHMSQLFQGVMRDISNSLKKVYNAKSAVVVPGSGTFGMEAVARQFATNRKCLVIRNGWFSYRWTQIFDMGGIPSESIVLKARPVEEGRQAAYAPPPIEEVVAAIRENKPDLVFAPHVETASGIMLPDAYLRAVADAVHAVDGMFVLDCIASGTVWVDMKASGVDVLISAPQKGWSASPCCGLVMLGELARERIEGTTSTSFACDLRKWLQIMEAYENGGFAYHATMPTDGLATLRDVMKETEAYGFDKVRAEQVELGRRVRSVLADRGFRSVAAEGFEAPGVVVSYTDDDGIRSGKKFADAGLQIAAGVPLQCDEPQDFKTFRIGLFGLDKLHDVEGAVGRFVKGLGSIL

SEQ ID NO: 30512 - protein, 348 aa, Zea mays
MAATLVDQKSVAFMIRNGSGIISVGMEEEDLTRLMIPMMSPITEIEDITAAASTVTVDARVGISTGVSAADRAKTILTLASSDSKPSDLRRPGHIFPLKYRNGGVLKRAGHTEASVDLVALAGLRPVSVLSTVMDPRDGSMAGVTVLQQMAMEHDIPIVSIADLIRYRRKREKLVELIAVSRLPTKWGLFRAYCYQSRLDGTEHIAVVKGDIGDGEEVLVRVHSECLTGDILGSARCDCGNQLELAMQLIEKAGRGVLVYLRGHEGRGIGLGQKLRAYNLQDEGHDTVEANVELGLAVDAREYGIGAQILRDIGVRTMRLMTNNPAKFIGLKGYGLAVVGRVPVISPI

SEQ ID NO: 30513 - protein, 508 aa, Pseudomonas fluorescens PfO-1
MRAAQLKAVLPRELLASVVVFLVALPLCMGIAIASGLPPAKGLITGIIGGLVVGWLAGSPLQVSGPAAGLAVLVFELVRQHGIEMLGPILLLAGFLQLVAGRLKLGCWFRVTAPAVVYGMLAGIGVLIVLSQVHVMLDASPKPSGLDNLTAFPGAVAQALPSLGWQAGLLGLSTIAVMWLWEKFRPHSLRFIPGALLGVGLATGASLLLALQVKRVEVPENLAEAIDWLKPADLLSLADPTLLIAAFAVAFIASAETLLSAAAVDRMHSGPRSDFDRELSAQGVGNMLCGLVGALPMTGVIVRSSANVQAGATTRYSTIFHGLWLLAFVLLLSSLLQSIPVASLAGVLVYTGFKLVNLKAFRGLGRYGRMPMFTYAATALAIIFTDLLTGVLIGFGLTLLKLAFKASRLKISLIDLPQEGEMELRLVGAATFLKVPALTQVLGSIPPGTTVHVPLNNLSYIDHSCLELLEEWGRANAAKGAKLLIESRGLKRRLEGRIRTTTGIGAAG

SEQ ID NO: 30514 - protein, 491 aa, Bacillus licheniformis ATCC 14580
MNVQTPSEKLVKPFDCQHYINGRYFPSEKGSTFDNINPATQEIIGSVAEGGKKEVDLAVAAARRALNGRWKNMTADERIRIIRKVGDIILERKDELARLETLDTGKPLSLSSTLDIPRAAFNFHFFADFMRGAGTEAYQTDDLAINYAIRRPVGVVGLINPWNLPLLLLTWKLAPCLAAGNTAVIKPAELTPMTATLLGEICHDAGMPDGVVNIVHGFGPDSAGAALSEHPDVDAISFTGETTTGKVIMEAASKTLKKLSFELGGKNPNIIFADADMDEAVSTSLKSSFVNQGEVCMSGSRIYVEREAYDEFLNKFVEKTKKLKVGDPFDPDTNIGALISSEHTERVMNYIELAKREGGNILTGGKRPEGQESGCFLEPTIITGLSRNSRLIKEEIFGPVVTVIPFDDEEEVIAQANDTHYGLSATLWTNDLRRAHRVAGQIESGMVWVNSWFLRDLRTPFGGMKQSGLGREGGIHSLEFFSELTNICIKL

SEQ ID NO: 30515 - protein, 205 aa, Oryza sativa
MAAAAAAKIAPSMLSSDFANLAAEADRMVRLGADWLHMDIMDGHFVPNLTIGAPVIQSLRKHTKAYLDCHLMVTNPSDYVEPLAKAGASGFTFHIEVSRDNWQELIQSIKAKGMRPGVSLRPGTPVEEVFPLVEAEMMEKVRALRKKYPSLDIEVDGGLGPSTIDVAASAGANCIVAGSSIFGAAEPGEVISALRKSVEGSQNKS

SEQ ID NO: 30516 - protein, 477 aa, Thiobacillus denitrificans ATCC 25259
MTVETTFASLALAEPILRAIADAGYTAPTPIQAQAIPHVLAGGDLLAAAQTGTGKTAGFTLPILHQLSTRAAVAPKPGRPRCLILVPTRELAAQVEESVKTYGKYLSLTSMVMFGGVNINPQFKALKARVDILVATPGRLLDHVAQKTVDLSGVEILVLDEADRMLDMGFIRDIRRVLAVLPKQRQNLLFSATFSDEIRTLANGLLNNPKSVEVARRNTTAEVVEQSMHRVPQAHKRDLLAHLIKHHDWQQVLVFTRTKHGANKLAEKLNKDGITAAAIHGNKSQSARTKALASFKDGSVRALVATDIAARGIDIDQLPQVVNFELPNVPEDYVHRIGRTGRAGATGSALSLVDDEEMGYLRDIEKLIKRAIVRVEIEPGFVPPAKADLMSDERPPRPPQGRGASRAGQNGGPRQGQGGRGGQGSGRNANRPAQGKSAAAPVKPASGRAAAPNSPAQPRKPRPQAALFSAKPGSRGH

SEQ ID NO: 30517 - protein, 351 aa, Vibrio vulnificus CMCP6
MEQPIYFYEPDENHGFLANFYPCSITVSGTCWPSSEHYYQAQKFDDVRLQEKVLRAEDAAQAFRLSREYQQWQRHDWYDIRVEVMRFIVREKFLQNTPLAHQLLATGDTELKEHSHKDAFWGDGGDGHGRNELGRILMMVREELQEHAPYNLVQFIDSAKLPTQWGTFQMYGFIEKATGKEHLALVYGDIEQQAAPLIRLHSECLTGDALFSARCDCGFQLAKALQNIVAEGAGVLLYLRQEGRGIGLINKIRAYHLQDDGADTVEANEQLGFGADMRDYAFCRGILSFLGIERVRLMTNNPRKVKALQLANIEVTERVPLQEGNNPHNHQYLRTKADKLGHMFDRNFVKP

SEQ ID NO: 30518 - protein, 506 aa, Zea mays
MMASQAMVPLRQLFVDGEWRPPAQGRRLPVVNPTTEAHIGEIPAGTAEDVDAAVAAARAALKRNRGRDWARAPGAVRAKYLRAIAAKVIERKQELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLVHTKIAKKFNERMVAWAKNIKVSDPLEEGCRLGPVVSEGQYEKIKKFILNAKSEGATILTGGVRPAHLEKGFFIEPTIITDITTSMEIWREEVFGPVLCVKEFSTEDEAIELANDTQYGLAGAVISGDRERCQRLSEEIDAGIIWVNCSQPCFCQAPWGGNKRSGFGRELGEGGIDNYLSVKQVTEYISDEPWGWYRSPSKL

SEQ ID NO: 30519 - protein, 605 aa, Prochlorococcus marinus str. MIT 9313
MVVSAMFQVPLMAQIDLTRRTKIVATIGPATESAERIRELVEVGATTFRLNFSHGDHDEHAKRISTIRQVSDELGMHIGILQDLQGPKIRLGRFDKGPITLANGDSFALTSKQVQCNQSVATVTYDKLADEVTTGSRILLDDGRVEMKVLKIDQSEQTLHCIVTVGGVLSNNKGVNFPDVQLSVRALTEKDRQDLAFGLQQGVDWVALSFVRNPSDMKEIRKLIRDHGHSTPVIAKIEKFEAIDQIDSILPLCDGVMVARGDLGVEMPAEEVPLLQKDLIRKANSLGIPIITATQMLDSMASSPRPTRAEVSDVANAILDGTDAVMLSNETAVGDYPVEAVQTMATIARRIERDYPQRPIETYLASTISNAISSAVSSIASHLNAAAIVPLTESGATAHNVSKFRPAAPILAVTNKLAVARKLQLAWGVTPLLVPTQKSTTATFSDAIAVAQELGLLKEGDLTIQTAGTLAGVSGSTDLVKVGIVSAVLGQGIGIGNGTVSGKVRFAFSPNDSTKIEPGEILVIHETSDDYLDAIRKSAGVITEQEGEEYHAEMISKRLGIPFIIGIAHATRNLLEGEVVTMQLSNGKVHRGTGGKLPMKLDSMD

SEQ ID NO: 30520 - protein, 444 aa, Chromobacterium violaceum ATCC 12472
MRLPDIRLIENTLRERLTLAPAPPGQRSGVELFGRVTEIGPTLLKASLPGASLSELCRLEPSGIEAEVVAVTGDHVMLSPFKEPLGVTIGSRVRPSGSPHQLRLGDFLLGRVVDGLGRPLDGDELPADSELRSLDGPAPNPLTRQLIDTPLPLGVRAIDGLLTCGMGQRIGIFAAAGGGKSTLLGMICDGSLADVIVLALIGERGREVREFLEHTLSEEARSRSIVVVSTSDRPALERLKAAYTATAIAEHFRDQGKNVLLMMDSLTRFARASREIGLAAGEPAAAGGYPPSFFARLPRLLERAGPAETGSITGIYTVLVEGDNLNEPVADEVRSILDGHIVLSRKLAETNHYPAIDIGASVSRIMGQIVSAEHRQQAGKLRRLMAAYKEIELLVRVGEYQPGQDAEADEALERKDAIRQFLCQSVTEKNDFEETLEQLWQTVD

SEQ ID NO: 30521 - protein, 289 aa, Chlamydomonas reinhardtii
VSYCLVSAGTILFNKHALSTFEFPAPNVLLTFQFGIAVVLLKVLHLLGFLHLEPMRWDIVKLWFPVNIIFVLMNATGFYALMSVSAGMFTVLKNLSNLLTILGDWYFFNKTYSWQVWACLGLMILSAGLGGWTDLSFSAEGYAWQLVNCIFTAAYSLHLSSVVRARRGGGGKLNELSMVYYNNVLSVPPLLLLSLMFGEPMRLRNYQHASNPEFTVVVLMGALLGFGVSFASIWCMSRTSATIYSLTGSMNKVVVAVVGMYAFREPINFTNLLSIAMGLGAGFLFVFAK

SEQ ID NO: 30522 - protein, 380 aa, Mesembryanthemum crystallinum
MVCQMEANNKVNGGGENGSSSEGRPPNPLAATYRQCYSATRVSSTCKKTLMRHPSLVKATDIPIEPLAVADCESEFLPIVRSGAWTDIGFRSNMEDAYLCVDDFIHHYGVEHINESPNAFYGVFDGHGRKHAADFACCHLPRFIFEDNDFPREIERVITSAFLQTDNAFAEACSLDAGLASGTTALAALVLGRSLVVANVGDCRAVLCRRGKAIEMSRDHKPHCSREIKRIEASGGYVDDGYLNGQLNVARALGDWHMEGMKGADGGPLTAEPELITTELTQEDEFLIIGCDGLWDVFRSQNAVDFARRRLQDHNDPVMCSRDLVDEALKRKSGDNLAVVVVCFQPQPPPNLIVPRARVQRSVSAEGLRELQSFLDGLES

SEQ ID NO: 30523 - protein, 514 aa, Prochlorococcus marinus str. MIT 9313
MDDYLQRILRARVYDVAHETPLELAKNLSRRFQNKIWLKREDLQPVFSFKLRGAYNRMSLLSQEELQRGVIASSAGNHAQGVALSASYLNCRAVIVMPITTPEMKVRAVRALGAEVALHGETYDEAYQEAMRRSEKDGLTFIHPFDDPEVIAGQGTIALEILRQIQDPPDAIYVAVGGGGLIGGIATYVKSLWPQVEIIGVEPYDAAAMKLSLEAGERIQLPNVGLFADGVAVRQVGKLTFSLAQMHVDAMVTVSTDEICAAIKDVFEDTRSILEPAGALAIAGMKADIAKRDLQDRTLVAVACGANMNFERLRFVAERAELGEEREAILAVEIPEQAGSLRKLCNVLAGKNLTEFSYRMAEGDRAQIFIGVQVLDLDDRTKLLTRLQSSGFACLDLSNDELTKGHLRHMVGGRLPASAKTLCRDGCRELLYRFEFPERPGALMTFVSALHPEWSISIFHYRNHGADVGRIVVGVLVQDNEMDDWQRFLEDLGYPNWEETNNPAYCLFLGAQTV

SEQ ID NO: 30524 - protein, 190 aa, Oceanobacter sp. RED65
MPVNLPNILTAIRVVLIPLMVVVFYLPVYWASFAAAVVFWVACITDYWDGYLARKMNLTTAFGAFLDPVADKLIVVVSLMLVVDRDNTLWLTVPALIIVGREVFVSALREWMAGVGKSADVAVSFVGKAKTLVQMTAITGLLGIEPGGHDALIASDGWYAAAIVLLVFAAVLTIWSMIQYLKAAWPVLKS

SEQ ID NO: 30525 - protein, 644 aa, Prochlorococcus marinus str. MIT 9313
MRLSELTHPNQLHGLSIAELEDVARQIRERHLEVVSTSGGHLGPGLGVVELTLALYQTLDLDHDRVVWDVGHQAYPHKLITGRYGDFNTLRQQGGVAGYLKRCESSFDHFGAGHASTSISAALGMAVARERRGESFKCVAVIGDGALTGGIALEAINHAGHMPNTPFLVVLNDNDMSISPPVGALSTHLNRMRHSAPVQFISDSVEERVKSLPFMGGELPAELDLLKGSMRRLSVPKVGAVFEELGFTYMGPIDGHDIERMVRTFETAHKVGGPVLVHVVTTKGKGYPYAEADQVGYHAQSAFDLSTGKALPSKGKKPPSYSKVFGETLIKLCQQDSTVVGITAAMATGTGLDLLQKAVPEQYIDVGIAEQHAVTLAAGMACEGLKPVLAIYSTFLQRAFDQLIHDVGIQNLPVTFVMDRAGIVGADGPTHQGQYDISYFRAIPNFTVMAPKDEAELQRMLVTCLQHQGPAALRIPRGSGEGVPLLDEGWKPLAIGRGEVLCEGDDLLIVAYGVMVPAAMITAQLLQEAGIKATVINARFLRPLDQALIHPLARRIGSVVTMEEGALAGGFGAAVVESLSDQDVLVPTFRIGIPDQLVDHASPQQSREALGLTPTQMSERIQEHFCLNSKPSLVGQEAPQALST

SEQ ID NO: 30526 - protein, 334 aa, Escherichia coli CFT073
MSGFYHKHFLKLLDFTPAELNSLLQLAAKLKADKKSGKEEARLTGKNIALIFEKDSTRTRCSFEVAAYDQGARVTYLGPSGSQIGHKESIKDTARVLGRMYDGIQYRGYGQEIVETLAEYAGVPVWNGLTNEFHPTQLLADLLTMQEHLPGKAFNEMTLVYAGDARNNMGNSMLEAAALTGLDLRLVAPQACWPEAALVAECSALAQKHGGKITLTEDIASGVKGADFIYTDVWVSMGEPKEKWAERIALLRDYQVNSKMMALTGNSQVKFLHCLPAFHDEQTTLGKKMAAEFGLYGGMEVTDEVFESPASIVFDQAENRMHTIKAVMVATLAK

SEQ ID NO: 30527 - protein, 2351 aa, Oryza sativa Japonica Group
MVSSSSPVVNVYPLANYTFGTKEPKMEKDTSVADRLARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLSEREYFAVPRNLKLLAVPLFELYDNVQRYGPVISTIPQQLSRFQFNMQVVDLKARHPDVLLMVEVGYRFRFFGEDAAVAASVLGIIAHPDHSFLTASIPTFRLGFHVRRLVAAGHKVGVVRQTETAAIKAAHGGGAAGTPFARGLSAVYTRATIEAAAGELEGGGAPDEGSRYLVCVVDKEVDAMGTEGFEVKIGVVAIEVSTGEVVHGEFMDGVSRNGLEAVLLGLAPVEVILGTPISSATEKLMVAYAGPTSNVRVERTSRLCFSEGGALAELLSLFEKSGVDAPTVENGRHLMEMNEENNNPRGIEVPLSSSELTVIAPYDWVSICSLGIMAMPELVIHALALSVRYLKGFGMDRIICFGSSFQPFTANTEMSLSANTLQQLELTHPLCDRNQICTRHDAVSEISESIGSQQYSTNNLQDEVDMSCSSSVRSDLSTILSSVLRMLAGTLDIQRGITRIFHCKATAKEGTSNDTPFGLIILVVLDKDEFVGVVQAILTAGKQLQKLVLEDTDTMSSQHRTVHSPLLRRLINTASSCTVLANAATLVSCLNKDAADQGDMLNLFIASVDQFPEVAEGHATVEMAKQKLELLITEYRKQLGLPVDRKVPSSWMKVNSTKKTIRYHTPEVSKNLENLLLAKEKLAVICRTTWNNFLMDFGRYYAQFQATVKSLATLDCLYSLATLAKQNKYVRPNFVRENEASQIHIKDGRHPVLESLLGVNFVPNDTELHANSEYCQIVTGPNMGGKSCYIRQVALITLMAQVGSFVPASSATLHAVDGIYTRMGASDSIQHGTSTFYEELSEASNILHNCSSRSLVIIDELGRGTSTHDGVAIAYATLHYLLKEKKCMVIFVTHYPKILNILREFEGSVGAYHVSYLATRKLLEVADRQMVINNTETKDLGEITFLYKLVAGASDRSFGLNVALLAQLPSSCIERASVMAAKLQQELSEREKNKFCRLMDVPRESSPKELCAQPYQGLAEACHRILFNVTSAQSNDELTDTLSSLREAREIALKAIKGWGRVGMDLSRFTAPRPGLQIGAAGNGFRACSLRRLRYRVCGGNPMGASALGGCGSRSLFYLAPNHGSPLALRTRGRALRCQGNDSLAYVDGPLEGTNGSVVDNTEDEANSSGLDEEKGDDDAENLRDLLQKARKELEVARLNSTMFEEKAQRISESAIALKDRADKAQSDVSSAVTTIQEIISKEADAKEAVRTATMALSMAEARLQLASEALDAKRGSVGPMEVSIDDVEEEALASAQEEIKECQESLSKCEEELRRIQEKKMELQKEVDRLTELAERALLDASKAEEDVANIMVLAEQAVALEMEAAQRANDAELALQKAEKAISSVDAVVELPAPAEEQVSDEEDNVSEVYDYSSDAIDDIPERDEVSNVERLTVGDLAVEGIEQLESSREMSDDESTDKLLVEPQKEAEPDIDKSKQGKKQEIERKESQPSNAPKASLKRSSRFFPASFFSSKADGEFTPTSVFKGLMKSTRKHAPKLVVGIVLLGAGAFFLNRAEKSSQLFQQQEITTSIEEVTSTAKPIVREMRKIPQRVKKLIELLPHQEVNEEEASLFDILYLLLASVVFVPLFQKIPGGSPVLGYLAAGVLIGPYGLSIIRHVHGTKAIAEFGVVFLLFNIGLEDISAYHFLPAAFCGKAKLNEEVLATTAAVGMIAHRFAVLPGPAAIVIGSGLALSSTAVVLQVLQERGESTSRHGRATFSVLLFQDLAVVVLLILIPLISPNSSKGGVGFQAIAEAMGMAAVKAIAAITAIIAGGRLLLRPIYKQIAENRNAEIFSANTLLVIFGTSLLTARAGLSMALGAFLAGLLLAETEFSLQVESDIAPYRGLLLGLFFMTVQHRGFYYLLWNDDKSLILPVGMSIDPKLLLSNFPAISVILGLLIIGKTMLVTFIGRVFGISTIAAVRVGLLLAPGGEFAFVAFGEAVNQGLLSPQLSSLLFLVVGISMALTPWLAAGGQFLASKFEQHDVRSLLPVESETDDLQDHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGATAVVPETLEPSLQLAAAVLAQAKLPMSEIAATVNEFRNRHLSELTELCATSGSSLGYGYSRVMSISKSKTVTSDDESETVDGALAI

SEQ ID NO: 30528 - protein, 375 aa, Zea mays
MADYVYGPGRTHLFVPGPVNIPDPVIRAMNRQNEDYRSPAVPALTKVLLEDVKKIFKTTTGTPFMIPTTGTGAWESALTNTLSPGDRVVSFLIGQFSLLWIDQQRRLGFDVDAAVAIVHNETATGVTNDLAAVRALLDKHAHPALLLVDGVSSICALDFRMDEWGVDVALTGSQKALSMPTGMGIVCASPRALEASKTARSVRVFFDWKDYLRFYDMGTYWPYTPSIQLLYGLRTALDLIFEEGLDNVVRRHNRLGTATRLAVEAWGLSNCCQKEEWFSDTVTAVVVPPNIDSAEVVRHAWKRYNLSLGLGLNKVAGKVFRIGHLGNLNELQLLGCLSGVEMVLKDVGYPVKLGSGVAAAAAYLSNSTPLIPSRI

SEQ ID NO: 30529 - protein, 223 aa, Pyrobaculum aerophilum str. IM2
MLKRLLAREAIRLVKSGMVVGLGSGTTAREFIKALAEAGVDDVLLVATSSDSEILAYEVGLGDRLRPMWAVDRIDLAVDGADEVTKDKVLLKGKGGALLREKIVDYAAEKFVVLIEEHKLVERIPSNNPVPVEVVPWAWRFVAREVEKRFGGVAKLRQDGGKLGPVVTDNGNYIIDWNPPGFIDPYLEDELKAIPGVVENGVFSKRRDATILVASSDGTIKTL

SEQ ID NO: 30530 - protein, 307 aa, Kluyveromyces lactis NRRL Y-1140
MDATSNSVLSPLQKEIISGLTAGTITTIVTHPLDLIKLRLQLAAIDLKPSSYYNQVQRIIKDGSGTQQLLKEAYRGLGINIIGNAVAWGLYFGLYRCSKDVVYSLSSEPALQNKFMNDRKMTSSMYLVSAGASGLATALLTNPMWVIKTRIMSTKSSQGYTSILNAITRIYTEEGLKTFWRGLVPSLFGVTQGALYFAIYDTLKLKYLHDRNDIQERRLNAVETIGIISLSKMISVSSVYPLQLLKTNLQTFRTEHNENSKMNSLIRSIWHTNGIAGFYKGLFANLVRAIPSTCITFGVYEHFKHIS

SEQ ID NO: 30531 - protein, 1101 aa, delta proteobacterium MLMS-1
MTEDTSKQVCKPAAIDSDALRANLQETAVDCIELPAKWGILLEVVADYKGIHATLEELLYEIAHPYRNWRLILPRYRSFVLKHLDHYRRHPRGPEACLRLLEILLLALAENQRQETLLLQSAEVLAALFDKLVSIIKPADLPTFHQTIQESCNRLAELDEELLRPLVAGQHSLKKTIGRLVSKCDGESEVKICELTAPARLLKRVLILNYRNWLAEEDPQPWFASECEEICQGWEAGQLFAEISHDRLRQHLATAEATDCEHDELALPKLLELPDHMDIVRLYREIPDRLSSRPGQPQETESDDRFAENRKLLFLFRIMDTGGLALIHEETLREINRGLVQLIRRQTFEEIERFLLTTLALLKSNVRRYPHTSLQCIQIIGTEVFRRGNSRLVETFLWEAVRFGFQYANVTGIGEDWQPLANPAHLANIRVWLNLIGQEPKWCSTLFSALIINLKLSGTCLKDTDLFQRDISELLNQPIEPVYNLVTQFAKQVPVFYNDIGAEGTLREVSTEMDEIHQRRDKLIHFLRKQSHVESSNLIVDFIESIILFWRDRDKNVLAPYLPEEVLREIAPEGEYVDDLHRLSKRIWALNHIHRPTDLLNWDYNQRRHYLEAQEDIPAGERRRFDLLVRMYRLCHQKYNLGTEELRQHLKQAAAGDFPEMEQLLADLEICDTFECLSALLEHLERLKEIILSEERFTAQESIYHKRHIAIDIPSVYGRYQERKFDALSLTFRLENLANTYLEKLPETVNLNIITKATFIRILKCLRLYLRALKIDGITSRKLTTYMSLLSNSLGIKRFSYTQFLDIFRGLSEGVKDVIYTYYTNIHENNLSIIIPQIGHDNLLPKYRYLWRGQDPVGNVNRLSESFMRDLIAGTFGLQHLDNFITRIHQTLEAQREVLDEDHLDLLMTYNPDRAISPLQPRHSRNANLILLGNKGYNLSLLAIDGQPVPPGLTVTTEVFRCWPVIRQFTKCRDDFMTRLRFGLNQIEERTGRRFGDPAAPLLLSVRSGAAISMPGMMATIHNVGLNEDIVGEFACQEGRGFLAWDNFRRFIQSWAMAQGVERERFQGLMNAAKERCNVRYKRDFTAEQIRELTLNTRKQP

SEQ ID NO: 30532 - protein, 552 aa, Festuca ovina
TEQWKALQAHVGAIHKTHLRDLMADADRCKAMTAEFEGVFLDYARQQATTETVDKLFKLAEAAKLKEKIEKMFNGDKINSTENRSVLHVALRAPRDAVINSDGVNVVPKVWSVKDKIKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAVSKHMIAVSTNLKLVKEFGIDPNNAFAFWDWVGGRYSVCSAVGVLPLSLQYGFPIVQKFLEGASSIDNHFRTASFEKNIPVLLGLLSVWNVSFLGYPARAILPYSQALEKLAPHIQQLSMESNGKGVSIDGVPLPYEAGEIDFGEPGTNGQHSFYQLIHQGRVIPCDFIGVIKSQQPVYLKGETVSNHDELMSNFFAQPDALAYGKTPEQLRSENVSENLIPHKTFKGNRPSLSFLLSSLSAYEIGQLLAIYEHRIAVQGFIWGINSFDQWGVELGKSLASRVRKQLHASRMEGKPVEGFNPSSASLLARYLAVEPSTPYNT

SEQ ID NO: 30533 - protein, 473 aa, Kluyveromyces lactis NRRL Y-1140
MSALLSRVAPRMSVLACAARLQLRTYASYPPYTIIGMPALSPTMVQGGLTEWSKNVGDRLEPGDVLAEVETDKAQMDFEFQEEGYLAKILVPAGTKDIPVNKPLAVYVEEESDVPAFANFTAADAESATAAKEAAKNGAKQPAKEESKEESKEGAKPASKPAAKKSSGSSASSGTRIFASPLAKSIALEHGVSLKEVEGTGPRGRITKDDVEAFLASAPSRESSAAKAAPALAAPTPASATYEDVPISNMRQIIGDRLLQSTQNIPSYIVSSQISVSKLLKLRQSLNATAKDQYKLSINDILIKAIAVAAQRCPDANAYWMPEQGVIRKFKNVDVSVAVATPTGLLTPIVKNAESKGLVSISKEIKDLGKRAKDNKLKPEEFQGGTICISNLGMNPAVSMFTSIINPPQSTILAIGTVNKVPVEDAGSEFGFTFDQKMNITGTFDHRTIDGAKGGEFMKELKKVIENPLELLL

SEQ ID NO: 30534 - protein, 497 aa, Moritella sp. PE36
MTDTFHKVAIMNKRSKKVGNAVSEVLNYVTEMNNDKPVTRAPAPVALNLTSFLSQPARVLATNSYLQRQEQRESNARSYPRRLPFALKRGQGIFVEDTEQQIFIDCLAAAGTLALGHSHPDVTTALIEAVQSEVPMQTLDLMTPIKDEFMTQLLGLLPGNMADNARIQMCSPCGSDAVEAALKLAKIATGRRSILAFSGAYHGMTHGALAMMGNLGPKSALSMTGADVQIMPFPYAPRCPYGLGEAGIKTSLYQLETMLTDPESGVAKPAAIIVEAVQGEAGSLPADPTWLKGLRDITKRHGILLIIDEIQAGMGRTGKVFAFEHADIEPDVIVVSKALGGGQPLAAIIYHNDFDKWNPGAHAGTFRGNQLAMASGLVVMRHLAQEQLHLHAGAMGAKLKHDLEAIDSNVIGDVRGRGLMLGIEIVDPNGERDVLGNLPQDGQRAKEIQQAALRRGLIIELGGRFGSTIRMLPPLIIQPEEIDVVVAILTDAINSVG

SEQ ID NO: 30535 - protein, 214 aa, Glycine max
MLCKLVPRKKKPGSNPVYLNVYDLTPINGYAYWLGLGVYHSGVQVHGVEYGFGAHERDTTGIFEVEPGHCPGFTFRKSIFIGSTDMGPKDVRAFMERLAEEYSGNTYHLIQKNCNHFCEDVCVRLTGKSIPRWVNRLARLGFLCNCVLPPSLNETKVRQVTIDRVQEGGEKKKMRSQSSRYEASPNPTLSSSQRHCLPPSSVINASPSSTLTVK

SEQ ID NO: 30536 - protein, 523 aa, Haemophilus influenzae Rd KW20
MTNIHYHKILILDFGSQYTQLIARRVREIGVYCELWAWDVTEQQIREFAPTGIILSGSPESTTEENSPRAPEYVFNAGVPVLGICYGMQTMAMQLGGLTETSDHREFGYASVSLENSTALFANLNDNLTASEPKLDVWMSHGDKVTRLPENFKVTGTTLTCPIAAMSDESRRFYGVQFHPEVTHTKKGLELLTNFVVNICGCETKWTAENIIEDAVARIKEQVGDDEVILGLSGGVDSSVVALLLHRAIGKNLHCVFVDNGLLRLHEGDQVMEMFGDKFGLNITRVDAESRFLGELAGVSDPEAKRKIIGKVFVDVFDDESKKLTNVKWLAQGTIYPDVIESAASKTGKAHVIKSHHNVGGLPDYMKLGLVEPLRELFKDEVRKIGLALGLPAEMINRHPFPGPGLGVRVLGEVKKEYCDLLRRADAIFIEELRNSGWYEKTSQAFSVFLPVKSVGVMGDGRKYDWVISLRAVETIDFMTAHWAHLPYDLLGKVSNRIINEVNGISRVVYDISGKPPATIEWE

SEQ ID NO: 30537 - protein, 452 aa, Desulfitobacterium hafniense Y51
MSNQENGMHRGLKNRHIQMIALGGAIGTGLFYGSAATIELAGPAITFSYLIGGLVIFFIMRMLGEMAVDEPVSGSFSHFAYKYWGEFPGFLSGWNYWFNYIVVSMAELTAVGIYINFWFPDIPHWLTALVCLVLVTLLNLISVGTFGEFEFWFAIVKVVAIIGMIVFGLFLIFSGINGEATGFDNLWIHGGFIPNGMIGILFSLVPVMFSFGGIELIGITAGEADNPQKSIPKAINQVMWRILIFYVGALSVLMVLYPWNQVGADGSPFVMIFSKIGIPAAATLLNIVVLTAALSVYNSGVYSNGRMLYSLAMQGNAPKLFAKLNKRGIPVAGVLVSSGITLVGVILNFLLPGKIFTYLMAVAIIAAVITWTTIIIVNLKFRKAKIAQGEGDALHFKTPLHPYTNYFCAAFLVMIVILMAFTESMKMAVLVLPIWLLILWISFKIKKSRESK

SEQ ID NO: 30538 - protein, 238 aa, Vitis vinifera
MTLDRSRSPPQAKRLRSSDRASYQDAPYPRDHRVHRQDYLCNKCKRPGHFARDCPNVTVCNNCGLPGHIAAECNSTTMCWNCKESGHLASQCPNDPVCHMCGKMGHLARDCSSPGLPAHDARLCNNCYKPGHIAADCTNEKACNNCHKTGHLARDCLNEPVCNICNISGHVARQCPKSRLVPETGGPFRDITCHNCGQPGHISRDCVSIVICNNCGGRGHQSFECPSVRMFDHVVRRY

SEQ ID NO: 30539 - protein, 449 aa, Pseudomonas aeruginosa UCBPP-PA14
MTFASLGLLDPLLKALEGLGHGTPTPIQAQAIPPALKGRDLLAAAQTGTGKTAGFALPLLQRLTLEGPQVAANSVRALVLVPTRELAEQVHASVRDYGQHLPLRTAVAYGGVSINPQMMKLRKGVDILVATPGRLLDLYRQNAVKFAQLQALVLDEADRMLDLGFARELDELFAALPRKRQTLLFSATFSDAIRTLARELLRDPLSIEVSPRNTAAKSVRQWLVPVDKKRKAELFCHLLQANRWRQALVFAKTRKSVEELVGLLQRQGIAADSIHGDKPQPARLRALQRFKAGEVDLLVATDVAARGLDIEEMPLVVNFDLPIVAEDYVHRIGRTGRAGASGQAVSLVCADEVELLAAIETLIGQTLQRREEPDFAPEHRVPQTAPGGVVLKKPKKPKKPKAAESAGKPGKIHLGSWFDSSAPTVKAVRKAPGFGAGAAGKPKKRPSGK

SEQ ID NO: 30540 - protein, 480 aa, Roseovarius nubinhibens ISM
MTETAHPTIHPVILCGGSGTRLWPLSRKSYPKQFTALVGDESLFQASARRLSGEGFGAPVVLTGEPFRFIVMEQLAAIESAPRGVLIEPEGRNTAPAVLAAALWLAEVDPEGLMLVAPSDHVIPDGAAFRAAVRAAAPRAAAGDLVTFGIRPTRAETGYGWLELQEPGHAEADAPQPLVRFVEKPDAETAEALLAAGHYLWNGGLFLFSVQGIIAAFEAHAPEMIAPVRAAVAQGEADLGFTRLAAEPWGQVAEDSIDYAIMEKAGNLAVMPFAAGWSDLGDWQAVWQESGPDGAGNVVTDHATALDCEGSLLRSENAAQELVGIGLRDMIAVAMPDAVVVAPRGESQRVKEAVAALKSRKARQATEFPVDHRPWGWFESLVIGERFQVKRIVVKPGAALSLQSHHHRSEHWIVVQGTARVTVDDDVRLVGENESVYIPLGAVHRMENPGKVEMVLIEVQTGSYLGEDDIIRYEDVYARK

SEQ ID NO: 30541 - protein, 267 aa, Clostridium acetobutylicum ATCC 824
MNILKDFSLEGKIALVTGASYGIGFAIARSYANAGATIVFNDINQDLVDKGLKAYEAEGIKAHGYVCDVTDEDKVNGFVKKVEKEVGLIDILVNNAGIIKRIPMLEMKAEDFRKVIDVDLNAPFIVSKAVIPGMIKKGHGKIINICSMMSELGRETVSAYAAAKGGLKMLTRNIASEYGEHNIQCNGIGPGYIATPQTAPLRELQADGSKHPFDQFIIAKTPAARWGTPEDLMGPAVFLASDASNFVNGHVLYVDGGILAYIGKQPQ

SEQ ID NO: 30542 - protein, 181 aa, Pseudomonas fluorescens PfO-1
MSLRKYQNHTPRLGQGAFVDGSAVVIGDVEIGEDSSVWPLTVIRGDMHRIRIGARTSVQDGCVLHITHAGPFNPDGFPLLIGDDVTIAHKVMLHGCTVGSRVLIGMGSIVMDGAVVEDDVIIGAGSLVPPGKHLESGFLYVGSPVKQIRQLTDKENAFFTYSAANYVKLKDLHLAEGYDQL

SEQ ID NO: 30543 - protein, 332 aa, Clostridium thermocellum ATCC 27405
MSFLEQIIERAKSDVKTIVLPESTDLRVIKAASMIMKKGIAKVVLIGNEKEIKSLAGDIDLEGVMIEDSLNSEKLEDYANTLYELRKSKGMTIEAARETIKDPLYYGVMMVKKGEADGMVAGAVNSTANTLRPALQILKTAPGTKLVSSFFVMVVPNCEYGHNGTFVYADCGLVENPDADQLSEIAISASKSFEMLVGAKPQVAMLSYSSYGSAKSELTEKVIKATQLAKEKAPHLAIDGELQVDAAIVPEVAKSKAKGSSVAGKANVLIFPDLDAGNIAYKLTQRLAKAEAYGPITQGLARPVNDLSRGCSAEDIVGVAAITAVQAQYVKA

SEQ ID NO: 30544 - protein, 125 aa, Bacillus licheniformis ATCC 14580
MIVKLFLILGAVNAMLAVALGAFGAHGLEGKIPEKYLQIWQTGVQYHMYHALGLIAVALIASKLAGAGSVSAAGWLMFAGIVLFSGSLYVLSLTQISVLGAITPLGGVAFIAAWIMVVVSAVKYL

SEQ ID NO: 30545 - protein, 521 aa, Oryza sativa
  misc_feature (126)..(126): Xaa can be any naturally occurring amino acid
  misc_feature (167)..(167): Xaa can be any naturally occurring amino acid
  misc_feature (325)..(325): Xaa can be any naturally occurring amino acid
MAMGLLAWMVAAAAAAVLASWAFSAVVHLVWRPRAISRRLRAQGVGGPGYRFFSGNLGEIKRFRGDGAGVVLNVSSHDFLPIVQPHFRKWIPLYGRTFLYWFGAQPNICLADVSMVWQVLSDRTGXIYPKNLTNPHFVRLLGKGLVLTDGDEWKRHRKVVHPAFNMXDKLKMMTMTMSDCSRSMMSEWESELAAKGGLVEIELSRRFEELTADVISHTAFGSSYKEGKQVFLAQRELQFLAFSTFLTVQIPGFSYLPTMKNFKTWSLDKKVRGMLMDIIKTRHANKDVAGYGNDLLGLMLEACAPEHGESCPQLSMDEIIDECTXFFFAGHDTTSHLLTWTMFLLSTHPDWQEKLREEIAMECGDKVPTGDMLNKLKMVNMFLLETLRLYSPVSLIRRKVDTDIELGGIKMPEGALLTIPIATIHRDKEVWGEDADEFRPERFENGVTRAAKHPNALLSFSSGPRSCIGQNFAMIEAKAVIAMILQRFSFTLSPKYVHAPTDVITLRPKYGLPMILKSLKL

SEQ ID NO: 30546 - protein, 485 aa, Triticum aestivum
  misc_feature (270)..(270): Xaa can be any naturally occurring amino acid
  misc_feature (288)..(288): Xaa can be any naturally occurring amino acid
  misc_feature (420)..(420): Xaa can be any naturally occurring amino acid
MASTAAPPAALVARRAASASAAAAPLRRAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIAVKKAEDVIGPEVEKLVADLENGAVLLLENVRFYKEEEKNDPEFAKKLASLADLFVNDAFGNSPQSTWPRLRGVTKFLKPSVAGFLLQKELDYLDGAVSNPKRPIRCXIVGGSKVSSKIGVIESLXLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAXELSKKGVTTIIGGGDSVAAVEKVGVADVMSHISTGGGASLELLEGKELPGVVALDEGVMTRSVTV

SEQ ID NO: 30547 - protein, 520 aa, Thiobacillus denitrificans ATCC 25259
MHQKILILDFGSQYTQLIARRVREAGVYCELHPNDVSEDFVREFAPQGIILSGGPNSVYEDETPRAPDVVFTLGVPVLGICYGMQTMAAQLGGAVESAAKREFGYAEIRARGHTQLLRDIQDRVTGEGHGMLDVWMSHGDKVTALPEGFKLMASNAATPIAGMADEARRFYGVQFHPEVTHTLQGKHILNRFVHDICGCGSDWNMPDYVEEAIGKVRSEVGSDEVILGLSGGVDSSVVAALLHRAVGDQLTCVFVDNGLLRLNEAEQVMETFAQNLGVKVIHVDATERFMRELAGVSDPEQKRKIIGREFVHVFQEEAEKLPKAKWLAQGTIYPDVIESASAKTKKAHTIKSHHNVGGLPETLHLQLLEPLRELFKDEVRELGIALGLPHDMVYRHPFPGPGLGVRILGKVKREYADLLRRADAIFIEELRASGWYEKTSQAFTVFLPVKSVGVMGDGRTYDYVVALRAVQTQDFMTAHWAELPYTLLGKVSNRIINEVRGINRVVYDVSGKPPATIEWE

SEQ ID NO: 30548 - protein, 366 aa, Bacillus cereus G9241
MGLTAGIVGLPNVGKSTLFNAITQAGAESANYPFCTIDPNVGIVEVPDERLNKLTELVEPKKTVPTVFEFTDIAGIVKGASKGEGLGNKFLSHIRQVDAICQVVRCFEDENITHVSGEVDPIDDIETINLELILADLESVDKRIERVAKLARQKDKEAVYEHEILVRLKEAFEEGKPARTVEFTEEQMKIVKGLHLLTTKEMLYVANVSEDDVIDPSENKYVQMVKEFAANENSQVIVVCAKIESEIAELDEEEKKVFLEELGIEESGLDQLIRAAYDLLGLATYFTAGVQEVRAWTFKQGMKAPQCAGVIHTDFERGFIRAETVSYEDLMTNGSMTAAKEAGKVRLEGKEYIVKDGDVMHFRFNV

SEQ ID NO: 30549 - protein, 421 aa, Acidobacteria bacterium Ellin345
MVNTIIGSGIFGIPTPLNAVVGRASPLAMVMAGLGIGLMMACAAEVSSRFTEPGGAYLYARTAFGRFVGIQIGWFSWLAPMGTSAAASNLFTSYLAAYFPFAGTALGRAAVITTLFAFLALANCVGVKVGANLSSVFTIAKILPLLLLIVLGLLYFAHHPQTFAQAQPAPAGISPWIDAMLLLSFAYGGFENAILPAGEVKNPRQTFPIALAAGLLLCIAIYSLVQFVSVATIGTAPAERPLASAAELLLGTGGAAFITVAAMISTFGHLSAVQLATPRLTYSLAERHDFPSVFARVHPRFQTPYISIMIFSAITCVLALSGTFRWAIAMASGALIVIYASICASLIRLRRMHGDEALLGIPFGPAIACLCIGFGLVLLARLTLREGFLLLVTFAIATLHWLVVRNRAYPQAIISEAGSAS

SEQ ID NO: 30550 - protein, 202 aa, unidentified eubacterium SCB49
MLIIGIAGGTGSGKTTVVQQIIDQLPICDVAVISQDSYYNDTSHLTMDERVQINFDHPSSIDFDLLEEHLTALKAGESIDQPVYSFVKHNRTGETIKTEPKRVVIVEGILILTHPEVRDLFDIKIYVHADSDERLIRRLKRDIAERGRDLEEVLTRYQTTLKPMHQEFIDPTKEFADIIIPTNRYNTVAVDVIRSVIETKLK

SEQ ID NO: 30551 - protein, 485 aa, Prochlorococcus marinus str. NATL1A
MKILDLARRTKIVATIGPATESASQISKLVEAGATTFRLNFSHGDHEEHAQRIKTIRKVSDDLGIHIGILQDLQGPKIRLGRFKNGPVNVKNGDKFILTSKNIECNQDQANVTYDKLAEEVNVGNRILLDDGRVEMKVEEVDIKEQRLICSITVGGVLSNNKGVNFPDVQLSIRALTDKDKKDLAFGLKQGVDWVALSFVRNPSDLIEIKDLIRNHGYDTPVVAKIEKFEAIDQIDAVLKLCDGVMVARGDLGVEMPAEEVPLLQKQLIKKANSLGIPIITATQMLDSMASSPRPTRAEVSDVANAILDGTDAVMLSNETAVGDYPIEAVATMATIAKRIERDYPQKALESHLPSTIPNAISAAVSSIARQINAAAIIPLTKSGATAKNVSKFRPPTPVLAVTNEKSVASTLQLVWGVTPLLIENQTSTSKTFVDAMNMAKKMKILKQGDLVVETAGTLSGVSGSTDLVKVGIVSSEDENESLFI

SEQ ID NO: 30552 - protein, 127 aa, Pyrobaculum aerophilum str. IM2
MKVRDLLKDNVIFCYADEPVECAVAKMYAANVGSVVVMDRANRPVGIVTERDIVRFLAQEIDLKTPLEQVAKKSLITVSPEESIVSAAAKMIENNIRHMPVVEGGRVVGVISIRDVLRALVTAEAFP

SEQ ID NO: 30553 - protein, 465 aa, Solanum berthaultii
MSTKPTPLELPEMSTMSLEETFHPSKVSESTESSSSSTTPLSPHTGGDVRWDAINSATGRGGPPLNLSNFRLLKRLGYGDIGSVYLVELRGTNAFFAMKVMDKGSLASRNKLLRAQTEREILSLLDHPFLPTLYSHFETDKFYCLVMEFCSGGNLHQLRQKQPNKHFTEEASRFYASEVLLALEYLHMLGIVYRDLKPENVLVRDEGHIMLSDFDLSLRCSVNPTLVKSSSVHGGGGNPSSGSGILDNDNAVQGCIQPSTFFPRNILPTKKNRKSKSDFGLFVGGSLPELMAEPTNVRSMSFVGTHEYLAPEIIRGEGHGSAVDWWTFGIFLYELLHGTTPFKGAGNRATLFNVVGQPLRFPETPQVSAIARDLIRGLLVKEPHKRIAYKRGATEIKQHPFFEGVNWALVRSAVPPSIPEPVDFAQYASKEASAPCSDKKMPDTESHDKSKNTSNDSSYMDFEYF

SEQ ID NO: 30554 - protein, 510 aa, Asarina barclaiana
MENGDHRTAPAFQLQQASPPEAAPVRNIILVAAIAAGVQFGWALQLSLLTPYVQLLGIPHTWTAFIWLCGPVSGMLVQPIVGYYSDNCTLRFGRRKPFIAGGAGLVVVAVFLIGFAADIGYAAGDTLGKGTKPRATAVFVVGFWILDVANNMLQGPCRALLADLSGGNARKMSNANALYSFFMAVGNVSGYAAGSYTHLFKIFPFSKTKACDVYCANLKSCFFISVALLLCVSALALTIVRETPPPETAEAPEATKKKKIPVFGELFSALKNLPRPMWFLLLVACLNWIAWFPFLLFDTDWMGKEVYGGTVAEGKMYDRGVRAGALGLMLNPVVLGFSSLGIQAIARGVGGPKRLWGGVNFLLAVCLALTVVITKQAEHSRLYTVGADGVQILLPPVPGVKISALALSGVLGIPLAVTFSIPFALASIYSSNYGAGQGLSLGVLNLAIVIPQMVVSVASGPLDALFGGGNIPAFVMGAVAAAVSGIFAVTMLPALPADASTKNLSVGSFH

SEQ ID NO: 30555 - protein, 511 aa, Prochlorococcus marinus str. NATL1A
MEDYLQKILRARVYDVAEETPLEKAKNLSKKFENNIWFKREDLQPVFSFKLRGAFNRMSQLSKEELDKGVIASSAGNHAQGVALSASFLKCRAVIVMPLTTPVMKVRAVESHKAEVILFGETYDECYEKALDISKKENLTFIHPFDDPEVIAGQGTIGLEILRQSQTPPDAIYIAVGGGGLIAGVSAYVKAIWPDTKIIGVEPEDACAMTLSLKANEPIELESIGLFADGVAVRKVGEKTFSICKKNVDEMVTVSTDEICAAIKDVFEDTRSILEPAGALSIAGLKKHVVNNQLKNNNLVAIACGANMNFERLRFVAERAELGEEKEAMIAVGIPEKAGSLKLLCKTLGSRSLTEFSYRISEGKTAQIFMGVEVSNNNDRELLTAEIKRGGFDCHDLSNDELSKVHLRHMVGGRLPRSISQISKGEYIELLYRFEFPERPGALMRFVNSMRPEWTISIFHYRNHGADTGRIVIGVLVNDSEIQAWNEFVKKIGYKNWDETDNPAYKLFLGA

SEQ ID NO: 30556 - protein, 611 aa, Gibberella zeae PH-1
MPSILNDDDKDTVKRFIPKQSNKIQAVGVARLYVAYPNRSKWTYTGIQGAVALVNDLVGNTYWIKMVDISPTNRGVIWDQEIFDTWNYNQDRTFFHTFELEECLAGLSFVDEKEAKQFKKKMDEREKNASRATKATPFGGGAQPSHKHGLLGGLFSHRHSTHHPTGPTPPESPRMPANSIQHHIINSTPNLNGHRQSEFSLLDAFDPLWREHFGADLQDKGLTDDFIKENQEFIVDFLREEQQKASQPHSTPPPPPAPASPANGNDGRSSRAPPPPPPPPAAGRSQDGPPAPPAPRKGGPPPPPAPRRSGKAETAPERAPSPPRPKFGVPPPLAEAGKFAHSEPPRAVSAAPNPGPPPPPRPAKTPIDSTKNENHRFGVPPPFPGSRVPPPTPSRGSVPPPPPPRSEPPAALPPPLPPKVPTSSAPPLPPPSTRPIPPPPAASSHPPAPPPLPPTTNGAPPPPPPPPPPPGGPAAPPPPPPPMPPTSGAPPPPPPPPPGGPGAPPPPPPPMPPGSGAPAPPVTGDPSRSAVLAGIQQAGGIHSLKKVDRSQIRDRSGAQVGGSDVGGNSATASAVSASGGGGGMADALAAALQKRKEKVSKSDDESDNDDW

SEQ ID NO: 30557 - protein, 496 aa, Coccidioides immitis RS
MALFQKIETPSCTYEQPLGLFINNEFVKGVEGKTFETINPHNEKPIVAVHEATEKDVDIAVAAARKAFEGEWKKVTPTDRGRMLNKLADLLEQHCDTLAAIEALDNGKAVSMAKVDVANSAGCIRYYGGWADKLHGKVVDTDHETFNYTRHEAVGVCGQIIPWNFPLLMWAWKIAPALATGNTIVLKSAEQTPLSALYACQLVKEAGFPPGVLNVISGFGRVAGAAISSHMDIDKVAFTGSTLVGRQILQAAAKSNLKKVTLELGGKSPNIVFNDADIDNAISWVNFGIYFNHGQCCCAGSRILVQEGIYEDFLQRFKERAMKNKVGDPFNPDTFQGPQISQLQFDRVMGYIDQGKKAGAKVEIGGERLGTEGYYIQPTIFSNVNEDMSIVKEEIFGPVCSIQTFKTEEDAIKIANGTSYGLAAAIHTKDLNTAIRVSNEIRAGTVWVNCYNLLSYQTPFGGFKESGLGRELGEYALDNYTQVKAVRIRLGDAMFG

SEQ ID NO: 30558 - protein, 628 aa, Prochlorococcus marinus str. NATL1A
MRLSQLSHPNELHGLAISELEDVACQIRERHLQVVSTSGGHLGPGLGVVELTIALYQTLDLDVDKVIWDVGHQAYPHKLLTGRYNRFDSLRQQKGVAGYLKRTESKFDHFGAGHASTSISAALGMAIARDRKGEDYKCVAVIGDGALTGGMALEAINHAGHLPKTPLLVVLNDNDMSISPPVGALSTYLNRMRHSPPVQFISDSVQESVKNLPFMGDAMQEEFKSLTGSVRRLAVPSVGAVFEELGFTYMGPVDGHDIAELTRTFNAAHKVGGPVMVHVATTKGKGYPYAEADQVGYHAQSSFDLTTGKSIPSKTPKPPSFSKVFGQTLVKLCEQDSKIVGITAAMAEGTALNLLQKAIPDQYVDVGIAEQHAVTLAGGMACEGIKPVVAIYSTFLQRAYDQLIHDIGIQNLPVTFVLDRAGIVGADGPTHQGQYDISYLRCIPNFTVMAPKDESELQQMLVTCINHNGPSALRIPRGSGEGAALMEEGWESLEIGKAETIEEGENLLIIGYGSMVFPAIKTAAILKEFGVNCTVINARFIRPLDEDTIHEAAKRIGKVVTMEEGTLLGGFGSAVVESFNDNDIFVPTLRIGIPDKLVDHATPQQSKESLGLTPEMMADQIRNKFNFN

SEQ ID NO: 30559 - protein, 328 aa, Saccharomyces cerevisiae
MTEILPHVNDEVLPAEYELNQPEPEHCPGPESDMAGKSDACGGCANKEICESLPKGPSPDIPLITDNLSGIEHKILVLSGKGGVGKSTFAAMLSWALSADEDLQVGAMDLDICGPSLPHMLGCIKETVHESNSGWTPVYVTDNLATMSIQYMLPEDDSAIIWRGSKKNLLIKKFLKDVDWDKLDYLVIDTPPGTSDEHISINKYMRESGIDGALVVTTPQEVALLDVRKEIDFCKKAGINILGLVENMSGFVCPNCKGESQIFKATTGGGEALCKELGIKFLGSVPLDPRIGKSCDMGESFLDNYPDSPASSAVLNVVEALRDAVGDV

SEQ ID NO: 30560 - protein, 489 aa, Arabidopsis thaliana
MAEKITRETSLPKERSSPQALILGRYEMGKLLGHGTFAKVYLARNVKTNESVAIKVIDKEKVLKGGLIAHIKREISILRRVRHPNIVQLFEVMATKAKIYFVMEYVRGGELFNKVAKGRLKEEVARKYFQQLISAVTFCHARGVYHRDLKPENLLLDENGNLKVSDFGLSAVSDQIRQDGLFHTFCGTPAYVAPEVLARKGYDAAKVDIWSCGVILFVLMAGYLPFHDRNVMAMYKKIYRGEFRCPRWFSTELTRLLSKLLETNPEKRFTFPEIMENSWFKKGFKHIKFYVEDDKLCNVVDDDELESDSVESDRDSAASESEIEYLEPRRRVGGLPRPASLNAFDIISFSQGFDLSGLFDDDGEGSRFVSGAPVSKIISKLEEIAKVVSFTVRKKDCRVSLEGSRQGVKGPLTIAAEIFELTPSLVVVEVKKKGGDKTEYEDFCNNELKPKLQNLTADDVVAEPVAVSAVDETAIPNSPTISFLPSDTE

SEQ ID NO: 30561 - protein, 433 aa, Roseovarius nubinhibens ISM
MNDASPIPNDLDSFWMPFTSSRAFKAAPRLVSGAKGLYYTTVDGREVFDGTGGLWCSNAGHGHPRIIEAIQKQAAEMDFAHCFGQGHPIAFQAASRMVALAPGFDHVFFTNSGSESVDTALKIALGYHSARGEGQRRILVGRQKAYHGINFGGLSVGGIGLNKGQFGTLYPSAQHLRHTNLPENRMSKGQPETGAHLAEDLAMICETHGGHNVAAVIVEPVAGAGGVFPPPKGYLERLREICDQHGILLIFDEVITGFGRMGTPFASQHFGVKPDIFTAAKGMTNATVPMGGVFTTAKVREAFLSGPEALPDLFHGYTYSGHPLASAAAIATLDVYRDEGIFENAAKMAPIWEEMLHSFADVPDVIDIRNMGLIGAMEIDPNSSRTAPELAKKAWDIGLSFRPIGNNFAMSPPLTIDEEHIGKVKDMLTKVLR

SEQ ID NO: 30562 - protein, 291 aa, Desulfitobacterium hafniense Y51
MSKSNLKIGFVGTGVMGRSMVKNLLKDGYSVAVYNRTKSSAEELFALGVQWVDSVAGLARLSDVVITMVGYPKDVEEVYLSEEGLIPNAKPGSVLIDMTTSSPLLAQRIALAGKAGGIDVLDAPVSGGDVGAQNGTLVIMVGGEEGVFDKVKPIFEAMGKNIILQGPAGAGQYTKMANQITVAGGMIGVCEAIAYAQKAGLDPSRVLDSIAGGAAGSWSLSNLGPRMIAGNFEPGFYVKHFIKDMNIALESAKEMGLMTPGLELAKSLYEQLAAEGEENSGTHALYKLYMK

SEQ ID NO: 30563 - protein, 340 aa, Legionella pneumophila subsp. pneumophila str. Philadelphia 1
MKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLSDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 30564 - protein, 329 aa, Corynebacterium glutamicum
MSAELFENWLLKRARAEHSHIVLPEGDDDRILMAAHQLLDQDICDITILGDPVKIKERATELGLHLNTAYLVNPLTDPRLEEFAEQFAELRKSKSVTIDEAREIMKDISYFGTMMVHNGDADGMVSGAANTTAHTIKPSFQIIKTVPEASVVSSIFLMVLRGRLWAFGDCAVNPNPTAEQLGEIAVVSAKTAAQFGIDPRVAILSYSTGNSGGGSDVDRAIDALAEARRLNPELCVDGPLQFDAAVDPGVARKKMPDSDVAGQANVFIFPDLEAGNIGYKTAQRTGHALAVGPILQGLNKPVNDLSRGATVPDIVNTVAITAIQAGGRS

SEQ ID NO: 30565 - protein, 307 aa, Alteromonadales bacterium TW-7
MPTTDYQRVLNEITQEVAPLLSKGKVADYIPALAEVDPEQFSIAIYTTEGEIICAGDCSQRFTIQSVSKVMTLTMALQRYGDELWNRVGKEPSGTAFNSLTQLEFEKGVPRNPFINAGAIVTCDALYSRLSAPMHSMLETFRLLSGNRGIVIDKKVANSEYEFRHRNAAMAHLMKSFGNFENDVDDVLWSYFNFCSIELNCVELAKAYSFLANKGVDQLSGEQVLSSRQNKQLNSLLFTSGLYDAAGDFGYRVGMPGKSGVSGTILAVLPNKFTVAVYSPGLNSFGNSVAGIAALELLSKKLDISIF

SEQ ID NO: 30566 - protein, 488 aa, Glycine max
MVNWAWLMTELMESDLGKLFIGGISWDTDDERLKEYFGKYGEVIEAVIMRDRTTGRARGFGFVVFADPSAAERVIMDKHIIDGRTVEAKKAVPRDDQQTINRQTGSIHGSPSPGRTKKIFVGGLPSTITESDFKKYFDQFGTITDVVVMYDHNTQRPRGFGFITYDSEEAVDRVLYKTFHELNGKMVEVKRAVPKELSPGPTRSPLIGYNYGLNRTSSFLNSYAQGFNMNPIGGYGVRMDGRFSPLTSARSGFTPFGSSGYGMGVNLDLGLNPSYGGTSGYGGNLGYGRMSPFNDGNSNRYTTPIGNSGGNGRSGSLMNSASRSVWGNGGLNNAVNSPVSPGAYLGSGSGTFGVSIGNAGTNWGPSVPTQGGGAASGYSTWGSYEGGDNSIGLGGGGYGRNSSPSVPQSSTFTAPTGDYEGSYGDLYRNGSVYSDSTLRSAASEIDASGSFGYGGLGGIASDDLVKSSEGFIGNYNVISRQTNRGIAA

SEQ ID NO: 30567 - protein, 328 aa, Thermoanaerobacterium thermosaccharolyticum
MSIIQSIIEKAKSNKKKIVLPEGAEPRTLKAADIVLKEGIADLVLLGNADEIRNAAEGLDISKAEIIDPLKSEKFDKYATDFYELRKNKGLTLEKAKETIKDNIYFGCMMVKRRLCSGLVSGAIDATADLLRPAFQNVKTAPGAKIVSSFFIMEVPNCEFGENGVFLFADCAVNPSPNAEELASIAVQSANTAKTLLGMEPRVAMLSFSTKGSASHELVDKVRTATEIAKNLIPDVAIDGELQLDADVVKEVAELKAPGSPVAGRANVLIFPDLQAGNIGYKLVQRLAKANAIGPITQGMGAPVNDLSRGCSYKDIVDVIATTAVQAQ

SEQ ID NO: 30568 - protein, 306 aa, Bacteroides fragilis YCH46
MRKVIGIGETILDIIFRNDQPSAAVPGGSVFNGIVSLGRMGVNVCFISETGNDHVGNIILQFMRDNHIPTDHVNVFPDGKSPVSLAFLNEHSDAEYIFYKDYPKQRLDVLFPSINEDDIIVIGSYYALNPVLRDKILELLDIAKEKRAIVYYDPNFRSSHKNEAMKLTPTIIENLEYADIVRGSLEDFYYMYGIKDVEKIYKDKIKFYCPLFLCTAGAERISLRTNAISKEYPVAPLEAVSTIGAGDNFNAGLIYGMLKYDVRYRDLQHLSEETWDKVIQCGQDFAAEVCKSFNNSISGEFAANYR

SEQ ID NO: 30569 - protein, 635 aa, Medicago sativa
MPKSSKKSATKVDAAPVVVSPVKSGKKGKRQAEEEVKAVSAKKQKVEEVAAKQKALKVVKKEESSSEESSEESEDEKPVAKAPAPSKKTPAKNGNVKKAQPETTSEESDSDDISSDEEEVKKPAAKAVPSKNGSAPVKKDDESSEEDSDESSESSDEDKKPAAKAVPSKNGSAPAKKDDSSEEEDSEDSDEDEKPAAKAVSSKNGSVSAKKDDSSSDEDSESSDEEDKKPAAKASKNVSAPTKKAASSSDEESDEESDEDEDAKPVSKPAAVAKKSKKDSSDSDDEDDDSSSDEDKKPVASKKEVSESESDSSDDDHKMNIDKDSSDSDESEEESEDEPLKTPQKKIKDVEMVDAGKSGKKAPNTPATPNETSGSKTLFVGNLSFDVKRSDIENFFQGCVEVVDVRLASDGDGVFKGFGHVEFATAEAAQSALEMNGQELLHRALRLDLARERGAFTPNNNSNYSAQSGGRGQSQTVFVRGFDKNLGEDEIRAKLMEHFGGTCGEPTRVSIPKDYESGYSKGFAYMDFKDSDSFSKALELHESELDGYQLSVDEAKPRDSQGPGGRGGGGRIGGGRFGEGGRTGGFGGRSGGRGGGRFGGRDSAGRGGRGGRGGRGGFNKPSFASEGKKTTFADD

SEQ ID NO: 30570 - protein, 326 aa, Capsella bursa-pastoris
MNCLRAIALSLSLFLMGMVGPIQAQLQMNFYANTCPNAEKTVQDFVSNHISNAPSLAAALIRMHFHDCFVRGCDGSVLINSTSGNAERDATPNLTVRGFGFIDAIKAVLEAQCPGIVSCADIIALASRDAIVFTGGPNWNVPTGRRDGRISNASEALANIPPPTSNFTNLQTLFANQGLDLKDLVLLSGAHTIGVSHCSSFTNRLYNFTGRGDQDPALDSEYAANLKSRKCPSPNDNKTIVEMDPGSRKTFDLSYYQLVLKRRGLFQSDSALTTNPTTLSNINRILTGSVESFFSEFAKSMEKMGRINVKTGSAGVVRRQCSVANS

SEQ ID NO: 30571 - protein, 415 aa, Bacteroides fragilis YCH46
MKQLSTRAEMQYNIHTLSNGLRIIHEPSSSKVAYCGFAVDAGTRDEAENEQGMAHFVEHLIFKGTRKRKAWHILNRMENVGGDLNAYTNKEETVIYSAFLTEHFGRALELLADIVFHSTFPQNEIEKETEVIIDEIQSYEDTPSELIFDDFEDMIFRNHPLGRNILGRPDLLKKFRSEDAMAFTSRFYQPSNMVFFVLGDFNFQKIVRQVEKLLVDLPLVTVENQRTIPPLYVPEQLVVHKETHQAHVMIGSRGYNAYDDKRTALYLLNNILGGPGMNSRLNVSLRERRGLVYTVESNLTSYTDTGAFCIYFGTDPEDVDTCLKLTYKELKRMRDVKMTSSQLMAAKKQLIGQIGVASDNNENNALGMAKTFLHYNKYESSESVFRRIEALTAEGLLEVANEMFAEEYLSTLIYR

SEQ ID NO: 30572 - protein, 1349 aa, Staphylococcus aureus subsp. aureus NCTC 8325
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKLIEKESVQSTTGNKVEVSTAKSDEQASPKSTNEDLNTKQTISNQEALQPDLQENKSVVNVQPTNEENKKVDAKTESTTLNVKSDAIKSNDETLVDNNSNSNNENNADIILPKSTAPKRLNTRMRIAAVQPSSTEAKNVNDLITSNTTLTVVDADKNNKIVPAQDYLSLKSQITVDDKVKSGDYFTIKYSDTVQVYGLNPEDIKNIGDIKDPNNGETIATAKHDTANNLITYTFTDYVDRFNSVQMGINYSIYMDADTIPVSKNDVEFNVTIGNTTTKTTANIQYPDYVVNEKNSIGSAFTETVSHVGNKENPGYYKQTIYVNPSENSLTNAKLKVQAYHSSYPNNIGQINKDVTDIKIYQVPKGYTLNKGYDVNTKELTDVTNQYLQKITYGDNNSAVIDFGNADSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVTLLNEKGEVIGTTKTDENGKYCFDNLDSGKYKVIFEKPAGLTQTVTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 30573 - protein, 542 aa, Microcystis aeruginosa PCC 7806
MRGESLVAWAAQQNSLDSSSAVNSQTVGDIPELVLILILLLLIATAVALVTQRLRISYVAGLVLAGLPITDLLSRRIGLDPFLVLNLFLPILIFEAAINTDISRLRSTFKPIALLAGPGSVFSAAIIAVLVKFGLGLDWIPALLVGVILANTDTVSIIAVFKEIRVPSRLSTIVEGETLFNDAAALVTFNLLLVIYATGTISTTQVIKEVLIVALGGGLVGAVLGYLCLPIYVRLRDPLSSLLLTVALALGAFQLGQFLGVSGAVAVVIAGLVFGNLGLPRSASASDRITLISFWEYAGFIVNTFIFLLIGIEINPLTLWQTLPSIVLVILAYQLGRILSVYSLLWVLRWIDRPIPLRWQHILILGNIKGSLSMALAVAIPLTLTGRELIIELVFGAVLFSLVIQGLALPWLIKKLDISQVSAVTREIGQLQLQLIASKAAQDELANLLKSGVLPKAVYEELWASYQAKVAVSERLLRDAYNQSRSGQRSPNNGQLDAIRRRLFLAEKAALSDALRKRIVPEDLVQSYVKGLDEKLLSLDDD

SEQ ID NO: 30574 - protein, 485 aa, Acidobacteria bacterium Ellin345
MKSLHSYIGGRFVPGKRGFADINPADGSVAATVTEASAEMVDEAVAAARKALHGEWGKLGARGRATVLYKIAEGIEKRFDCFVQAEVADTGKPLSLASRLDVPRAAANFRVFADVIKIAGLEAFETELPDGRRALNYTVRKPIGVVGIVTPWNLPLLLLTWKVAPALACGNAVVVKPSEETPATATLLAEVMQEAGVPDGVYNVVHGFGPNSAGEFLVSHPGVNAVTFTGESQTGASIMRACAPTVKPVSFELGGKNAAVIFADCDFDATIAGMSDAVFLNTGQVCLCAERVYVERRIFDRFVAALTERAKSYDLGWPMEPATSMGPLISKVHREKVLSYFDLAREEGATVVIGGGVPTFGDGRDSGFYVQPTIFTGLKESARCVKEEIFGPVCHVAPFDSEEEAVALANDTRYGLAASIWTSDLQRAHRVAPQMNAGITWVNCWFLRDLRTPFGGVGLSGIGREGGMHSLNFYSELNNICIRTE

SEQ ID NO: 30575 - protein, 78 aa, Neisseria gonorrhoeae FA 1090
MSNIEQQVKKIIAEQLGVNEADVKNESSFQDDLGADSLDTVELVMALEEAFGCEIPDEDAEKITTVQLAIDYINAHNG

SEQ ID NO: 30576 - protein, 284 aa, Triticum aestivum
NKFVQKSRLVPVRNSRDIVDPRVRALVSLSLSPPCAPAASSSSNHLLTPPSLAGGSGSIRRGGPRGNAGLALTLPAGRRGREWRAPVSSFSSFLPSFFTGSKKKEEEDAKKAATLKEELLAAIAPLDRGAEATPEDKDRVDQIAQQLEEVNPTKEPLKSELLNGKWELLYTTSTSILQPQRPKFLRPYGMIYQAINTDTLRAQNMETLPYFNQVTANLVPLNSRKVAVRFDYFKIFSLIQIKAPGSGKGELEITYLDEDLRVSRGDKGNLFVLKMADPLYRVPL

SEQ ID NO: 30577 - protein, 413 aa, Acidobacteria bacterium Ellin345
MATHTPHRPAASVTLESIEQARARIRADVYFSPCNHSHSISKIAGQRVYLKLENLQMTGSFKERGALNKILTLSNDEKQRGVIAASAGNHAQGVSFHATRHGIRARIVMPMMTPLVKVNATRGYGAEVILHGADYDEAYEEACRLAALEGLVFIHPFDDPQVIAGQGTIALELLEQAPDMEAVVVPIGGGGLISGIACALKSLRPDIRVIGVQAARMPSMQSALQAHKAVTIDSNTTIADGIAVRRSGDLTVHLVESYVDELVVAEEEEIASGILTLLEREKTLAEGAGAAAVAALLHHKTSLKNEKTVALVCGGNIDVSLLARIIQRGLAKDGRLVRLQIHLSDRPGSLHQLTRLLTVHQANIVELHHDRTYYGVNLGDTMIDVTLEARGEEQIQQILHGLRQEGYRHERIV

SEQ ID NO: 30578 - protein, 181 aa, Candida glabrata CBS 138
MGLFASKLFSNLFGSKEMRILMVGLDGAGKTTVLYKLKLGEVITTIPTIGFNVETVQYKNISFTVWDVGGQDRIRSLWRHYYRNTEGVIFVVDSNDRSRIGEAREVMQRMLNEDELRNAVWLVFANKQDLPEAMSAAEITEKLGLHSIRNRPWFIQATCATSGEGLYEGLEWLSNNLSNQS

SEQ ID NO: 30579 - protein, 450 aa, Yersinia pestis CO92
MTKHYDYLAIGGGSGGIASINRAAMYGKKCALIEAKQLGGTCVNVGCVPKKVMWHAAQIAEAIHLYGPDYGFDTTVNHFDWKKLIANRTAYIDRIHQSYERGLGNNKVDVIQGFARFVDAHTVEVNGETITADHILIATGGRPSHPDIPGAEYGIDSDGFFELDEMPKRVAVVGAGYIAVEIAGVLNGLGTETHLFVRKHAPLRTFDPLIVETLLEVMNTEGPKLHTESVPKAVIKNADGSLTLQLENGTEVTVDHLIWAIGREPATDNLNLSVTGVKTNDKGYIEVDKFQNTNVKGIYAVGDNTGVVELTPVAVAAGRRLSERLFNNKPDEHLDYSNIPTVVFSHPPIGTIGLTEPQAREKFGDDQVKVYTSSFTAMYSAVTQHRQPCRMKLVCVGAEEKIVGIHGIGFGMDEILQGFAVAMKMGATKKDFDNTVAIHPTAAEEFVTMR

SEQ ID NO: 30580 - protein, 381 aa, Cicer arietinum
WRSLRRACATKIFSPQQLDSTQFHRKRKVQDLLNYVQKCCEKGEALDFGEVVLATVMNSISETFISMDLFHYCDPSNDDDNKKSREFKEMVFGIMEEVGRPNVVDFFPFLKLFDPQGVRTRMRNHFEKLLAFFYEVMKERMRLRASGESKEYKDVLDSFLDLLNEENSQLCRHDVLHLFTDLFVAGIDTTSTTMEWAMAELLHNPSKLARLRKELEQIHGKFGQIEESDASKLPYLRAVVKEILRLHPSVPFLVPHKSKDDGELGGFMVPKNAQILVNVWSIGRNSSIWDNQIHLNLKDFWRVKLISKGRDFELVPFGAGRRICPGLPLASRSIHYIMASLLHHFNFKLADDLKPDDMDMSHKFGVTLHKAQPLRVVPIKA

SEQ ID NO: 30581 - protein, 200 aa, Candida glabrata CBS 138
MSEPDFNDFEESTNDDKYKVSEKKTVDEYKKLDAEDESLAKWKESLGLSSDVLPLEFPGDTRKVVIQKIQLLVDTEKEPITFDLTNETTIKELASKRYKVKEKSIYKLRITFKVQHEIITGLRYVQYIKKAGIAVDKIDDHLGSYAPNTKQKPFYEVELPESEAPSGFLARGNYSAVSKFIDDDKTTHLTLNWGVEIVKK

SEQ ID NO: 30582 - protein, 206 aa, Saccharomyces cerevisiae
MKLLMSDHQVDLINDSMQEFHVKFLGPKDTPYENGVWRLHVELPDNYPYKSPSIGFVNKIFHPNIDIASGSICLDVINSTWSPLYDLINIVEWMIPGLLKEPNGSDPLNNEAATLQLRDKKLYEEKIKEYIDKYATKEKYQQMFGGDNDSDDSDSGGDLQEEDSDSDEDMDGTGVSSGDDSVDELSEDLSDIDVSDDDDYDEVANQ

SEQ ID NO: 30583 - protein, 528 aa, Citrus sinensis
MESTEAGAAAAAPTKNQSSIELRQPPPPPSSPMWKIVMVASIAAGVQFGWALQLSLLTPYVQLLGIPHKWSSLIWLCGPISGMIVQPIVGFHSDTCKSRFGRRRPFILAGAVLVAIAVFLIGYAADIGHSAGDSVTDSVKTRAIIIFVIGFWILDVANNTLQGPCRALADLSSGSSNKKTRTANSFFSFFMAVGNVLGYAAGSYTHLYHMLPFTKSKACDVYCANLKTCFFLSIALLITLTTIALFYVTEQRLEEIDDKETAPSTKDPFFSEIFGALKGLQKPMWILLAVTALNWIAWFPFLLFDTDWMGREVYGGNSKGSAEELRVYNNGVRAGSLGLMLNAIVLGFTSLGVEVLAKLIGGVKRLWGVVNFLLAVSLAFTFLITKLAESNRRSVTTAGGATHILPPPVGVKVGALAIFTVLGIPQAITFSVPFAMASIFSRTSAAGQGLSLGVLNLAIVVPQMLVSLLSGPFDAVCGGGNMPAFMVGAVAAALSGIVALTLLPSTTADVPPPITEAGTATANQTNKL

SEQ ID NO: 30584 - protein, 588 aa, Citrus hybrid cultivar
  misc_feature (9)..(9): Xaa can be any naturally occurring amino acid
QEFGTSLKXRFLAAKPRTLDGFSLSSNGVSKFQSFVSKPQGFVPKERPLLICKAEAAASASADGQPLLGEAEKPKFFGIEYTTFKKIIPLGLMFFCILFNYTILRDTKDVLVVTAKGSSAEIIPFLKTWVNLPMAIGFMLLYTKLADKLSKQALFYTVIVPFIAFFGAFGFLLYPLSNAIHPQALADKLLNILGPRFLGPLAIMRIWSFCLFYVMAELWGSVVISVLFWGFANQITTVDEAKRFYPLFGLGANVALIFSGRTVKYFSNLRKNLGPGVDGWAVSLKGMMSIVVLMGLSICGLYWWVNNNVELPTRSKKKKEKPKMGTMESLKFLVSSRYIRDLATLVVAYGISINLVEVTWKSKLKAQFPSPNEYSSFMGDFSTATGIATFTMMLLSQFIFDKFGWGVAAKITPTVLLLTGVGFFSLLLFGDPLGPALAKFGMTPLLAAVYVGAMQNIFSKSAKYSLFDPCKEMAYIPLDEDTKVKGKAAIDVVCNPLGKSGGALIQQFMILTFGSLANSTPYLGGILLVIVLAWLGAARSLDTQFTALRQEEELEKEMERAAVKIPVVSENEGGNGTLPRWISFECSR

SEQ ID NO: 30585 - protein, 251 aa, Vitis vinifera
MPINRIAIGTPGEASHPDALKAALAEFFSMLIFVFAGEGSGMAFNKLTDSGSSTPAGLVAAALAHGFALFVAVSVGANISGGHVNPAVTFGAFIGGHITLLRGILYWIAQLLGSVVACLLLKFSTGGLETSAFSLSSGVSVWNALVFEIVMTFGLVYTVYATAVDPKKGNLGIIAPIAIGFIVGANILAGGAFDGASMNPAVSFGPAVVSWSWANHWVYWAGPLIGAAIAAIIYDLIFIDSTHEQLPTTDY

SEQ ID NO: 30586 - protein, 422 aa, Brassica napus
MRGLVNKLVSRSLSVSGKWQHQQLRRLNIHEYQGAELMGKYGVNVPKGVAVSSLDQVKNAIQQVFPDETELVVKSQILAGGRGLGTFKSGLKGGVHIVNRDQVPDIAGKMLGQVLVTKQTGPQGKVVSKVYLCEKLSLVNEMYFSIILDRKSAGPLIIACKKGGTSIEDLAEKFPDMIIKVPIDVFAGITDEDAAKVVDGLAPKAADRKDSIEQVKKLYELFRKTDCTMLEINPLAETSTNQLVAADAKLNFDDNAAFRQKEIFALRDPTQEDPREVAAAKVDLNYIGLDGEIGCMVNGAGLAMATMDIIKLHGGTPANFLDVGGNASEHQAVVEAFKILTSDDKVKAILVNIFGGIMKCDVIASGIVNAAKEVSLKVPVVVRLEGTNVEQGKRILKESGMKLITADDLDDAAEKAVKALAN

SEQ ID NO: 30587 - protein, 464 aa, Aeropyrum pernix K1
MERFDLVVVGGGPGGYPAAVRAAQEGLNVALVEMDSLGGECTNYGCIPTKALLHPAGLVASLARLKFVKGSVDVDFKGLMEWVDSVVKGVSNGVSTLLKGYGVEVVKGRAKIRPGVVEVDGSGSIGYSKLVLALGTSPASIPGLEPDGEVVHNNRTILGLRRKPGRMLIVGGGYIGVEYATAMARLGVEVTIVELLDRLLPNMQRDFSRVVERRLRAEGVKIHTKSKVEAVERRERYAVVEVSGVGKMEYDAILVAVGRRPNTGDVGLEKLGVKLDKAGYIQVDGATLETGVPGVYASGDVTGPPLLAHRAFLQAVVAAERAAGDSSAAFDAKAVPAVVYTDPELATVGLTLEEARAAGVDAAETRLPLASLPRVGAIEGCRECFAKVVYDRSSRAILGFHVAAPHASEIIAEAALAIEMGATLEDLALTIHPHPSVSEALKEVAELALERPIHYILRRGGARR

SEQ ID NO: 30588 - protein, 293 aa, Zea mays
IIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFSNYKPRTDLPNVVELYMKKELEVEKFITHSVPFAEINKAFDLMA

SEQ ID NO: 30589 - protein, 185 aa, Debaryomyces hansenii CBS767
MLSQLTRNIARPQFVRTFRTSMPSFVAVGDKIPSTTLFESSPGNNVNLAEETSNGKSVIIGVPGAFSPACSSSHVPGFLSKLRDFNNKGYQKFFIVSVNDAFVMKAWGSLLLGNIDGDQISFLADPQAEFVSALDLKFDATKAFGNERSKRYALLVEDGKVTETFVEPDNISVDVSDAEKVLSQI

SEQ ID NO: 30590 - protein, 383 aa, Glycine max
MKKRFFFLLRRRKMALGDDAQHHSHSPSFLDSLLCEERETFEEDFDANGDECETENNDPSVIKSQPLPLVLYDNDLFWEDDELVSLIAKEGETHLRSFSDGALEGPRVEAVNWVSKVSGHYGFSALTTVLAVNYFDRFITSLKFQRDKPWMTQLAAVACLSLAAKTEETHVPLLLDLQVEESRFVFEAKTIQRMELLVLSTLKWRMLPVTPISFFEHIVRRLGLKSRLHWEFLWRCERVLLNIIADSRVMSYLPSTLAAATMIHVIKEIESFNATEYIDQLLGLLKISEEQVNKCYRIIQKLLGCHEGIYGLPQKCKRLSELGSPSAVTDASFSCDSSNDSWAVSSSVSLSLEPQLKRRRSQDQQMRLPSVSRVSIDVLNSPH

SEQ ID NO: 30591 - protein, 429 aa, Chromobacterium violaceum ATCC 12472
MKPPRLLRRLANPQRLSGPILEAVLPGVAVGELCEIRRNWQEREVVARAQVVGFQHERAVLSLIGNARGLSREAVLQPTGRALSAWVGEEALGAVLDPTGRVVERFSPAAAGGGEARDIDSDPPPYSRRVGVREPLATGVRAIDGLLTCGVGQRVGIFASAGCGKTMLMHMLIEQADADVFVIGLIGERGREVTEFAEALRGSDKRDRCVLVFATSDFPSVDRCNAALLATTVAEYFRDQGKKVVLFVDSMTRYARALRDVALAAGEPPARRGYPASVFDSLPRLLERPGATGAGSITAFYTVLLESDDEPDPMADEIRSILDGHIYLSRKLAGQGHYPAIDVLKSASRVAGQVTDTGQQQAAAAVRGLLARLEELQVFIDLGEYRPGENADNDRAMSLRDPLRRWLRQRMDERAAYRDTLESMDGFRA

SEQ ID NO: 30592 - protein, 293 aa, Zea mays
IIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMA

SEQ ID NO: 30593 - protein, 634 aa, Prochlorococcus marinus str. MIT 9313
MEVGMVLKQSDGLKTAVARSADNRYSAASNLRNVRGWRARGTFHCLHRTPADRTGVDNEPSTFIPKALRTSPIPAESVEIRFDEISDALAAIRNGECVVVVDDERRENEGDLICAAQFATPEQINFMATEARGLICLAMQGSRLDQLDLPLMVDRNTDANQTAFTVSIDAGPEKGVSTGISAEDRARTIQVALHPETRPRDLRRPGHIFPLRASQGGVLKRAGHTESAVDLSQLAGLAPAGVICEIQNSDGSMARLPQLQNYARRWGLKLINIADLIRYRLENERFVYRQATADLPSLFGSFQAIGYLNGLDGSEHIALVKGDPRKLKEPVLVRMHSECLTGDAFGSLRCDCRPQLEAALARIEQEGEGVVVYLRQEGRGIGLINKLKAYSLQDGGLDTVEANESLGFPADLRNYGVGAQILTDLGIHRLRLLTNNPRKIAGLGGYGLQVESRVPLVICPGDHNAAYLAVKREKLGHLIDAGKSENKAPEVGPFVVVAWDGEVNGETLAKLRTRAHDWAKSNELELIAESSPRLLALWDRPLFVWRVCPRVKTSSEVSSDPLKKASLELLLQELIQWSGSRRIGLLRTDRAEQAMHPPQDLKREERSLATLFKDDFSPLKDWDATSFPNLILWS

SEQ ID NO: 30594 - protein, 379 aa, Oryza sativa Japonica Group
MAKDGGGPDWNGLLKWSLAHGDGTAKPRSLSEEDKKWFMEAMQANTMDVVKRMKEITQVMKTPDDVLQSQGVTPENIEDMLDELQEHVESIDMANDLHSIGGLDPLLGYLKNSHAGIRAKAAEVVSTIVQNNPKSQQLVMESNGLEPLLTNFSSDASTNSRTKALGAISSLIRHNQPGVAAFRLGNGYSALRDALGSDDARLQRKALHLLQYLLHDNKADRSVATELGLPKLMMHLASSDDSGVREAALGGLLELARDNTSGAGNVLPDQDKLKDVLKSRIEGISTMDADDLSAHREERQLVDSLWKECYNEPSSLREKGLVVLPGEDAPQQPPPDVVGSMFEPPLRAWAASRPPPKEDSESESAKKDPPLLLGPGPSS

SEQ ID NO: 30595 - protein, 142 aa, Brassica napus
  misc_feature (130)..(130): Xaa can be any naturally occurring amino acid
PISSPDTKSSSLTRHHPILKTLLQPPISHYATQSSKFPEYEMPTVTWGVIQGKKEKLVNRVKVCDHLKTLGVITDELETIELPSTLEVISERLEFLHKLGLTIDDVNEYPLMLGCSVRKNLIPVLAYLEXIGLSRSKLGEFV

SEQ ID NO: 30596 - protein, 176 aa, Aeropyrum pernix K1
MTGCLKIGPGDEAPDVVNVVIEIPMNSSVKYEFDKEACIVKVDRFLYTSMVYPFNYGFIPGTLEEDGDPVDVLVISREPVAPGSLIEAVPVAVLDMEDEEGPDSKVVAVPKAKLDPLFASYKDVGDIPDALKSKIKHFFEHYKELEPGKWVRVTGWRPAADAKEIIRRAIERYKGA

SEQ ID NO: 30597 - protein, 576 aa, Azoarcus sp. EbN1
MPFTMHGLPVSQGIAIGHVHLVSHAMLEVNHYHVASKYLPEEMDRLDEAVATVQGELIGLKAAATAGQSHSEVGAFVDLQLMMLSDPMLVDAARELIEARRCNAEWALVQQMEHVVEQFEQIEDPYLRERKADVVQVVERLVKVLLGHPGHLPPKRRDGLGTIVVAHDLSPSDTIGFRDHNIGGFVTDVGGPTSHTAIVARSLRIPAVVGLHHIRQLVEEDELLIIDGTRGVVIVGPDEHIVEEYRLRRTELEVERSKLNRLKDTRATTLDGENVNLLANIEGPKDLNQVKAVNADGVGLYRTEFLFIGRDALPDEEEQYEAYRAVLKSMPGKPVTIRTFDVGADKALNGVGTRFEPNPALGLRAIRYSLAEPQMFKTQLRALLRASAHGQLQIMIPMLAHAHEIDQTLTLIEKAKVELRAERVKFDERLAVGGMIEVPAAALALGMFIRRLSFLSIGTNDLIQYTLAIDRSDEAVVHLYDPLHPAVLKLISGTIQAGARFGLPVSVCGEMAGDAAYALLLLGMGLRNFSMHPGNILEIKQQVLRADVGELAPRVQRILKMDEQSKIREAVLRLAG

SEQ ID NO: 30598 - protein, 650 aa, Neisseria gonorrhoeae FA 1090
MNEFSLAPIVVVLLVSVITVILCRKFNIPSMLGYLLVGFLAGPGMLSLIPKSHATDYLGEIGIVFLMFSIGLEFSLPKLRAMRRLVFGLGGLQVGVTMLSVMGILMLTGVPFNWAFAVSGALAMSSTAIVSRILSEKTELGQPHGQMAMGVLLMQDIAVVPLMILIPALAGGGDGNIWAALGLAFAKMLLTLGLLFFVGSKIMSRWFRMVAKRKSSELFMINVLLVTLGVAYLTELEGLSMALGAFVAGMLLSETEYRFQVEDDIRPFRDILLGFFFITVGMKLDIQALIGGWRQVLMLLAMLLVLKALVVFAIAFKMKHSVGDSLKTALYLAQGGEFGFVMLAIAGQLDMVSPELEQAATAAVLLSMIIAPFLLGGSDALVGRLVKSSWDMKSLDLHSMLVEAMSKSDHVLIVGFGRGGQTVGRVLAQEDIPYFALDLDIARVQVARSAGEPVSFGDAKRREVLEAAGLGRAKMVVVTLNNMHETQHVLDNVLSMHPNMPVYARATNDDYVKTFTDMGAEEAVSDTKETGLVLAGYAMLGNGASYRHVYQTMANIRHSRYAALEGLFVGSDDEAGFGENGETVRHAFPLAAEAYAVGKTVGTLPMAAYGIKLLFVRRRTGRIENPDASFTLEGGDVLVVAGKKKRNYLF

SEQ ID NO: 30599 - protein, 555 aa, Prochlorococcus marinus str. MIT 9313
MSEKMSRHFDRGSFRAVSDVHQLMSFPDFSASDAHVQWQRFNNLLWHHNDLGIWLDISRMHINAEDFERLGPRFDQAFKAMQALEQGAIANTDEQRMVGHYWLRQPQLAPDQEVCDHIAKEIDLIETFGSNVINGLIKAPNGKKFTDVLWIGIGGSGLGPLLMIRALQNAEQGLRFHFFDNVDPDGMSRVLGNLGDALSTTLVVTVSKSGATPEPHLGMEQARQRLEAMGGHWAGQAVAVTMLNSQLDQLAQKESWLKRFDMFDWVGGRTSITSAVGLLPAALIGCDIRAFLAGAAQMDEATRVSDLHSNPASLMAAAWFVAGDGLGRRDMVVLPYRDRLEVFSRYLQQLVMESLGKRLDRDGNVVHQGLAVYGNKGSTDQHAYVQQLRDGVDNFFATFIEVLEDVENIPAINNEHPGDFLDGFLQGTRAALSQGGRQSLTISMRRFDPRRLGALVALFERAVGLYGELVNINAYHQPGVESGKKAAAAILNLQSRVEDLLADGVERSAGEIHQVIGDGSEEAIFWIMRHLTANKRGYVAEGDWGIPTSLRFSKG

SEQ ID NO: 30600 - protein, 547 aa, Physcomitrella patens subsp. patens
GEALLSFKRGLSNANRSLSNWNASHPNPCLWSGVTCLPKSDRVYILNLPRRNLRGIISPEIGKLDQLRRLGLHHNNLFGTIPREINKCTNLKALYLRGNFLTGNIPEQLGDLERLKILDVSNNGLTGSIPESLGRLSQLSFLNVSANFLVGKIPTFGVLAKFGSPSFSSNPGLCGLQVKVVCQIIPPGSPPNGTKLLLISAIGTVGVSLLVVVMCFGGFCVYKKSCSSKLVMFHSDLPYNKDDVIKRIENLCDSDIIGCGGFGTVYRLVMDDGCMFAVKRIGKQGMGSEQLFEQELGILGSFKHRNLVNLRGYCNAPLANLLIYDFLPGGSLDDNLHERSSAGERLNWNTRMNIAIGSARGIAYLHHDCVPRIIHRDIKSSNVLLDEKLEPHVSDFGLAKLLEDESSHVTTIVAGTFGYLAPGIGRATEKGDVYSYGVMLLELISGKRPTDASLIKNNLNLVSWVTSCARTNQVEEIVEKSCLDEVPIERIESTLNIALQCISPNPDERPTMDRVVQLLEADTLSRVPSDLSNFYCSPISDHEGRGR

SEQ ID NO: 30601 - protein, 141 aa, Triticum aestivum
  misc_feature (55)..(55): Xaa can be any naturally occurring amino acid
PDLPDELIFHINYLGADQPTFTLNFSKGSSQVIAQYYQLIRLGFEGYRNIMDNCXRENAMVLKEGLERPGWFNIASQDQRVPLARLPLRDSSATRTTARSRSVMRPRRSGAGPSGTTMTTPNGSDAGRRASGQTGTAPAPR

SEQ ID NO: 30602 - protein, 461 aa, Physcomitrella patens subsp. patens
MAQSGKPLHPQLDQHNTKELNLTVVSSVLVRSMAQFEAYRRGVGDMTYCRGVVCMRRESGLDRGRECFLGLMCGGLSRECLLEWGCVRGFLTCFVRAWMNYEEFDLRSMYEAIPVVFGRRSQPRFQFIVMNRQSTDNLVENLLGDFEYEVQAPNLLYRNANQETNYILFTNKRECEEVDSLFQRILNAFSKPPSKPRLIPASSDYVELEAAPTSVNFEGPLERGPIASSTMLEMQDEPLERRLNTVRTSTPDIVPSTATRPPINHSVQSRTSVPASPTLAPMPLSSILSSTTASPLNSLAPPLPLDTPDNPSAGRATLIKPSFFVPPFSSVHSTPSAPLIPSSTPVVPSHGAPLLQPYPPPNPPHSLSPAMQQGVPVTRDGVRDALNRLVKVRLLSVLLQSSTSHSRFWVSVFKSSRKFQHLGAPLQLKKWGSEEVLSMCSESSENLCFCAGGHESFGESL

SEQ ID NO: 30603 - protein, 343 aa, Neisseria gonorrhoeae FA 1090
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAVSEAGALKGVLGYNTLPLVSMDFNHTTEASHFDATLTKVVDGNMVKVFAWYDNEWGFSCQMLNTARRMFGLEVRPLK

SEQ ID NO: 30604 - protein, 165 aa, unidentified eubacterium SCB49
MATINKNLSEYDKATIPNAKDFRFGIVVSEWNDDVTEGLFQGAFDAILDCGGIKENIVRWNVPGSFELIYGCKKMQQSYDMLDAVIAIGSVIQGETKHFDFVCDGVTQGIKDLNIQSDIPVIFCVLTDNHKQQSLDRSGGIHGNKGTEAAIAAIKMAQLRKDAKF

SEQ ID NO: 30605 - protein, 500 aa, Arabidopsis thaliana
  misc_feature (343)..(343): Xaa can be any naturally occurring amino acid
MYRTAASRAKALKGILNHNFRASRYASSSAVATSSSSSSWLSGGYSSSLPSMNIPLAGVSLPPPLSDHVEPSKLKTTTLPNGLTIATEMSPNPAASIGLYVDCGSIYETPQFRGATHLLERMAFKSTLNRSHFRLVREIEAIGGNTSASASREQMGYTIDALKTYVPEMVEVLIDSVRNPAFLDWEVNEELRKVKVEIGEFATNPMGFLLEAVHSAGYSGALANPLYAPESAITGLTGEVLENFVFENYTASRMVLAASGVDHEELLKVVEPLLSDLPNVPRPAEPKSQYVGGDFRQHTGGEATHFALAFEVPGWNNEKEAIIATVLQMLMGGGGSFSAGGPXGKGMHSWLYLRLLNQHQQFQSCTAFTSVFNNTGLFGIYGCTSPEFASQGIELVASEMNAVADGKVNQKHLDRAKAATKSAILMNLESRMIAAEDIGRQILTYGERKPVDQFLKTVDQLTLKDIADFTSKVITKPLTMATFGDVLNVPSYDSVSKRFR

SEQ ID NO: 30606 - protein, 561 aa, Prochlorococcus marinus str. NATL1A
MKSEDCYEIEFDDIADALAAIRNGECVVVVDDEKRENEGDLICAAQFATPQQINFMATEARGLICLAMQGERLDELDLPLMVDRNTDSNQTAFTVSIDAGPEFGVSTGISAEDRAKTIQVALNSQTKPIDLRRPGHIFPLRAKIGGVLKRAGHTEAAVDLSLLAGLSPAGVICEIQNLDGSMARLPELKKYAQERKLKLISIADLIHYRLENERFVYRQAVAKLPSLFGDFKAIGYKNELDGSEHVAIIKGNPENLKEPVLVRMHSECLTGDAFGSLRCDCRPQLEAALSRISEEGEGVVVYLRQEGRGIGLVNKLKAYNLQDGGLDTVEANEKLGFPADLRNYGVGAQILTDLGINRLKLLTNNPRKIAGLGGYGLQVESRVPLVICPGDHNAAYLEVKREKLGHLIDNNIQTNLTNERQNIVVYWDGKVNDSELKHFENKACKWSENHFLNISIQTAPRLIALCENPLFIWNVRHRDIKTHLEGNFIDKRLLESLLKELSNWKNTERVGIIKTDNYERLLHPSSNITIESKKISELSNFENSPLFDWNLKDKTSTFEWS

SEQ ID NO: 30607 - protein, 259 aa, Prototheca wickerhamii
EFEIRMSTMASPCSSLRPTRLLGPSGSQLAYWPDHTPDCMHRDPPPSRSNGKTDSSRPRASTSTPALPGYAKGVSLSSSNAKMMAEDPASEASSLDIPTRKTKTVCTIGPTSCDREAFFRLADAGMNVVRLNMSHGDHASHQQVIDLVREYNALGRRNLAIMLDTKGPEVRSGDLTQPLDLEKGDLITFTIVAGADGTNNRIGVNYDGFIDDVEVGDMLLVDGGIMTMLVKSKSDTEVLVEVLGLGHEISRHLTFGEVR

SEQ ID NO: 30608 - protein, 822 aa, Candida glabrata CBS 138
MSENLPRSDDLDATWNFIQPGIDQILGNDSTEVTNKKVQKILSPTMYMEIYTAIYNYCVNKSRSSGHFNADRQQSGSSGQSSILVGSEIYERLKKYLRHYISNFKKDSNETFLQFYVRRWKRYTIGAIFLNHAFDYMNRYWVQKERSDGKRHIFDVNTLCLMTWKEVLFDPHSDELITEILDQITAERNGEIIQRDHITTSIKSLVALGIDPQDLKKLNLNVYIQVFEKKFLKKTETYYQQYSEDYLTTHSVTEYIFKAHEIISREEKGMAMYWDDHTKKPLSETLNEVLVKSHIEKLESEFIVLLDSRDNSKISALYSLILRDFSLLPRLANVFEEYIRKSGENEVSQLISAHKAAVMEASADGNGTKKMAMATTQSLPPKDYIKALLKVYNTFKNIDRECFPTDPLFAKALDNACRAYININEFALPSGSSRSATSKTSEMLAKYSDQLLKKSTKPEVANDMSDDDIITIFKFITDKDAFESHYRRLFAKRLIHGTSTSSDDEESIIKRLQTENSMEYTGKITKMFQDVRLSKMLESDFDVMIKSQSDYSREKFPELQPFVLAENMWPFSYQEVDFRLPEELVASHKKLESMYIGKHNGRILKWLWPLCRGELKADIGKPGRVPFVFTVTLFQMSILLLFNDKDVLTFEEIQEGTNLNIQNIASSMVPFIKFKLVQQLPPGLDNLVKGDTQFKLNRPYKAVKTQINFAAGVKNDILGTISKSSNSVSNGVSGISDEKLSESEKIEKELNAERQMFLEACIVRIMKTKRNLPHSTLVNECIAQSHQRFKAKISMIKRAIDSLIQKGYLQRGEDGESYTYLA

SEQ ID NO: 30609 - protein, 314 aa, Yersinia pestis CO92
MTSKNIAVIGECMIELSQKGTDLSRGFGGDTLNTAVYIARQVSAPDLNVHYVTALGTDSFSEEMLTAWQQENIQTDLIQRMDNKLPGLYFIETDESGERTFYYWRNDAAARFWLTSPAADDICQRLETFDYLYLSGISLAILDSASRQRLLKLLRACRAKGGKVIFDNNYRPRLWQSKEETQEAYRDMLACTDIAFLTLDDEDMLWGEKPLEQVIDRTQALGVSEIIIKRGADSCIVWVKEGSEAQQYDVPAVKLPKEDVVDTTAAGDSFSAGYLAVRLTGGNAHDAAVRGHLTASTVIQYRGAIIPLAAMPTA

SEQ ID NO: 30610 - protein, 217 aa, Oryza sativa Japonica Group
MAASDSDSDADAAAAAAASLLPAPIHLLPPDALHNVLLRLPLRDAVVCRPPRSPILASGAAAVFALCDVGTPWRSQWKLFSCPLSMLTGGWAPVERSAWGDVFEILKRPRLLAGAGGRRVLMIGGLRSSFAIDAPCSTVLILRLDLATMEWDEAGRMPPNMYRCFTGLCEAAAQGNAMPTAVCWVATTRSRCLAVMARCGLLESGCEGSWQCGRRMS

SEQ ID NO: 30611 - protein, 304 aa, Glycine max
MQEQIYQILYVHTALQIMALGVVGTEAHHTTLNMEHPLIMDLHHMEVVEVTIQPHQLPQVVEAMIQLHHHPQVVGGSYNPTPSTPPSGGSYDPTPSPPSGGGGSYNPTPSSPPVGGSHDPTPSPPSGGGGSYNPTPSTPPGGGSYDPTPSPPTDGGSYNPTPSPPSGSNCGTPPHDPSTPTPSVPTTPSTPTTPSTPSTPSHPPSGGGGYYNSPPTYGGGSPPTPITVSPPSTPIDPGTPTIPSTPPYLPSPTPFTGTCNYWNTHPGIIWGLLGWWGTLGHAFGVSSMPGFGASLSLPQALCNT

SEQ ID NO: 30612 - protein, 427 aa, Methanocaldococcus jannaschii DSM 2661
MLYNMDERFEIKDIVAREVIDSRGNPTVEVEVITKGNGYGSAIVPSGASTGTHEALELRDKEKRFGGKGVLMAVENVNSIIRPEILGYDARMQREIDTIMIELDGTPNKSRLGANAILAVSLAVAKAAAATAKIPLYKYLGGFNSYVMPVPMMNVINGGKHAGNDLDLQEFMIMPVGATSISEAVRMGSEVYHVLKNVILEKYGKNAVNVGDEGGFAPPLKTSREALDLLTESVKKAGYEDEVVFALDAAASEFYKDGYYYVEGKKLTREELLDYYKALVDEYPIVSIEDPFHEEDFEGFAMITKELDIQIVGDDLFVTNVERLRKGIEMKAANALLLKVNQIGTLSEAVDAAQLAFRNGYGVVVSHRSGETEDTTIADLSVALNSGQIKTGAPARGERTAKYNQLIRIEQELGLSKYAGRNFRCPF

SEQ ID NO: 30613 - protein, 533 aa, Roseovarius nubinhibens ISM
MKLQSQILTGSEDFAANRAAHEAALAEIREAADWAAAGGGAGARERHVGRGKMLPRRRVANLLDPDSPFLELGATAAHGMYDGAAPCAGVITGIGRVQGRDCMIVCNDATVKGGTYYPMTVKKHLRAQEIAEECHLPCIYLVDSGGANLPNQDEVFPDRDHFGRIFYNQARMSAKGIAQIAVVMGSCTAGGAYVPAMSDVTIIVRDQGTIFLAGPPLVKAATGEVVSAEDLGGGDVHTRLSGVADYLAEDDAHALALARRAVGSLGGATLAPVTGGGEEPAYDPEEILGVVPGDLRTPYDIREVIARVVDGSRLDEFKSRFGETLVTGFAEVQGMPVGIIANNGVLFSEAAQKGAHFVELCSQRKIPLVFLQNITGFMVGRKYENEGIARHGAKMVTAVATTSVPKITMLVGGSFGAGNYGMSGRAYQPRFLWTWPNSRISVMGGEQAAGVLATVKRDAIERKGGSWSAEEEAEFKQPTIDMFERQSHPLYASARLWDDGIVDPRKTRTVLGLSLRAALNAPIEDTKFGVFRM

SEQ ID NO: 30614 - protein, 327 aa, Idiomarina loihiensis L2TR
MKRLLPTLRADQTSESLISVINTIQIAAKEISFRLHQGALAGVLGSTLDENIQGETQKKLDVVANQLLKTLLLESPNVHAVASEEEDSIVESPNSGHYLVAFDPLDGSSNIDINGGVGTIFSILRKPEGEETSENMFLQPGKAQVAAGYVLYGPATMLVMTTGKAVRIYTLDQTVGEFLLTHEKAEIPKDTKEFAINMSNRRHWADPIRAYISDLLEGEEGPRGKNFNMRWNAAMVSDVHRVISRGGLFTYPWDARKPEKPFKLRLLYEAAPMAMLVEKAGGKATDGYSRLMEIVPEHIHQRVSVVMGSANEVDVCMDYHKQHPKPY

SEQ ID NO: 30615 - protein, 176 aa, Idiomarina loihiensis L2TR
MSLGNVTAGANMPEEVNVIIEIPANADPIKYEVDKDTGTLWVDRFMATAMFYPANYGFVNQTLSLDGDPVDVLVPTPYPLQAGSVIKCRPVGVLKMTDESGEDAKVIAVPVSKLTKEYDHINDVDDLPELLKAQITHFFERYKELEKGKWVKVDGWGDAAAAKEEIVSSFERAKKS

SEQ ID NO: 30616 - protein, 535 aa, Burkholderia xenovorans LB400
MSTTPNTRASDHPAASQPPSCKVSMNPQQAPASPAGKRPAPPCTLVIFGAGGDLTKRLLMPALYNLAVDSLLDDGMKIIGVNHGARETSEWRDDLHKSLEQFAADKASTFHAGKLDDQAWDWVAQRLEYMAGEFETDDTFAQIKQKLEQTPGGNVIFYLAVSSRFFEPIVERLGNAGLLKEGDVGGFRRLVIEKPFGSDLASARDLNAHILSFAKETQVYRIDHFLGKDTVQSILAVRFANALFEPIWRREYIDSVQITASETIGVEGRGKFYEQTGAFRDMVPNHLFQLLGMVAMEPPNSFDAEAVRDRKAEIFDAIKPLTPDDVVFGQYEKGPAGVGYREEPDVAPDSTTETYAAARVFVENWRWAGVPFYLRTGKRLAGRRTEISVQLKPVPFRLFRDTPVDALTPNVLTLRIDPAHGTSFDFNVKTPGPVMQIGAVQSSFDYGDFFAERANVGYETLLYDCMLGDETLFQRADSIETSWCAVDDVLHPESGGAMPVHGYPAGSEGPAEADALLARGGHAWRPLQRDVVEKK

SEQ ID NO: 30617 - protein, 245 aa, Mycobacterium sp. JLS
MGRVDGKVALISGGARGMGAEHARALVAEGAKVVIGDILDDEGKALADELGDAARYVTLDVTQADQWEAAVATAVNDFGLLNVLVNNAGIVALGQIGKFDMTKFQKVIDVNLTGTFLGMQASVEAMKAAGGGSIINVSSIEGMRGAVMVHPYVASKWAVRGLTKSAALELGPHQIRVNSIHPGFIRTPMTKHFPDNMLTIPLGRPGQSDEVATFVVFLASDESRYATGAEFVMDGGLVNDVPHKI

SEQ ID NO: 30618 - protein, 341 aa, Coprinopsis cinerea okayama7#130
MANEEPPSTDLITLTRHVLSDQIRLGSSATGDLTLLLNAIQLTSKFIATNVRKARLINLVGLAGETNVQGEEQKKLDVLSNDIMVNALRASGKTAVLVSEELDEAIFIDDPYKGKYCVVFDPLDGSSNIDAGVNIGTIFGIYKVQPESTGTIEDVLRPGREMVAAGYTMYGSSCNLVMSTGNGVNGYTLDAALGEFILTHPNITIPPRGKIYSFNEGNSMYFYPPTTAYLKSIKYPANNKSPYSARYIGSMVADVHRTLLYGGIFGYPSDKKSKSGKLRLLYEAFPMAYLTEQAGGIATTGTQRILDITPKTIHERCPVFLGSRDDVQELMRFYKEVPLEG

SEQ ID NO: 30619 - protein, 200 aa, Clostridium acetobutylicum ATCC 824
MIIKQAEFIISAAWKKQFPIDGKDEIAFVGRSNVGKSSLINAITNRRKLVKVSGTPGKTRLVNFFMINNDFYFVDLPGYGYAKVSKKELEKWSQTIEGYLVGREQLKKVILLVDSRHKPTKDDITMYNWIKYYDYKCIVIATKSDKIKRSEKVKNEKLIKETLKFNDSDEFYFFSSATKQGRDELINNICSGINYSENSL

SEQ ID NO: 30620 - protein, 596 aa, Glycine max
DFENLVPKFIKVFPKEYKRVLASTKSKEASKDAVESASNHGEEQDEIELVEEDAFEKLKKLATASINGKPSEAESSKRPSQVIDPVKHRGFVAYERESVQYRDPNARINDWNEVMKETKPGPLLKTQSARCMDCGTPFCHQENSGCPLGNKIPEFNELVYQNRWREALDRLLETNNFPEFTGRVCPAPCEGSCVLGIIENPVSIKSIECAIIDKAFEEGWMVPRPPARRTGKRVAVVGSGPSGLAAADQLNKMGHTVTVYERADRIGGLMMYGVPNMKTDKVDIVQRRVNLMAEEGINFVVNANIGHDPLYSLDRLREENDAIVLAVGATKPRDLPVPGRELSGVHFAMEFLHANTKSLLDSNLQDGNFISAKGKKVVVIGGGDTGTDCIGTSIRHGCSSIVNLELLPQPPQTRAPGNPWPQWPRIYRVDYGHQEGAAKFGKDPRSYEVLTKRFVGDENGVVKGLEVIRVLWEKDETGRFQFKEIEGSEEILEADLVLLAMGFLGPEPTIAEKLGIERDNRSNFKAEYGRFSTSLKGVFAAGDCRRGQSLVVWAISEGRQAAAQVDSFLTNEDIEHNVAGSPDDKLQHKFAVPNKQ

SEQ ID NO: 30621 - protein, 175 aa, Triticum aestivum
MPPPVMAWSATSVAPLQGLESTGVLPVSRRSNGDSLDSVSNGGRIMCMQVWPIEGIKKFETLFYLRPLSTEALLKQVDYLIRSKWVPCLEFSKVGFIFREHNASPGYYDGRYCTMWKLPMFGCTDATQVIHEVEEVKKEYPDAYVRIIGFDNMRQAQCVSFIAFKPPGCEESGKA

SEQ ID NO: 30622 - protein, 602 aa, Oryza sativa Indica Group
MKKKKSSHLGGPTCHTPTLSWAPDVWWYIPGPVFTSIRFSSLPWPGSKRGAAMEKRRRLVVAGDGEGDGGEASGSAARGLVESLPEALLVEVVVRLELEAACSAASSCRALRAAAAAAFSAVTSLDLSMFPPTNAILNRILAGNGALRCLAVNCSLLDDSAVGAIAKGSLRELSLLKCSSFSSYLFVAVGERCKNLRSFVLEMAASDDDEHFGICRKSIAHIVKGCGYLENLSLKFFPLLGPGSVDFESLVPIPSTIKVLLLQPVSNWQAKRLFPISTSLKTSISNTLESLSLVLDIITDELVAFITGSLHNLVELCLEDNPMKEPDLHNDLTNVGLQALGLCHNLAHLSLTRGKQNCSSTFRRVTDFGIMMLADGCKQLKTIRLAGFSKVRDAGYAALLQSCKDLKKFEVSTGYLSDLTCLDLDEAAPKITEVRLLCCSLLTSETAISLSSCTKLEVLDLSGCRSIADSGLASISQLSKLTLLDLAGADITDAGLSALGNGRCPMSSLCMRGSMRHNLGKSSLRMLDLSYCSRLSRNFLGLFEPPFFRGLRWLGVGKNMLERRGCSPTVAELLERKPGLTVCGNACEMGCRNQCHPDIRRQ

SEQ ID NO: 30623 - protein, 193 aa, Clostridium acetobutylicum ATCC 824
MSLVPYVIEQTSRGERSYDIYSRLLKDRVIFLGEEVNDTTASLVVAQLLFLESEDPDKDIYLYINSPGGSITSGMAIYDTMQYVKPDVSTICIGMAASMGSFLLTAGAPGKRFALPNSEIMIHQPLGGFKGQATDIGIHAQRILEIKKKLNSIYSERTGKPIEVIEKDTDRDHFLSAEEAKEYGLIDEVITKH

SEQ ID NO: 30624 - protein, 276 aa, Oryza sativa Indica Group
MSAPSDPAVATHPQAGAAAAASSSSGLTFKLHPLVIVNVSDHHTRVKAQAACSGDGASSAAAGGQPPRVFGCVIGVQRGRTVEIFNSFELVLDPVSGTLDRAFLEKKQELYKKVFPDFYVLGWYSTGSDVRDTDMQIHKALMDINESPVYLLLNPAINLSQKDLPVTIYESGIHSAIKMLNSRVRVIHQYLVSMQKGDMPLDNSLLRQVSSLVRRLPAMESEKFQDDFLMEYNDTLLMTYLAMFTNCSSTMNELVEKFNATYERSTARRGGRGAFM

SEQ ID NO: 30625 - protein, 119 aa, Glycine max
LVMHSAQREIRERHHYTVDCVVAIYVGILLWKMTGFIWSHEATSSNRRLTKFEKIQSRLIQASKDSDIDEVRELLKEIELSNEESKNQTGIKYSRLFRSATIVFALVIVVLAFTLTSDG

SEQ ID NO: 30626 - protein, 336 aa, Thiobacillus denitrificans ATCC 25259
MRVLLTGGAGYIGSHTAVECLAAGHDVVVFDNLSNSSEKSLERVARIAGKPVSFVRGDIRDRHALRKLFAEHAVDAVVHFAGLKAVGESVEHPLRYYDNNIGGSIALFETMAEVGLKTIVFSSSATVYGDPVRVPITEDFPLSATNPYGRSKLFIEEMLRDIARSDGGWHIALLRYFNPVGAHASGLIGEDPRGIPNNLMPYIAQVAVGRRPHLNVFGGDYPTPDGTGVRDYIHVVDLARGHVAALGRLQKTAGVQTWNLGTGRGVSVLDMVRAFEAASGRAIPYRIVERRAGDVAQCWADPSCAARDLGWRAEYDLPRMCEDAWRWQQGNPEGYA

SEQ ID NO: 30627 - protein, 443 aa, Oceanobacter sp. RED65
MQDQLFNSGPVYQPLASRTRPQTLDDYAGQKHLLADGKPLRKVIESGRLHSMIFWGPPGVGKTTLAMILANYVNAQFISVSAVMDGVKEIRAAVDKARMAQQQDRPSLLFVDEVHRFNKSQQDAFLPYVEDGTFIFIGATTENPSFELNSALLSRARVYKLRSLEHDDIRQLLEHAVRTDQQLNSIGLQFENGALDRLVRVADGDARTALNLLELAAGLCQAESSNVITENVVAEISQESLRRFDKGGDVFYEQISALHKAVRGSSPDGAMYWFVRMLDGGCDPKYIARRVVRMASEDIGNADPRALDLAMNAWQAYERLGSPEGELVIAQAISYLACAPKSNAVYNAYNQARRLVAESPSYEVPEHLRNAPTQLMKQEGYGAEYRYAHDEPEAYAAGENYLPEEHADETFYHPVDRGLEIKIQQKLKHLAQLDEKSEYKRYK

SEQ ID NO: 30628 - protein, 322 aa, Xylella fastidiosa
MPTIQDERNLMVFSGNANKPLTQSICKELGVRMGKSLVSRFSDGEEQVEIEESVRRQEVFVVQPTCAPSAENLMELLVIIDALKRASVSSVTAVIPYFGYSRQDRRMRSLRVPITAKVAAKMISAIGADRVLTIDLHADQIQGFFDVPVDNVYASPLLLADIWRAYGTDNLIVVSPDVGGVVRARAMAKRLGDTDLAIIDKRRPRANVATVMNIIGEVNGKTCVLVDDLVDTAGTLCAAAVALKQNGATKVVAYITHPVLSGPAVDNINNSELDELVVTDTIPLSDAARECRKIRQLSVAELLAETIRRIAFGESVSSLYVD

SEQ ID NO: 30629 - protein, 465 aa, Oryza sativa Japonica Group
MSEEDTNAAAGQPRRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVIPGSFLRARAIGLMPMIDQGEKDDKIIAVCADDPEYRHYNDINKKNENKEVAVDAFLPANTARDAIQYSIAETAYEVFMVLVNMYNQICKSGCSNKTSATLRLRREGGYVELGKPEGLRQRTLATTWRTEVEGQKRNFTCNNRIGRDGRASRTLEALGFSIDRRRRRRRRERGHRRRHRRREQRVCCWRRLLQRRRRYRRGKDDIDAAAAGKDDIDAAATGNDEFATAAACFNAAVAGKDEFDAAAAACFNIRVLDETIRRLEQLFRFTQANNPGPAVLLRIIGRINRANARRSTLFAQLHTYIRRRRRRHHQQQAPPSPPAGGNIASNGNGAAINNGNSNNAAAGAPPADA

SEQ ID NO: 30630 - protein, 500 aa, Herminiimonas arsenicoxydans
MNAPIPHAVCHLNDMPLANSFASLPPAHYTALMPTPLPAPYLVCASASAAALIGLDFSDIDSAAFIETFTGNRIPDGSRPLSAVYSGHQFGVWAGQLGDGRAILLGDVPAPTMIPSGRLELQLKGAGLTPYSRMGDGRAVLRSSIREFLCSEAMAALGIPTTRALCVTGSDQIVLREQRETAAVATRMAQSFVRFGSFEHWFYNEKHDELKTLADYVIAQFYPQFKTAENPYKALLTEVTLRTAQMIAHWQAVGFMHGVMNTDNMSILGLTLDYGPFGFMEAFNATHICNHTDQQGRYSYARQPQIGEWNCYALGQTLLPLIGDVDETQNALRIYKPAYAEKFAELMRAKLGLQTQQPDDGKLFDALFAVLQGSHADFTLFFRRLGELRIGQAASREALRDLFLDRAAFDDWALQYELRLQLENSDDDARKLAMHAVNPKYVLRNYLAQIAIEKAQNKDFSEVAKLLQVLEKPFDEQPENEKYAALPPDWANDLEVSCSS

SEQ ID NO: 30631 - protein, 600 aa, Coccidioides immitis RS
MAHRPSPTSKSTTTAGLLPISPAAAAQHAPAKPASSRASAPRLKLLVRRLPPGLTQVEFETALGPEWTVGKGKLDWFAYKPGKLSADPSKPSKPSRAYLRVTASAIVPELSDRVRETSFQDSRNTFADPALLGPPTLEYAPYPRVPGGKVRKDARMGTIDQDPEFIAFLESLTNPVPKPSTDDIVEPDKDEKITITPLIQYLKDKKAGKAKEASAPARATKPSRSGAKDVKVEKVQAKKVLSRAEKAASPVSEKQQPKIDKAAKDAAKAANKQIASQASKQKGAKPAPASKQSEVPPQQPAPAPPGPPPQRKRERGNLSAATKILRRDLGLTPPRKRGEKSSTNTAATSSATDSKQAAPTPSTGGTKQQATTTKPSKENPPAKVTPPKLLKKPPTEPAAARNATKTTNPPTGPKNAPPESAKAAAPQSTATQAFLKHANPSQGVTEDLLESGFSKFGKVINVEIDKKKGFGYVDFAEPEALRKAIQASPVQIAQSQVVVLERRSTAAVAQARGNHMRNHPPPVMPSHSPSGGGAGGGGGGGGPTPARAPPQGPRGGGRGGPRNRGGYGRGRNGPGGGDRSNNANTGPKQTATAPPAKTTS

SEQ ID NO: 30632 - protein, 642 aa, Oryza sativa Japonica Group
MESLALLHAKPGGLPPRAGLRLPLPRARSARVSLPSSPAAPVSLQSPLLLASRSGPTSRDAVVGLGLGCGLLRRRSGASGGGGGGVSCGAQPAAAAAAGAVPAAQPEGKKFLGVEVKTLKKIVPLGLMFFCILFNYAILRDTKDVLVVTAKGSSAEIIPFLKTWVNLPMAIGFMLLYTKLSNVLSREALFYTVIFPFVAFFGAFAFVLYPLRNVIHPTALADKLLAALGPSFLGPVAILRIWSFCLFYVMAELWGSVVISVLFWGFANQITTVEEAKEFYPLFGLGANIALIFSGRTVKYFSNLRKTLGPGIDGWEVSLKGMMSLVVLLGLVITSIYWGVNKFVLNDPSLPKSDRKKKKDKPKLGMKESLKVLLSSRYVRDLATLVVAYGISINLVEVTWKSKLKAQFPSPNEYSSFMGDFSTATGIATFTMMLLGRIILRKSGWGVAAMITPTVLLLTGVGFFSLILFGQPLTPMLATMGMTPLLAAVNVGALQNIFSKSAKYSLFDPCKEMAYIPLDEDMKVKGKAAIDVVCNPLGKSGGALIQQFMILTFGSLANSTPYLGGILLVIVLAWLGAASSLDKQFSSLAKEDLKRDMSAKEKVDPSLLKAPEADVLVEHTNGTIESEATATEGSPSNSSPSN

SEQ ID NO: 30633 - protein, 350 aa, Listeria monocytogenes str. 4b H7858
MTYKITSLAGDGIGPEIMTSGLQVLEAVAKKYNHTFEIESHPFGGAGIDVAQDPIPSSTLKACRDADAILLGAIGGPKWDNAPKRPEDGLLALRKALGLFANIRPIQVPSSITHLSPLKKEIVENTDFVVVRELTGGLYFGEPKYWDNEAAVDSLTYTRAEIERIIEKAFEIAATRNKKVTSVDKANVLASSKLWRKIADEVASRHPDITLEHLYVDAAAMLMIQRPTTFDVIVTENLFGDILSDEASVITGSLGMLPSASHAENGPSLYEPIHGSAPDIANQNIANPMSMISSVSMMLRQSFSLFEEADATDAATARTMQAGFLTADLGGNTSTTDFTNEVLKQIEGGE

SEQ ID NO: 30634 - protein, 402 aa, Candida glabrata CBS 138
MDSTAPLLGPNSRQTALSTYSAAKRDLIYVCASSPLHLLLIFVPLGIIWGYMELSHTWTFVFNFLAIIPLAAILAHATEELADKAGSTIGGLLNATFGNAVELIVSVIALKEGQVRIVQASMLGSLLSNLLLVLGFCFLFGGYNRIQQTFNQTAAQTMSSLLAISCASLLIPAAFKATLPHGKEDWIVDDKILHLSRGTSLILLMIYVLFLVFQLGSHHAMFEQQHEETDEVVSELSIKPHQSLSIRSSLWFLLLSTVIVSICADYLVGTIDNVVESTGLSKTFIGLIVIPIVGNAAEHVTSVMVAMKDKMDLAISVAIGSSLQIALFVTPFMVLVGWWIDVPMTLNFSTFETTTLFIAVFLSNYLILDGESNWLEGVMSLAMYVLIAMAFFYYPDVMADAA

SEQ ID NO: 30635 - protein, 137 aa, Herminiimonas arsenicoxydans
MTEKVIKTDAEWRAMLDDEEYDVTRHAATEAPFSGRYWDHHEHGIYTCVCCNTPLFASDAKFDSGCGWPSYFTALNPDNVKEKIDRAYGMIRTEVICNVCDAHLGHVFNDGPPPTGLRYCINSASLRFDATPDLNES

SEQ ID NO: 30636 - protein, 431 aa, Zea mays
MEAQWLAEYPHQGADKRPRKRARLAWDVAPTLFQPPKVWFWPRSPHRLATSRGVWLDLGAVFARFGVGWFDQGLELGELGAIPMLYCGQELINDRILNKMGEGTFGQVLECWDLENQEAVAIKIVRSLQKYREAAMIEIDVLQRLGKHDFTGSRCVQIRNWFDYRNHICIVFEKLGPSLYDFLRKNSYRSFPIDLVREFARQILESVAFMHDLRLIHTDLKPENILLVSSESIRVPDYKVSIRPPKDGSFFKNLPKSSAIKLIDFGSTTFESQDHNYVVSTRHYRAPEVILGLGWNYPCDLWSVGCILVELCSGEALFQTHENLEHLAMMEKVLGPLPKHMIVRADRRAEKYFKRGVRLDWPEGAASRESMKAVWKLPRLQNLVMQHVDHSAGDLIDLLQGLLRYDPNERLKAHEALQHPFFTRCIRRCGF

SEQ ID NO: 30637 - protein, 334 aa, Picea sitchensis
MEMEDTLKQTLQDLQKQLGKKQTFESAATSLAWILGHKYASASVGLQEMMYAAVCRVTTLLQTRYVAPGFWIIGLKVFEEAEKLVSKPSEKNHMKACISRAHEHLGETGDREDASAHQQQNTDSRFLFEGQLTVGPEPPPPRWLAAQNLLTDFAIGNPASSTTVESSENLVHENNASEGNAEGSTENFLEQVVNNLQGIINLENDLDSAIEAALQEVGSGPRVPPPASKEVVAKLPIIDVTDQVLAGMGKDTECAVCREHLVVGDKMQELPCKHLFHPNCLKPWLDEHNSCPICRYELQTDDLEYELKKEREKEAEEERKGAANAIRGGEYMYV

SEQ ID NO: 30638 - protein, 830 aa, Candida glabrata CBS 138
MGEEHKPLLDGSGAEPTVEDSTATAILRRKKKDNTLIVDDATNDDNSVIAINSNTMDKLELFRGDSVLVKGKKRKDTVLIVLIDDELEDGACRINRVVRNNLRVRLGDLVSIHPCPDIKYASRISVLPIADTIEGITGNLFDVYLKPYFVEAYRPVRKGDHFVVRGGMRAVEFKVVDVEPEEYAVVAQDTIIHWEGEPINREDEENNMNEVGYDDIGGCRKQMAQIREMVELPLRHPQLFKAIGIKPPRGVLMYGPPGTGKTLMARAVANETGAFFFLINGPEVMSKMAGESESNLRKAFEEAEKNAPAIIFIDEIDSIAPKRDKTNGEVERRVVSQLLTLMDGMKARSNVVVIAATNRPNSIDPALRRFGRFDREVDIGIPDATGRLEVLRIHTKNMKLADDVDLETLAAETHGYVGADIASLCSEAAMQQIREKMDLIDLEEDEIDAEVLDSLGVTMDNFRFALGNSNPSALRETVVESVNVTWDDVGGLDEIKEELKETVEYPVLHPDQYTKFGLAPSKGVLFYGPPGTGKTLLAKAVATEVSANFISVKGPELLSMWYGESESNIRDIFDKARAAAPTVVFLDELDSIAKARGGSLGDAGGASDRVVNQLLTEMDGMNAKKNVFVIGATNRPDQIDPAILRPGRLDQLIYVPLPDEPARLSILKAQLRKTPLEPGLDLTAIAKATQGFSGADLSYIVQRAAKYAIKDSIEAHRESLAAAEAEVKTEGGDVDMTSEDVKKEPVETVDPVPYITREHFAEAMKTAKRSVSDAELRRYEAYSQQMKASRGQFSNFNFGDSNQGTTETGNDGNSGANFGSAGDDDDDLYS

SEQ ID NO: 30639 - protein, 260 aa, Aspergillus niger
ASTQGISEDLYNRLVEMATISQAAYADLCNIPSTIIKGEKIYNAQTDINGWILRDDTSKEIITVFRGTGSDTNLQLDTNYTLTPFDTLPQCNDCEVHGGYYIGWISVQDQVESLVKQQASQYPDYALTVTGHSLGASMAALTAAQLSATYDNVRLYTFGEPRSGNQAFASYMNDAFQVSSPETTQYFRVTHSNDGIPNLPPAEQGYAHGGVEYWSVDPYSAQNTFVCTGDEVQCCEAQGGQGVNDAHTTYFGMTSGACTW

SEQ ID NO: 30640 - protein, 419 aa, Aspergillus nidulans FGSC A4
MAYHKRPTSSYQPCDSYFVESYDDFTVPRMDPKEHAKLVARERQYAMADELSRVTSEEYRDDILSHMLDMDASTLPDVESIDIQTEIQWFMRPYLLDFLIEAHTAFQLLPSTLFLTVNLLDRYCSKRVVYKRHYQLVGCAALLIAAKYGDKKDRVPTIRELKSMCCSLYDDDMFIQMEWHVLQTLGWTIGHPTVDSFLQTAVMDTPYDPEVEHLALYIAEISLFHREFVSKPSSDLARASLALARCILNRPQPRHTEWASQYDSMTLVGLSQQLHQPSQVLARKYSSSHYSRVSKILEQFLARQASIASYTPPSPPSDVVNSESKPYEGEIGLATPQKAPHPTNMPHGYITPPITPENEAFVNGNAGYVKAVPVPSACSPSPTPSPSVQYVTHNPYQQESNYVTQQQYLQPQMSFTSGY

SEQ ID NO: 30641 - protein, 55 aa, Glycine max
MRLFDPWPVFFKREWKRCWPFLTGFAVTGVLITKLTAGFTEEDAKNSKFVQQHRR

SEQ ID NO: 30642 - protein, 204 aa, Bacillus cereus
  misc_feature (53)..(53): Xaa can be any naturally occurring amino acid
EKIRKKLLEDSESKTLKKRWAHFDLTMLGIGAIIGQEYLVLTGLVASRDAGPXSIFSFMIAAIVCGFAALCYAEIASTLPVSGSVYTYSYATIGEFVAHLMGWTLLSVYIVTTAAVAGGWTGYFHNLLNGFGFEIPRSLLTIPTQGGIVNLPAVIITLLLTWLLSKGTKESKRVNNAMVLIKIGIVVLFISVGIFYVKPENWID

SEQ ID NO: 30643 - protein, 83 aa, Glycine max
SDRTPHCCTFCRSTYISFGGGRHGCLGEPFAYLQIKAIWTHLLRNFELELVSPFPEIDWNAMVVGVKGKVMVRYKRKELSVNQ

SEQ ID NO: 30644 - protein, 374 aa, Oceanobacter sp. RED65
MDFQKEFPQNNEIVYFNHAAVAPWPKRTQQAVTEFAQENTFFGATHYPNWLQTEHNLRVQLKDLIGATSTDEIALLKSTSEGLSVIAYGLDWSDGDEIIISNEEFPSNRIVWESLAQFGVSVRVANITEHDPIKAIQSQITDNTKLISISSVQYASGRTTDLSSLSKLAKQHGVLLCVDAIQSLGVKPFSLTEIDADFVVADGHKWMLGPEGLALFYCKQELLNRLKIHQYGWHMIENAGDYTTNEWSIAKTAKRFECGSPNMLGTHALNASLSLIHEVGLTTIESLTLKTTNYLRERIQENNKLELITDINQPTAITTFSIIDQDDASIQKQLMKKGLICAYRGGGIRFSPHFYQGKKEVDKAMAIVADTIEG

SEQ ID NO: 30645 - protein, 440 aa, Staphylococcus aureus subsp. aureus NCTC 8325
MKTYDLIVIGFGKAGKTLAKYAASTGQHVAVIEQSPKMYGGTCINIGCIPSKTLVHDGLEGKSFEASYNRKNDVVNALNNKNYHLLADDNNIDVLDFKAQFKSNTEVNLLDQHDDIVDSITAPHIIINTGATSVIPNIKGLDQAKHVFDSTGLLNISYQPKHLVIVGGGYIALEFASMFANLGSKVTVLERGESFMPREDQDVVAYGITDLENKGIALHTNVETTELSSDNHHTTVHTNVGNFEADAVLLAIGRKPNTDLALENTDIELGDRGEIKVNAHLQTTVPHIYAAGDVKGGLQFTYISLDDYRIIKSALYGNQSRTTDNRGSVPYTVFIDPPLSRVGLTSKEAAAQHYDYTEHQLLVSAIPRHKINNDPRGLFKVVINNENNMILGATLYGKQSEELINIIKLAIDQNIPYTVLRDNIYTHPTMAESFNDLFNF

SEQ ID NO: 30646 - protein, 417 aa, Arabidopsis thaliana
MAASAATTTSSHLLLSSSRHVASSSQPSILSPRSLFSNNGKRAPTGVRNHQYASGVRCMAVAADASETKTAARKKSGYELQTLTGWLLRQEMKGEIDAELTIVMSSISLACKQIASLVQRAGISNLTGVQGAINIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFVLTLGKGVFSFTLDPMYGEFVLTQENIEIPKAGRIYSFNEGNYQMWDDKLKKYIDDLKDPGPTGKPYSARYIGSLVGDFHRTLLYGGIYGYPRDAKSKNGKLRLLYECAPMSFIVEQAGGKGSDGHSRVLDIQPTEIHQRVPLYIGSTEEVEKLEKYLA

SEQ ID NO: 30647 - protein, 145 aa, Prunus dulcis
KKIGNAFDNRIDAKRTLREIKLLRHMDHENVIAIKDIIRPPQKENFNDVYIVYELMDTDLHQIIRSNQPLNDDHCRYFLYQLLRGLKYVHSANVLHRDLKPSNLLMNANCDLKIGDFGLARTTSETDFMTEYVVTRWYSAPEILL

SEQ ID NO: 30648 - protein, 391 aa, Aeropyrum pernix K1
MDGSWLREVRERIPIFSRKVYLDTAGAGPLTLDVKDAVEGFLELWNSEGEPWGEALDDILESRRLFAQMVGAKVEEVAAVPGVTYGLNAFLSSLKLPPDSNVVVSETNFPTGVYTFHAMARRGLIREVRIASASDGCVGLDGFERLIDDSTSIVYVDMVSWITGCREDLRTLAELAHSHGALMVSDVFHAAGVYPIDVKKLGLDAAFTGSYKWLLGLHGGGFAYVSEELLPSLEPMFSGWMAIDDSVMERMARGDPLFSRPFNVREFRRASDAKVLEWGTWPAIAFVSLKASLKMLSAYDAPGLYASHTGRLVKRLIDSLTDMGVETVTPRGMAAGIVVFRHRHPERLGRFLESRGIVASVRPGSVRVSIHFYNSREDVEALLRALEEFRG

SEQ ID NO: 30649 - protein, 457 aa, Burkholderia xenovorans LB400
MKVTIVGTGYVGLVTGACLAELGNDVLCLDVDAAKIEELNNGGVAIYEPGLSEVIARNRDAARLTFSTDIAKGVAHGDIQFIAVGTPPNEDGSADLKYVLAAARSIGQHMDSFKVVVDKSTVPVGTADKVRETISRELAARGHGAQFAVVSNPEFLKEGAAVEDFMRPDRIVLGYDPDVAGLRAKSLMEQLYAPFNRNHQRTLCMDVRSAEFTKYAANAMLATRISFINELANLADRVGADIEHVRRGIGSDPRIGYSFLYAGCGYGGSCFPKDVQALMHTANENGMELNILASVEYVNTLQKTVLFDKIKQHFNNALNGKHFAVWGLAFKPNTDDMRAATSRQLIAALIRGGASVSVYDPVALDQARRSLAADLGPDNFEHVTFAKERDMALQNADALVILTEWKEFRSPDFEQMNEALNDAVIFDGRNLYDPTAMRDSGWKYYTIGRDAAHSTSR

SEQ ID NO: 30650 - protein, 294 aa, Prunus dulcis
MDQYEKVEKIGEGTYGVVYKARDRITNETIALKKIRLEQEDEGVPSTAIREISLLKEMQHGNIVRLQDVVHSEKRLYLVFEYLDLDLKKHMDSTPEFAKDPRQIKMFLYQILRGIAYCHSHRVLHRDLKPQNLLIDRRTNSLKLADFGLARAFGIPVRTFTHEVVTLWYRAPEILLGSRHYSTPVDVWSVGCIFAEMVNQRPLFPGDSEIDELFKIFRIMGTPTEDTWPGVNSLPDFKSSFPKWLAKDLATAVPNLESAGVDLLSKMLCLDPSKRITARTALEHEYFKDIAFVP

SEQ ID NO: 30651 - protein, 365 aa, Zea mays
  misc_feature (304)..(304): Xaa can be any naturally occurring amino acid
  misc_feature (310)..(311): Xaa can be any naturally occurring amino acid
  misc_feature (314)..(314): Xaa can be any naturally occurring amino acid
  misc_feature (316)..(316): Xaa can be any naturally occurring amino acid
  misc_feature (319)..(319): Xaa can be any naturally occurring amino acid
  misc_feature (322)..(322): Xaa can be any naturally occurring amino acid
  misc_feature (324)..(324): Xaa can be any naturally occurring amino acid
  misc_feature (329)..(331): Xaa can be any naturally occurring amino acid
  misc_feature (334)..(334): Xaa can be any naturally occurring amino acid
  misc_feature (342)..(342): Xaa can be any naturally occurring amino acid
  misc_feature (348)..(349): Xaa can be any naturally occurring amino acid
  misc_feature (352)..(355): Xaa can be any naturally occurring amino acid
  misc_feature (360)..(360): Xaa can be any naturally occurring amino acid
  misc_feature (362)..(363): Xaa can be any naturally occurring amino acid
MVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPDGRKAVQALKDVYAHWVPEDRILTTNLWSAELSKLAANAFLAQRISSVNAISALCEATGANVTEVAYAVGKDTRIGPKFLNASCGFGGSCFQKDILNLVYICECNGLPEVANYWKQVIKINXYQKSRXXERXVXFNXQNXPXKKIAXXXCLXKGKPGNKXNPGIDXXKGXXXXKAKLXFXXPS

SEQ ID NO: 30652 - protein, 641 aa, Oryza sativa Japonica Group
MAHHVAPLLLLLTLAAVAAAASEEAAAADTEAAAAVEAGLLVRREAQLARLEELTESLAKSVQALESALARSVEPDPPPPAAAAAAPGDRRAPQGVAVTKRRPYWSERFHFAAAARLGDGAYAAAATALPYEDADGLTKYFAVGDSRGRVFVFSAAGDALLELEPGVSGEPPVTALLAYLSPRRTDCFLFAGHADGSIAAHRLIESSPHGDDWLTLAAASSRLLVRGLDAAPVLHLEAHHAGRARYVLSCDSGGRIRVFTENGTLYGTAIASSTPLAFVKQRLLFLTEAGAASLDLRSMSVRETPCEGLAEALNGSLPKAYSFDPSERFKAYGFTDAGDLVHVLLLGDIASLKCRVRAIKKAEIDNPVAIQTIKGYLLVASQDKILVYNTSTQYYGRVGAPRLLFATSIKDIKSVFAGSGGVMPASPAGKPLVAADREKLVILGLGDGYIAIYRSNFPVYKPESNAVVWSGPALLFLLFLIGIWQVYVKKKDSLGWTPEETFNTSVTAPTGSILNHSTSDRAFADSSTRTGERGYVDGTTRASDRSYVDATTRATDRAYAEATRGVDLRGGALRGAPRRYVSPTRYTGAAGIPYRPVSTEPVLRTTPELKYRGPGMEPPGFPKKRDTLFSSNQTVVDDHVD

SEQ ID NO: 30653 - protein, 342 aa, Coccidioides immitis RS
MMASAFEAEVALHAVIPEHVPKPIAWGTYKSQPHVHFYLCDFVEMSDRLPNPRKWAEAVARLHTRSAGKSPEGKFGFHVSTHLGHVPVDNSWRDSWESFWSQQMKSLLDYEESIKGQSDEFSELKVAFFRKVIPRLLRPLEAGGRKIKPCLIHSNLWPGNIKHKAEGRDLCIFDSCAYWGHNEADLAVCRNPRYRLGKDYIDSYAQYMPEFPSHPADEFDDRNALYAIAMDEMRRLVKRFPTGYASYEEKAKDEVEIVESPTLLSVEPHVRGEEPRGHFVKHDLLEEERQHAAPPSGSSAESRAQEQKFRGKMNIPSAVLLALGVMGILIAYLLGVRVSLPE

SEQ ID NO: 30654 - protein, 265 aa, Picea sitchensis
MPKRTTHTYSSEDAAPDGPESDLYVYYCKHCGSHVLITDTQLQKMPRRKTDKAYVLDKKQHLARLNIVETGKFLLKRGEGKLEKQFRMACVGCGLFVCYRSEEDLEAAPYIYVADGALSSVAAETNPQDAPVPPCISQLEGGLVQVAIEVEDRAQRSAITRVNADDVRVTVAAPAARGEANNELLEYMGKVLGLRLTQMTLQRGWNNKSKLLVVSLNVTGGRFICPGCLRKAFTCSAAIRCYLFFILTLHTSGFLLCFAYGILFV

SEQ ID NO: 30655 - protein, 311 aa, Candida glabrata CBS 138
MVKQEFFKLNNGHEMPGVAIVGTGTKWHKVNETDENFSQTLVDQLKYALSLPGVVHLDAAEFYMTYREVGRALAETSKPRDEIFITDKYWTLSKVTENPIVGLETGLKRLGLEYVDLYLLHSPFISKETNGFSLEEAWGMMEELYHSGKAKNIGVSNFAKEDLERVLKVCKVKPQVNQIEFNAFLQNQTPGIYNFCKQNDIQLAAYSPLGPLQKKPADGNSQPFYSYINKLAQHYNKTPGQVLLRWVTKRGVVAVTTSEKKERIKQAQEIFEFDLKDDEVTEITKLGLDHEPLRLYWHDQYNKYNSESQKA

SEQ ID NO: 30656 - protein, 88 aa, Brassica napus
LETHITAGSLFIVPRFFVVSKIADPEGMSWFSIVTTPDPIFTHLAGRTSVWKALSPEVLQAAFKVDPEVEQLFRSKRTSDAIFFPPSN

SEQ ID NO: 30657 - protein, 357 aa, Mycobacterium tuberculosis H37Rv
MSLSLGIVGLPNVGKSTLFNALTRNNVVAANYPFATIEPNEGVVSLPDPRLDKLAELFGSQRVVPAPVTFVDIAGLVKGASEGAGLGNKFLAHIRECDAICQVVRVFVDDDVTHVTGRVDPQSDIEVVETELILADLQTLERATGRLEKEARTNKARKPVYDAALRAQQVLDAGKTLFAAGVDAAALRELNLLTTKPFLYVFNADEAVLTDPARVGELRALVAPADAVFLDAAIESELTELDDESAAELLESIGQSERGLDALARAGFHTLKLQTFLTAGPKEARAWTIHQGDTAPKAAGVIHSDFEKGFIKAEIVSYDDLVAAGSMAAAKAAGKVRIEGKDYVMADGDVVEFRFNV

SEQ ID NO: 30658 - protein, 157 aa, Glycine max
MEFVKRVLGSSKRLYPENSGGSGSYGRRLSTSKKKKKKAPQGCICVYVGAERERFVIKVKIANHPLFKALLDAAEREYGYRNNGPLWLPCDVDLFSEALKDMENSIQEEEETGSVGCAAFAAGHSFRRSPSSASNNYISCRYLLTGSVIHHYQTLVS

SEQ ID NO: 30659 - protein, 467 aa, Yersinia pestis CO92
MKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWNSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERAKSSEMPS

SEQ ID NO: 30660 - protein, 209 aa, Herminiimonas arsenicoxydans
MTTSMTRTSALDTDMLGMVPMVIEQSGRGERAYDIYSRLLKERVIFLVGPVNDHAANLIVAQLLFLESENPDKDISLYINSPGGSVSAGMAIFDTMQFIKPNVSTLCTGLAASMGAFLLAAGEKGKRFSLPNSRIMIHQPLGGAQGQASDIEIQAREILYLRERLNQILADRTGKTLEEISRDTDRDNFMSADAAVEYGMIDKVLTTRA

SEQ ID NO: 30661 - protein, 181 aa, Kluyveromyces lactis NRRL Y-1140
MGVSFSKLFSNLFGHKEMRILMVGLDGAGKTTVLYKLKLGEVVTTIPTIGFNVETVEYKNISFTVWDVGGQDKIRPLWRHYFRNTEGIIFVVDSNDRARIAEAREVLQRMLNEDEIRNAVLLVFANKQDLPEAMPAAEITEKLGLHSIRQRPWYIQATCATSGEGLYEGLEWLSTTLKNQS

SEQ ID NO: 30662 - protein, 359 aa, Aspergillus nidulans FGSC A4
MNPIHALLRRAEDGSLPTCETGNEYDGRMGVRISSIFVILVGSAFGALFPVFARSFQNSKVPSWAFFIAKYFGSGVIIATAFIHLLGPAEEALRNECLSGPITDYSWAEGIILMTIVVLFFVEMMVIRFSRFGEGHSHDNDSHSDHSHAHGHAGELKGTELSSNDVNHHMPGEDHLGHSREHRDLELAEKGVDLNEYMAQLTSVFILEFGIIFHSIFIGLTLAVSGPEFTTLYIVLVFHQTFEGLGLGSRLATIPWPRSKRWTPYFLGMGYAISTPIAIAIGLGVRQSYPPEGYTTLLVNGVFDSISAGILIYTALVELMAHEFMFSTSMRRAPLKNVLAAFGLLCLGALLMALLGKWA

SEQ ID NO: 30663 - protein, 274 aa, Brassica napus
MKRPSIVRVIFLIVISITTASGSPDHGEVEDETEFNYEKGGEKGPEKWGTLKPEWKMCGNGTMQSPIDLTDKRVFIDHNLGPLRSHYLPSNATIKNRGHDIMLEFEGGNAGMGIIINGTVYQLQQLHWHSPSEHTINGKRFVLEQHMLHQSKDGRLAVVAFLYSLGRPDSFLLSLERQLKRITDAHGSEDFVSLIDPRAVNFKTRLYYRYLGSLTTPPCSENVTWSISREMRTVTLEQLDLLRVSVHDQSNTNARPLQRQNGRPVKFYLPAWHI

SEQ ID NO: 30664 - protein, 257 aa, Picea sitchensis
MDKSKRSKGEEEEHIDGELVLSIEKLQEIQDELERVNEEASDKVLEVEQKYNEIRRPVYTKRNEIIQTIPDFWLTAFLSHPALSDLLTEEDQKVFKYLQSLDVEDFKDVKSGYSITFTFRPNPYFDETKLVKVFSFCDDGSTKITGTTLKWKDGMDVTNGISPEKEGNKRSYQEESFFTWFSETQKDTPDGIHDEVAEIIKEDLWPNPLKYFNSEADEEYEDGEDEDDDGEDEDPGKSTDGVDEDEEDQDDDEDEDC

SEQ ID NO: 30665 - protein, 81 aa, Triticum aestivum
MHLTRGAAEAVGWLTIGLFAAFAALGLHCIFQSVYFWFRIRKGTLLSLGYFNGPWVTRIALILITIWWGVGEIVRLSFLKR

SEQ ID NO: 30666 - protein, 479 aa, Burkholderia xenovorans LB400
MPNHTYDGRHNGMRTIDNTMGDRSSAGVSGPVTRGSIIARLERLPRNAMQVRARILIGLATFFDGFDVIAIAATLPILIAKWHLTPWEIGFLIGSGSVGQLIGAFVFPWYAERGGRVKAIALSSGIIGITSIACGFAPTFAAFVVLRVIQGLGLGGELPVAATYINEISRAHGRGRFVLLYEIVFPVGLLASNALGAWIVPRFGWQAMYFIGGMPLILFFVLRKLVPESPRWLAERERMADADTAVHAFERAVKGPLPPVTHSAEFEAMANRHPKRRMSDLFGPAYLKRTLAVAMLWITCGFIQYGLSTWLPTIYRTIYHAPLQLALNLAVAASVLGVVGSLTCALLVDKVGRKPIINLSFVACALSLLLAGVFHDSSVYVVATFCAFSLGFLACGFITAYVYTPELYPTSIRAMGCGVGGAWLKVAAIFAPAIVSKTMIGGNLQVAFYILAAVPFLAAVTVHFLGIETKGKVLEQLEA

SEQ ID NO: 30667 - protein, 220 aa, Glycine max
MVAEMNVREFSISKNDRTSNSNSKFLTLPTILTLGRVAAVPLLVATFYMDGWRGTVVTTSIFTAAAVTDWLDGYIARKMKMKSTFGAFLDPVADKLMVSATLVLLCTRPLEVAVFRQVPWLLIIPSITIIGREITMSALREWAASQGSKLLEVVAVNNLGKWKTASQMVALIILLATRDCSRGGPAILVGSGVVLLYISAGLALWSFVVYMREICKVLRR

SEQ ID NO: 30668 - protein, 428 aa, Marchantia polymorpha
MPRFALHETVRRNLASRFGRCLYVGATNKEKVVPLFDGDRGNPKRAHEWMRVYCKWAVQEGLSQDQTLLIAVDHMFVNAYGWATQFLNGVSWEEFMTGFYREYVTNNGAVIQAVRGWYRMLKKAKAVPFIRFSGRELATATDDFAPRHIVGEGGFGVVYMAHLPGNQVVAVKKLKGASKEAMQQAHNEVEILSQFRHPNLVKLLGCCLEQRDPLLVYEYIPNGNLMQHLCGEMKKTLTWENRMSIAIGTAEAITHLHSCGSSPVYHRDVKSNNILLDHDLNAKIADFGLSKFVQTLNFVATHITTTPQGTHGYVDPCYLQTFHLTEKSDVYSFGIVLLELVAGMRVLDMSRPEGEWSIVYVAIDRVTKGRFESFLDPKLKESEPDCIEQALDITTLALKCLTLSLEDRPVMKQVLQELHCIQDNWVLV

SEQ ID NO: 30669 - protein, 341 aa, Brassica napus
MQARHGQSSYRDRTDEFFGVVESRRRSIAPAAANNVPYGGGGGRREDPRSAAANQSEFSKRASLIGLAIHQTSQKLSKLAQLAKRSSVFDDPTREIQELTVVIKQEISGLNGALLDLQAVRNSHNDESNISRDTTTHSATVVDDLKNRLMDTTKEFKDGRPTRPENMKIQEDRMKKFSKISSKESANPFVRQRPLASKPSPSQPAPLPWANGSSSSSSQIVPSRQGEAESSPLLQQSQQQQQHMVPLQDTYMQSRAEALHNVESTIHELGNIFTQLATMVSQQGEIAIRIDQNMEDTLANVEGAQSQLARYLNSISSNRWLMIKIFFVLIAFLMVFLFFVA

SEQ ID NO: 30670 - protein, 141 aa, Bacillus cereus
MRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFD

SEQ ID NO: 30671 - protein, 151 aa, Neurospora crassa
MSTAARRRLMRDFKRMQTDPPAGVSASPVPDNVMTWNAVIIGPADTPFEDGTFRLVMHFEEQYPNKPPSVKFISEMFHPNVYATGELCLDILQNRWSPTYDVAAVLTSIQSLLNDPNTGSRANVAPSNLYKDNRKEYHKRVRETVEKSWED

SEQ ID NO: 30672 - protein, 394 aa, Listeria monocytogenes str. 4b H7858
MKNLVKVKVFPKFTKGYKEGYPLILKERMEKWPKELQEGDVLELTDTNGQFIARGYHGEQNKGSGWLFTWDKKQQLDEDFLTNLITTAIEKRQFLFADDSTTAFRIFNGEGDGLGGFTVDFYDGYLVIQWYSLGIYAFQKMIIDIFLSFPEIKGIYEKRRFQEDTKDDFVAGQKATFPLIIKENGINYATYLDDGWMTGIFLDQRDVRRRISEDYSVSKNVLNTFSYTGAFSVAALFGGASKTTSVDVAGRSLSKTKEQLEVNGLDPNEQAIIVEDVFHYFKYAARKQLTFDLVVVDPPSFARTKKVTFRAAKDYPAMLREIIDITAPNGTIIASTNYAGFGMKAFKKLIAEAFQTSDRTYKIVETHSLPADFTVNKNFPEGNYLKVLFLTLDI

SEQ ID NO: 30673 - protein, 366 aa, Acidobacteria bacterium Ellin345
MRVRNVLIAAAAGSVAAGAVAGVGAVLLGRAIWKGFREISLRGKIALVTGSSRGLGLAMAQELAREGARLVICARDEAELRWAQEELQAIGAEVLAVPCDVGDREQVRKMFEQIRARYGALDVLINNAGVIQVGPLHSQTIEDFEEAMRVMFWGLVYPTLEAIRDMRAMGSGHIANITSIGGRIAVPHLVPYSAAKFAAIGFSEGIHAELAKDGITVTTVVPGLMRTGSHVNARYKGDHRKEYAWFSLGASTPVTAMSAHRAARCVITAVKRGRSSVTLSPQAKLAALAHGIAPGLVSDALGMVNRIMPGSRSTSTEGFTGKESRSVVSESFATKLGRDAAEELHQNPEQRRTDNATSGPEALLAD

SEQ ID NO: 30674 - protein, 1300 aa, Arabidopsis thaliana
MIQTGEEDEEKATSLEVEFASGNGVDDEEELRLQWATVERLPTFKRVTTALLARDEVSGKGRVIDVTRLEGAERRLLIEMLVKQIEDDNLRLLRKIRKRIDKVGIELPTVEVRFNNLSVEAECQVIHGKPIPTLWNTIKGLLSEFICSKKETKIGILKGVSGIVRPGRVQKRCWFSCRMTLLLGPPGCGKTTLLQALSGKFSDSVKVGGEVCYNGCSLSEFIPEKTSSYISQNDLHIPELSVRETLDFSACCQGIGSRMEIMKEISRMEKLQEIIPDPAVDAYMKATSVEGLKNNLQTDYILKILGLDICADTRVGDATRPGISGGEKRRLTTGELVVGPATTLFMDEISNGLDSSTTFQIVSCLQQLAHIAEATILISLLQPAPETFELFDDVILMGEGKIIYHAPRADICRFFEEFGFKCPERKGVADFLQEIMSKKDQEQYWCHRDKPYSYISVDSFINKFKESNLGLLLKEELSKPFNKSQTRKDGLCYKKYSLGKWEMLKACSRREFLLMKRNSFIYLFKSALLVFNALVTMTVFLQVGATTDSLHGNYLMGSLFTALFRLLADGLPELTLTISRLGVFCKQKDLYFYPAWAYAIPSIILKIPLSVLDSFIWTLLTYYVIGYSPEVKRFFLQFLILSTFNLSCVSMFRAIAAIFRTIIASTITGAISILVLSLFGGFVIPKSSMPAWLGWGFWLSPLSYAEIGLTANEFFSPRWSKVISSKTTAGEQMLDIRGLNFGRHSYWTAFGALVGFVLFFNALYVLALTYQNRKIILPFKPLTVTFQNVQYYIETPQGKTRQLLSDITGALKPGVLTSLMGVSGAGKTTLLDVLSGRKTRGIIKGEIKVGGYPKVQETFARVSGYCEQFDIHSPNITVEESLKYSAWLRLPYNIDSKTKNELVKEVLETVELDDIKDSVVGLPGISGLSIEQRKRLTIAVELVANPSIIFMDEPTTGLDARAAAIVMRAVKNVAETGRTVVCTIHQPSIDIFETFDELILMKNGGQLVYYGPPGQNSSKVIEYFESFSGLPKIQKNCNPATWILDITSKSAEEKLGIDFSQSYKDSTLYKNNQQDLISIFGSMYTLVVFPGMNNCAAVINFIAAERNVFYRERFARMYSSWAYSFSQVLIEVPYSLLQSLLCTIIVYPTIGYHMSVYKMFWSLYSIFCSLLIFNYSGMLMVALTPNIHMAVTLRSSFFSMLNLFAGFVIPKQKIPKWWIWMYYLSPTSWVLEGLLSSQYGDVDKEILVFGEKKRVSAFLEDYFGYKHESLAVVAFVLIAYPIIVATLFAFFMSKLSFQKK

SEQ ID NO: 30675 - protein, 210 aa, Picea sitchensis
MPSVSELTKEEEETLAAKLEQQKIESDEPIVEDDKDDDEDEDDDDEEDDNDDDDGQGEQGGEGKSKQSRSEKKCRKAMLKLGMKPISGVSRVTIKKSKNILFVISKPDVFKSPTSDTYIAFGEAKIEDLSSQLQTQAAEQFKAPDLSHVTMKPESSSAAQEDEEEVDDTGVEPKDIELVMTQAGVSRAKAVTALKAADGDIVSAIMDLTT

SEQ ID NO: 30676 - protein, 314 aa, Yersinia pestis CO92
MELKDIGNTELIELKNLSINNNSLFSKCEFNNPTGSHKDRTFLHILNILEEENKIIPGMTLIDCSTGNGGAALAWIGQKKGYKIKIFMPEGMTEERKEQIYSFGGEIIETPKENFLKGAVKAATEYSNHQKNIFFLNQSDTTLNKDAWHSCGEEIVRKMKEINKKPDYFICSIGTGGTFSGIAEILKKAYPRIHTVGIEVDQSAPIYSQRHGLNFHHKHHNLMGLGAGVISVNTLLDLIDEVRVVNGKAAWERMKSFIEKERLGIGPTCGANLLITEDIMQEVNGKVIVTLFFDSAWKYKSCWDGVYPGYKETQ

SEQ ID NO: 30677 - protein, 869 aa, Oryza sativa
RVADSCGLLCGRRSRPFRAMASRRQWGAGAGAVDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYTVSQTEINERMRAILTDWLIEVHYRLMLMAETLYLTVYIIDQYLSLENVPRKELQLVGVSAMLIACKYEETWAPLVKDFLVISDNSFSRQQVLSTEKSILNKLQWNLTVPTMYMFILRYLKAALGDEEQEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVCVLQFLVCCCCYGHIQFVFFSSWFVVVMACTMSSMACHSLPESGSNLSAADELFQNQRSEQGIYWTLWDSRLSDDLNTTTVYSDNHGSNGGGTQSFDTSEHCSTVPSDSDEQPGYPSQFEPLHMEQTNDMFLSQFSDEEVRRMDAPFQALDMFPDSMHRLMSYEHILNGALVSDSKNQEVNMDQDDMDTCGFPLYFSHGLQDDGGLPSFAKGMVAADTSSMDKTNRYIWVFANAGASATERGDPGSSPPGFEEAVLEELEEVMVQMARTTRICLRDAFYRLAEGSRSPRSAAAAADGATVAEATRYHAQAAVDLSRSLLEILQLVILMLSVSSSPLAAANPLQCVDDAAAPSPRRDRQDGGEPHLQAAAVLAGSRGGDDAAHACLRRPSSPSPDHRRTGGDSLGFSFQCDLARRIASSLACLTKDTLCM

SEQ ID NO: 30678 - protein, 147 aa, Bacillus subtilis
MAYNKEEKIKSLNRMQYEVTQNNGTEPPFQNEYWDHKEEGLYVDIVSGKPLFTSKDKFDSQCGWPSFTKPIEEEVEEKLDTSHGMIRTEVRSRTADSHLGHVFNDGPGPNGLRYCINSAALRFVPKHKLKEEGYESYLHLFNKLEHH

SEQ ID NO: 30679 - protein, 511 aa, Zea mays
MMMQLGARSLVRRFSRLAAAGAPAETTSAGVPRMPAFDHVPLPYDGPSAADIARKRAEYLSPSLFHFYSKPVRRSVDGSNARRIHIDRCVCERVPRSLRAELNIVEGKRQYLYDEHGRRYLDAFAGIATVCCGHCHPDVVDAITRQAKRLQHSTVLYLNHVIADFAEALASKLPGDLKARCWLIASCTDSVVFFTNSGTEANELAILMARLYTGSHDIISLRNSYHGNAAGTMGATAQKNWKFNVIQSGVHHAVNPDPYRGAFGSDAEKYVRDVQEIIEFGTTGQVAGFISEAIQGVGGIVEVSPGYLPLAYDKVRKAGGLCIADEVQAGFARVGSHFWGFETHGVVPDIVTMAKGIGNGIPLGAVVTTPEVAQVLTRRCYFNTFGGNPLCTAGGLAVLEVLEKERLQENAFVVGSYLKDRLRGLQEKHEIIGDVRGTGFMLGIELVTDRQLKTPAKDEICHAMEHMKDMGVLVGKGGFYGNVFRITPPLCFTKEDADFFVEVMDIALSKL

SEQ ID NO: 30680 - protein, 475 aa, Triticum aestivum
  misc_feature (377)..(377): Xaa can be any naturally occurring amino acid
  misc_feature (382)..(382): Xaa can be any naturally occurring amino acid
  misc_feature (385)..(385): Xaa can be any naturally occurring amino acid
  misc_feature (397)..(397): Xaa can be any naturally occurring amino acid
MLPQMRPLPSSPAIHAVHRRTSPAPPSIRGLGQHGRVALVRTTAPVVCRSVASPAANQGAPAVERPWKLSDARLVLEDGSVWNAKSFGASGTQVGEVVFNTSLTGYQEILTDPSYAGQFVLMTNPHIGNTGVNSGDEESIKCFLGGLIVRSLSICTSNWRCTETLDEYLRKRNIMGIYDVDTRAITRRLREDGSLIGVLSTDQSLKDKELLEMAKNWKIVGVDLISDVTCDAPYEWVDKTGSGWEFNDNQSSETFHVVVYDFGVKHNILRRLASYGCKITVVPASWPASDVLNLKPDGVLFSNGPGDPAAVPYAVKTVQEIVGKVPVFGICMGHQLIGQALGGKTFKMKFGHHGGNHPFRDNRTGRVDISAQNHNYXCGPRXLPXGVQVTHINLNDXSCAGLCSQDKLSQYIRSLGSMTTVGELWTDKTTIVVKKLELGHVTPLVVCHSLIFRSTRQSTGMTIVVTLFKKKPGPI

SEQ ID NO: 30681 - protein, 490 aa, Mycobacterium tuberculosis H37Rv
MTRITRANGCPDGTLENAVVALDGGANYPREILGNKGHGIDMMRRHHLPVPPAFCITTEVGVRYLAAPGSTIAAIWDDVLDRMSWLETETSCTFGRGPNPLLVSVRSGATQSMPGMMDTILDVGMTDAVERVLARPGAADFAHDTRRRFTSMYRRIVGSAGPITDDPYAQLRASIEAVFASWNSPRAVAYRDHHGLDDQGGTAVVVQAMVFGNLTANSGAGVLSSRNPITGANEPFGEWLPGGQGDDVVSGLVAVAPITALRDQQPAVYDQLMAAARSLERMAGDVQEIEFTVEDSQLWLLQTRGAERSAQAAVRLALQLHHEGLIDDTETLRRVTPTHIETLLRPSLQTETRLAAPLLAKGLPACPGVVSGTAYTEVDEALDAADRGEPVILVRDHTRPEDVMGMLAAQGIVTEVGGAASHAAVVSRELGRVAVVGCGPGVAAALAGKEITVDGYEGEVRQGVLALSAWSESDTPELRELADIAQRISS

SEQ ID NO: 30682 - protein, 258 aa, Coprinopsis cinerea okayama7#130
MQAAGQPPRILNAQQIEKMRTVCRLGREILDLAATYVRPGVTTDEIDEVVHNACIERNAYPSPLNYRGFPKSVCTSVNEVICHGIPDKRPLREGDIVNIDVSLYFDGYHGDLNATYPVGKIDDESAKLIRVTRECLDAAIALVKPGALFRDLGKAIEPIAKANGCSVVRTFTGHGINELFHTAPNIPHYAKNKAVGTMKPGMTFSIEPMINLGNNWADVHWPDNWTATTVDGKRSAQFEETVLVTETGVEVLTAAKSA

SEQ ID NO: 30683 - protein, 400 aa, Oryza sativa Indica Group
MLSDQELARYVESFVRQAAAVPGAVAAAGGISAESVARQLGPQLGLDLTPKAPLIRDILLALFSPPPQGAPFTSSAPSPSASASASASASAAAAGHFFSQQQQQQQLQTFLTASQQYQHRGGAGAAAAPPSAYGVAAAAAGYRYGQPFPQDEGAHLQRLVQMHHHQQQQQQQQMAAAAAGVAAAPPTAVESPRPAAASKKESASTGVKRRGGPGGLNKVCGVSPELQAIVGEPTMARTEIVKQLWAYIRRNNLQDPNNKRKIICNDELRLVFETDSTDMFKMNKLLAKHIRPLEAKMLKILAEDSNRDSKKLKPVDSEPISPAETDVNQLPIILSDALASFFGTGEKEMPSSEAVKRVWDHIKSNNLEDPANPTMILCDSKLKQLFGCESLTAMNRLTGL

SEQ ID NO: 30684 - protein, 407 aa, Idiomarina loihiensis L2TR
MLKLSNFGPGALVAAAFIGPGTVVTASLAGANFGYALLWALLFSVVACVILQEMSARIGLVTQAGLGENIRNNLTSGWLRWLALLLIFSAIAIGNSVYQGGNLSGASLGASELLGPVPVLDVWLSNAWALIIGIIALLILWSGNARVIERALIVMVLLMSVAFIGTFLLTDPDWGAVFNGTFGFSMPTGATLTVVALIGTTVVPYNIFLHASSVSKKWKTAEELPAARRDLFLSIPFGGLISMAIVATAASAFFGQQVEIESAGDLAESLRPLFGDGATYLMAIGLFAAGISSATTAPLASAYALCGIMGWSVNLRSRAFRIIWFTILVIGIIISSVGIKPVTVIWFAQVANGILLPIIVGFLWWLCQSPLLGKYRNSLLQNILAAIIFLISVVLSGRSLGSAFGFW

SEQ ID NO: 30685 - protein, 477 aa, Triticum aestivum
  misc_feature (403)..(403): Xaa can be any naturally occurring amino acid
  misc_feature (406)..(406): Xaa can be any naturally occurring amino acid
  misc_feature (442)..(443): Xaa can be any naturally occurring amino acid
  misc_feature (452)..(452): Xaa can be any naturally occurring amino acid
  misc_feature (457)..(457): Xaa can be any naturally occurring amino acid
MAASLLRRAAAGRGRCPSPAESLRRLVSSEAAPEQALPRPLPEMPPFEHRPSPYAGMGGAEILEKRKKFLGPSLFYYYQKPLNIVEGKMQYLYDEQGKRYLDCFGGIVTVSCGHCHPDIVKAVQEQTKLLQHTTTIYLHHAIVEFAEALASKMPGNLKVVYFVNSGTEANELAMLMARLYSGNLGMVALRNGYHGGSAGTIGLTGLQTWKYPIPQGEIHHVMNPDPYRGAFGSDAAAYAREVEEHINFGSSGKVGGFIAETFQGVGGTVELAPGYLKSVYDTVRKAGGVCIADEVQSGFGRTGSNYWGFQTQDVIPDIVTMAKGIGNGLPLGAVVTTPEIASVMAQKIQFNTFGGNPVCSAGGLAVLKVLDKEKRQAHCADVGAHLVERLKSLQQKHEIIGDXEGXGLMLGVELVTDRTEKTPAKAETAVLFEKLKDLGVLXXKSGLHGNVXKIKPXMCFSKDDANSWWTHGLSDRF

SEQ ID NO: 30686 - protein, 247 aa, Roseovarius nubinhibens ISM
MSDKPIALITGGAQGIGYASAQALAEDGYYIVLADIKESVHDAAKTLGGTGHICDMGDVEAIHAMFDKIEAEIGPVAALVNNAGIANPGDFLSYSLEDFDKVLGINLRGVFVATQRAGRTMVDKGIEGAIVNMSSINAQLAIPAIPAYCASKGGVMQLTKVAAIALAKHNIRVNAIGPGSIDTEMMAGVNANPEAYKVAMSRTPLGRPGTAREIGDVVAFLCSKKSAYITGESIYVDGGRLGLNYTV

SEQ ID NO: 30687 - protein, 242 aa, Vitis vinifera
MADMGREEEEEEEVRTPSSPPQSQSSHMLVLSILSKRRTWVCLFILVYAALLFFSWNLLKTILSWYNNSMSSSSPPSSFGWPALYASVLLGVVFGLLSMVAALAVAVPATLVTWITVLVLLTFCGKPRRTLVVEGRMITAEITGFVLKILLKEGNVVAAICAVLGYFALVRRRGEVDLDKFGGIYLFGPTISWDTTRTLCLHERMFMISQIGYRRKFLMLYKYKFFLTLKTCFKAMRVSLGL

SEQ ID NO: 30688 - protein, 411 aa, Pinus sylvestris
MASATLSMAAVANCSSTHASLQVSGKGFSEYSGLKSSSGFPCLRKYNEELRFQLVAFQTNAVGSSGQKRGVVEAKIKVAINGFGRIGRNFLRCWHGRKDSPLDVVVINDTGGVKQASHLLKYDSILGTFDPDVQVAGNDGISVDGKVIKVVSDRNPVNLPWKDYEIDLVIEGPGVFVDREGAGKHLQAGAKKVLITAPGKGDIPTYVCGVNEDKYYPAEEIISNASCTTNCLAPFVKVLDQKFGIIKGTMTTTHSYTGDQRLLDASHRDLRRARAAALNIVPTSTGAAKAVALVLPSLKGKLNGIALRVPTPNVSVVDLVVQVEKKTFAEEVNAAFRETADKELKGILAVCDEPLVSIDFRCSDVSSTVDSSLTMVMGDDMVKVVAWYDNEWGYSQRVVDLADIVANNWKS

SEQ ID NO: 30689 - protein, 276 aa, Triticum aestivum
  misc_feature (158)..(158): Xaa can be any naturally occurring amino acid
  misc_feature (224)..(224): Xaa can be any naturally occurring amino acid
  misc_feature (234)..(234): Xaa can be any naturally occurring amino acid
MHPTRWELSHMVDLQAAALVISVVAAEVPPNPISSPPLPSARPNPIRSPPSSSVAMGRKFFVGGNWKCVESIVNTLNAGQIASTDVVEVVVSPPYVFLPTVKGKLRPEIQVAAQNCWVKKGGAFTGEVSAEMLVNLGVPWVILGHSERRSLMGESSEXVGEKVAYALAQGLKVIACVGETLEQREVGSTMAVVAEQTKAIADKIKDWTNVVVAYEPVWAIGTGXVASPAQAQEXHGHLRDWLRTNVSPDVAESTRIIYGGSVTCASCKELAGQPDL

SEQ ID NO: 30690 - protein, 209 aa, Zea mays
VGIAFSYLNSFKCCRHIAAECSSKGVCWNCKEPGHMANSCPNEGICRNCGKSGHIARDCTAPPVPPGEVILCSNCYKPGHFREECTNEKACNNCRQSGHLARNCTNDPVCNLCNVAGHLARQCPKSDTLGERGGPPPFRGVGVPFHDVGAPFRGGFSDVVCRACNQIGHTSRDCMAGAFMICHNCGGRGHMAYECPSVSIMDRFPPRRF

SEQ ID NO: 30691 - protein, 114 aa, Glycine max
  misc_feature (33)..(33): Xaa can be any naturally occurring amino acid
MAAPIPREWVGLQQFPAATQTKLHELLGKLKEXNVSTLTILVMGKGGVGKSSTVNSIVGERVANVSAFQSEGLRPMMCSRTRAGFTLNIIDTPGLIEGGYINEQAVEIIKRFLL

SEQ ID NO: 30692 - protein, 191 aa, Triticum aestivum
GRRVPIISDELMLDGNPRLNLASFVTTWMEPECDKLIMDSVNKNYVDMDEYPVTTELQNRCVNMIAHLFNAPIKEEETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNDLLTK

SEQ ID NO: 30693 - protein, 284 aa, Picea sitchensis
MAKEGGKEMQEQQQGFVAKDYKDPPPAPLVDINEFKLWSFYRALIAEFIATLLFLYITIATVIGHSRNKADCGSVGVLGIAWSFGGMIFVLVYCTAGISGGHINPAVTFGLFLARKVSLPRAVMYMIAQCLGAICGAGLVKAFQKPYYDRYGGGANVVAHGYTKGVGLAAEIIGTFVLVYTVFSATDPKRSARDSHVPVLAPLPIGFAVFMVHLATIPITGTGINPARSFGAAVIYGHKHSWDDQWIFWVGPMVGAAAAAAYHQHILRATAIKALGSFRSNPQV

SEQ ID NO: 30694 - protein, 267 aa, Aeropyrum pernix K1
MIDAEQLRRVSVKVSSETAGLLRDLACSEDLGRVVSGETTVADKRAEDYILDLLRRELGQVQVISEEAGGVASKTSDAPIALVDPLDGSTNYLSCITWCSVSVAFADPRSGEILAGSVAPVYAGMPVSFARGKGCYHGGLKVEDPSIRGSIISVYVDEPGAIESVAGAIGRLKGVRRDFKVRSLGSAALELAYTAIGYIAVFADLRARLRNIDVAAAVGAVRECGGVVTDAHGQPLRIGVWRVERVGSVVASLDEALARIAVGGGSG

SEQ ID NO: 30695 - protein, 831 aa, Marchantia polymorpha
MRISVQRSRYCGTGILIPVFLASTLLSTYGFDIRWYSLKEDVTGPQNLVLTYSHPTGPLSLPVGAGEGNVLREHPSLIGHGAKTAKRLALKHGALKRKLAAAASPYQGPALPRLPLRRAQLRVKPLEVTPKPVPVVSPVNSPRSPPPPDALVPSPPTSIPTPPPQADCKCKDGYTSTPTGSPCGCVIPIQVGLELSVDLEVFFPLVLELSKELAEGSFLPQSQVRITGANAVSNNQERTDVHADLVPLGVAFDNTTAQLIAQRFWGRQVEINETLFGNYTILYVNYPGLSSPPAQASGPDSEGSAGGGSPSGTVPSGKAETGAGTENRFSRGIIVIISLTSAAGTAVLLGGIWLVAVKCCRSETSAVGEDSFLPGAKKSAGSTLVSTMDSFTTLSYSSNFATYIASARNFTASEIQRATDNLKEENVVGEGGFGRVYQGRLDDGLKVAVKVLTRDDDSELLAEAELLSRLHHRNLVKLLGICIEGGVRALVYELISNGSVESHLHGPDGMIAPLNWDARIKIALGAARGLAYLHEDSNPRVIHRDFKASNILLEEDFTPKISDFGLAKVASEGGGGEHISTRVMGTFGYVAPEYAMTGHLLVKSDVYSYGVVLLELLSGRKPVDMSQPPGEENLVRWARPLLTSREGLQLLLDPVLGETVPFENVQKVAAIASMCVQPEVSHRPFMGEVVQALKLVYNDSDASDGRISFNGSHTGDGQSCGHGTGEPLGPQSSYRPSSMPAAPFSSGPTLSSESEPPQRPISASAVLSNSSRFIRQLSGSFRRYGSSGPLRTTRSRPAWYKVRYPRGGTMSDHHNSKFEIELERDYFELWP

SEQ ID NO: 30696 - protein, 53 aa, Pisum sativum
VDRREAALLKFRQKRKERCFDKKIRYVNRKQLAERRPRVRGQFVSKLNGINVD

SEQ ID NO: 30697 - protein, 192 aa, Oryza sativa Japonica Group
MAPAGCCLLLVLLIAAGGRAAANSAAAVATTNNKPQQLVQSTCNSTTYYDVCVAALAADPSISTAADVRGLCAIAVSAAATNASAAGASLLASAAAYQSQPQAPLLRACAARYADARQALISAQEAIKEEAYDYAFVHVSAAAQYPTMCRALFRRASSQQRAYPSDLAKREEGLRRLCTVVLDIISLLLLSY

SEQ ID NO: 30698 - protein, 392 aa, Arabidopsis thaliana
MEPPKEQQNTPEKSISDAPATISSAFPPSGCCTNCGGPTISEAPPPLASFPEMSPPPNYRPIRAPAINLPHNSQAIILSPVPHAEQVPVVSPPYHFQSPVKRIHSPDDIRRFHESASCKNFLGFVVSLSESIRGFKISDPCHISPTVAAIVSILETLLQWIDEIPPAQQSARYGNVSFRSWHERLRERGESLILEFLPEEFKESVIEIVPYFFDSFGNSSRIDYGTGHETNFAAWLYCLARMGIVKEEDYHSLVARVFVKYLELMRKLQMVYCLEPAGSHGVWGLDDYHFLPFIFGSSQLIDHKYMKPKSIHNDDILENFSSEYMYLSCIAFVKKVKKGLFAEHSPLLDDISGVPNWKKVNSGLLKMYRVEVLEKVPIMQHFLFGWLIKWEE

SEQ ID NO: 30699 - protein, 341 aa, Synechococcus sp. WH 5701
MGIRQGPCTQAGISQGFVEAVGNTPLIRLRLLSDLTGCEILGKAEFMNPGGSVKDRAALGILLEAEESGALQPGGTVVEGTAGNTGIGLTHLCNARGYRSLIVIPDTQSAEKIGLLRSLGAEVRTVPAVPYRDPNNYVKLSGRIAAEIPGAIWANQFDNLANRRAHYASTGPEIWEQTGGRIDAWVSATGTGGTYAGVALFLKERSERVRCVLADPHGSALHAWATGAGLKAEGSSITEGIGNSRVTANLEGAPIDDAVRIDDQSALETIYQLLWREGLFMGGSVGINVAAAVETARRLGPGHTIVTVLCDSGDRYRSRLYDADWLASRGLSQPRRERVPA

SEQ ID NO: 30700 - protein, 488 aa, Microcos latistipulata
  misc_feature (7)..(7): Xaa can be any naturally occurring amino acid
SGVSTLXKRNLGRISQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGDIDEATAKATNLEMESKLK

SEQ ID NO: 30701 - protein, 470 aa, Sinorhizobium meliloti 1021
MPADLAARTSSKIFNGVDLMDASARADNAFYLDRQERRESNARSYPRRFPVALKSASGCIVTDVDGRSYLDCLAGAGTLALGHNHPEVIETLQQVLGSGLPLHTLDLTTPVKDRFVSDIFGTLPAGLRDEAKIQFCSPSGTDAVEAAIKLAKTATGRTDLVSFRGAYHGMSQGSLSLMGSLGPKASVGQLVPGAHFFPYPYAYRCPFGRGGNETATLAAEYFERALRDPEGGINRPAAVILEAVQGEGGVIPAPVEWLRAVRRVTRDLGIPLIVDEVQSGVGRTGSFYAFQKAGIIPDVVVLSKAIGGGLPLAVVIYREDLDLWKPGAHAGTFRGNQLAMAAGSKTLEIIERERLVERAAIAGRRLRANLERIAAQTPYIGEVRGEGLMLGVEVVDPEGLPDALGHPPHGQEIARMIQHEMFRAGIILETGGRFGSVLRLLPPLVISDAEIDQVSGALAAAFERLGRKAA

SEQ ID NO: 30702 - protein, 256 aa, Oryza sativa Japonica Group
MADLHPPEPDTNGGSAAAAAAAAAAAAPLGDPAAEASGAQAAAGPPYSKRRRRPSVRLGDIGVHSAAAADVPLPQRRHHKTSSSSHPRPPRRAHPEDALDPLNHSSAAAHRRGQKPAQRRPRTAWIPAAPGTDGYEEEAEHYYDDADQSDSAAAAAARARVSGSRDASGDESDGVADWGLPNGRLPGSMGYGGVKAWLDGLGLSRYAPVFEIHEVDDEVLPLLTLEDLKDMGIGAVGSRRKLYAAIQKLQRSDSVS

SEQ ID NO: 30703 - protein, 87 aa, Picea sitchensis
MDPFSSPSPASSSTPSNEQIMDQLKNQIAQAYAEEFLETVRTKCFARCVTKPGTSLSGSEGSCVSRCVERYIEATQIISRAIFNAPR

SEQ ID NO: 30704 - protein, 188 aa, Oryza sativa Japonica Group
MASGALARLLLGRRAAATPLLARPFAAKARASRRPQEPAFPSEDEDDFAGGEVAAPAPTEGISKPLAEVLRELGKRVPEALVKTRVEDGFSLKYIPWHIVNKILNIHAPEWSGEVRSIVYSSDGKSVSVIYRVTLHGTDAEIYREATGTSSADDTGYGDPVQKAEAMAFRRACTRLGLGLHLYHEDMS

SEQ ID NO: 30705 - protein, 475 aa, Herminiimonas arsenicoxydans
MSKNFDVVVIGGGPGGYVAAIRAAQLGFSVACIDEWKNAKGGAAPGGTCTNVGCIPSKALLQSSEHYEHAGHAFAEHGIEVKDLTLNVKKMVARKDTVVKQNNDGILYLLKKNKVTFFHGRGSFAKAGAGGYEIKVAGAGEETIATKHVIVATGSTPRVLPGADFDEKMILSNTGALAMTEVPKRLGLIGAGVIGLEMGSVWRRLGSEVTVLEALPVFLGAVDEQVAKEAQKQFVKQGLAINLGVKIGAIAVGKNEVTVNYVDDKGAAQKAVFDKLIVSIGRIPNTVGLNTEAVGLKLDERGFIAVDGDCKTSLPNVWAVGDVVRGPMLAHKAEEEGVAVAERIAGQHGHVNFNTIPSVIYTSPEIASVGKTEQQLKAENIAYKAGTFPFLANGRARALGDTTGFVKFLADAKTDEILGVHIIGPQASELISEAVVAMEFRASSEDIARICHAHPTLSEALKEAALAVDGRSLNF

SEQ ID NO: 30706 - protein, 489 aa, Trifolium pratense
MDYVGSGMLLLLTCIVACFIGSLYARSRKSNYRLPPGPSIFTIMSHVFELYYKPQQTLAKFAKFYGPVMLIKLCTETTVIISSSDMAKEILHTNDSLFTDRSVPDNTTTHNHNNFSLVFLPFSPLWQHLRKICHNNLFSNKTLDGSQELRRMKLKDLLNDMHKSSLKGETVDIGRAAFKACINFLSYTFVSQDFVESLDDEYKDIVSTLLSAVGTPNIADHFPILKILDPQGIKRHTTKYVAKVFHALDIIIDQRMKLRKSEDYVSKNDMLDSLLDISKEDSQKMDKKQIKHLLLDLLVAGTETSAYGLERAMTRLVHDPKAMSKARKELEETIGLGNPIEESDIDRLPYLNAVIKESLRLHPPAPMLLPRKARVDVEISGYTIPKGAQVLINEWAIGRTDIWDDADSFSPERFLGSEIDVKGRHFKLTPFGSGRRICPGSPLAVRMLHLMLGSLINSFDWKLENNMEAKDMNLDKPLRAIPVALNKVY

SEQ ID NO: 30707 - protein, 414 aa, Herminiimonas arsenicoxydans
MAILEITVPQLSESVAEATLLQWHKKVGETVARDENMIDIETDKVVLELPAPAAGVITQIIRDDNSTVVAGEVIALLDTDLSAAVAPAASAPAAATAAPTAAPAMAASANAASNIAMPAAAKMLAENQLAASDVAGTGKDGRVTKGDVINQLEKKQAAPVATAAKPALQQVTAPMSATMLANRPEERVPMSRLRARIAERLLQSQSSNAILTTFNEVNMQPVMDLRAKYKDKFEKEHGVKLGFMSFFVKAVVAALKKYPIINASVDGNDIVYHGYFDIGIAVGSPRGLVVPILRDADQMTIAEIEKKIAEFGNKAKEGKLTLDDLNGGTFSISNGGVFGSMLSTPIINPPQSAILGIHATKERAVVENGQIVIRPMNYFAMSYDHRIIDGREAVLGLVAMKEAMEDPARLLLDL

SEQ ID NO: 30708 - protein, 348 aa, Clostridium perfringens SM101
MKILKWLLIFIPISIIGEFMHFSPTLMFILSALAIVPLAGLMGEATEEISFYTGPKLGGFLNATFGNATELIISFFALKDGLFDVVKASIAGSVIGNILLVLGASMLAGGLKYKTQSFNKKVMETSSSMLLFAVIGLTIPAIFMHTIKPEFLNTKYESLSVIVAIVMFAIYILSLIFSFFTHKDIYAVEQDEEDGEAKWSLKKAITVLIVATVIIAIESEFLVGAVEPMTEALGLSKLFVGIIIIPIIGNAAEHSTAIIMAMKNKMDVSVEIAIGSSLQVILFVAPVLIFLSLIFKPMSIIFNAFELVALIVSVLIANRIVNDGESNWLEGVQLLAVYIIIAAMFMIV

SEQ ID NO: 30709 - protein, 594 aa, Roseovarius nubinhibens ISM
MRFWLYSSLFVILAGAASGQQASDSVAPEIGGTGQVATSEAVAEAQARKAEGRPVEAQDWMVVAAHPLAVEAGAEVLAAGGTAADAMVAVQAVLGLVEPQSSGLGGGAFLVWWDAKSGAMTTLDGRETAPLEATPRLFQDDQGQPLQFYDAVVGGRSVGVPGTPALLQEAHERWGARPWAGLFDRAITLAEEGFAVSPRLSASVAGDAERLGRFDATARYFLPEGAPLQPGAQLRNPDYAETLRALATEGARVFYGGEIAEDIAATVQSAPGNPGVLSEVDLALYRVKERAAVCAPYRAYEICGMGPPSSGAVAVGQTLGLLAPFDLAGSGPESPEAWRLLGDASRLAFADRGKFLADTDFVPVPVKGLLEKMYLENRSQLLNGGVALPEAAPGAPEFDHALNWAMDNSIELPSTSHISIVDSQGNALSMTTTVENAFGSRLMVRGFLLNNELTDFSFRSHRDGVPIANRVEPGKRPRSSMAPTIVMAEGRPVLVLGSPGGSRIIPYVSKTLVAVLDWGLDAQAAVDLPHLVNRFGTYDLEAGTAAEAQAEALQAMGYATEARDLTSGLHVIDLRGGRLQGGADPRREGVALGQ

SEQ ID NO: 30710 - protein, 357 aa, Glycine max
MGTEGYTYMGRSLTELRINDDSSSSAFSDCNSDRSGEFATASSQTRRFLIACATENSDDLIRQLVSDLHSSSIDYQKQAAMEIRLLAKNKPENRIKIAKAGAIKPLISLILSPDLQLQEYGVTAILNLSLCDENKEVIASSGAIKPLVRALGAGTPTAKENAACALLRLSQVEESKAAIGRSGAIPLLVSLLESGGFRAKKDASTALYSLCMVKENKIRAVKAGIMKVLVELMADFESNMVDKSAYVVSVLVAVAEARAALVEEGGVPVLVEIVEVGTQRQKEIVVVILLQVCEDSVAYRTMVAREGAIPPLVALSQSGTNRAKQKVLFSSTPFPLLFSARDVAPFPSNRFDPFFYL

SEQ ID NO: 30711 - protein, 467 aa, Klebsiella pneumoniae subsp. pneumoniae MGH 78578
MVDQVKVAAVEQEPTEQSLRRNLTNRHIQLIAIGGAIGTGLFMGSGKTISLAGPSIIFVYMIIGFMLFFVMRAMGELLLSNLEYKSFSDFAADLLGPWAGYFTGWTYWFCWVVTGMADVVAITAYAQFWFPGLSDWVASLAVILLLLGLNLATVKMFGEMEFWFAMIKIVAIVALIVVGLVMVVMHFKSPTGVEASFAHLWNDGGWFPKGLSGFFAGFQIAVFAFVGIELVGTTAAETKDPEKSLPRAINSIPLRIIMFYVFALIVIMSVTPWSSVVPSKSPFVELFVLVGLPAAASLINFVVLTSAASSANSGVFSTSRMLFGLAQDGQAPKMFAKLSKRAVPAKGLTFSCMCLLGGVVMLMVNPSVIAAFTMITTVSAILFMFVWTIILCSYLAYRKNRPQLHEKSSYKMPLGKVMCWVCMAFFVFVLVLLTLEDDTREALMVTPLWFVLLGAGWLFAGKKRLAK

SEQ ID NO: 30712 - protein, 553 aa, Coprinopsis cinerea okayama7#130
MSVDEKKVHNEKVEEQSQVSSEVEEFDPNLHDPREASLHRGLKARQISMIALGGAVGTGLIIGSGTALRRGGPLGLLLGYAYVGFVCYLVMVSLGEMAAYLPHKKGFAGYATRFVDPALGFALGWNYLLKYLIVTPNNINAAGVVVQYWPNGREVHIAIWMVIFIAAIFVVNFLGVRVFGELEFWLSSAKILALIGMLLFGIIIDLGGNPQKDRIGFRYWKAPNGPMGKYLLDQVKNTSLSIFLGFWATLTNALFAYMGTELIGVTVGEAQNPRRNIPIAIRRTFFRILVFYVGGVFVIGLIVPSTDESLFIATQSKTGAAASPFVVAAGLVGISALRHVINGAILIFVMSAANSDLYIGSRTLYGLAIEGKAPAVFKIVNKMGVPWPSLLFCTAWCGLVFLNVASTVFGWFVNLVSTFGALTWLCILYSHMQFMKALKAQGISRDTLPYKAPFQPWGNWFAFVSTLVITFFKGFDTFIPFNTANFITSYIAIPVFFMMWFGYKYLMKTKVVRPADIDLVTGLRAIDEEEQRYLAEQAAKGPRTRWQRIWDAL

SEQ ID NO: 30713 - protein, 623 aa, Azoarcus sp. EbN1
MKRMDLAMYLARLGAALFVATAVLAPLALAAEGGSASATSIGVPQIDPAQATGSSAGNAASSRGVVSVSHPLAAAAGAQILEAGGNAIDAAAAIQFALNVVEPQFSGIGGGGFMMVHLAAENRTFIVDSREKAPAGASADMFLGQTFLAASTSGHSIGVPGTLKGIDYALRQWGSMTLAATLAPAIRLAEEGFRINRFLAADTYNVRTTLQPETRAIFRLPDGSPLPEGHLLVQPALAQTFRLIARDGVDPFYRGDIARAILDVQLRSQIGPAGAGRMTASDLAAYDVAVRQPVEGDYRGYTIKSMPPPSSGGLALLMMLELLEPFPLGSGDGWRFGGRDALHAMIEAMRLTFADRSVWMGDPDFVPVPVKGLLSECFLATRRAFINSGSRMATPLPGDPRACDSPNRRPHDELPRVPAEEEKSMHTTHFSVVDAAGNFVSYTSTTEHTWGTGILVPGYGFLLNNQLTDFNFTPQLSASTGNPGANDAGPFKRPLSSMAPTILFKDGKPLIAYGASGGPTIINTVLNITLNLVDHRMDIQQAIDAPRLSVTSAAGAVRCEAGLPPDSLRQLVELGHDLPDVAGVPVCNESIGSVQAVVIEMQNGRRYGGADQRSEGTVIALPR

SEQ ID NO: 30714 - protein, 620 aa, Photobacterium profundum SS9
MTLDISKYPHLALANTPDELRLLPVESLPEVCDELRTYLLNSVSQSSGHFASGLGAVELTVALHHVYNTPFDHLIWDVGHQAYPHKILTGRRDQMSTIRQKDGIHPFPWRGESEYDVLSVGHSSTSISAGLGMAIAANKEGLGRKVVSVIGDGAITAGMAFEAMNHAGDVHSDMLVILNDNEMSISENVGALNNHLARLLSGSLYTTIREGGKKVLAGAPPIKELVKRAEEHIKGMVVPGTMFEELGFNYIGPVDGHDVTELVKTLKNMRNLKGPQFLHIMTKKGKGYAPAEADPINYHAVPKFDLSQNPLPKAANAKPTFSKIFGDWLCDMAAEDEKLMAITPAMREGSGMVRFSKEYPSQYFDVAIAEQHAVTLASGMAIGGYNPIVAIYSTFLQRGYDQLIHDVAIMELPVMFAIDRGGLVGADGQTHQGAFDLSFMRCIPNIVIMAPSDENECRQMLYTGHKHQGPSAVRYPRGNGLGAEIQKEMTALEIGKGIIRRQGEKIAILNFGTMLEYALEAAEKLNATVADMRFVKPLDEELILELAANHDVLVTVEENAIAGGAGSGVIEFMMKSKCLKPVLNIGLPDRFVEQGTQQELHTALEIDAAGIEKKIRDYIA

SEQ ID NO: 30715 - protein, 363 aa, Oceanicola granulosus HTCC2516
MSGKRLKLGILNGDDIGHEIVPASVEVARAAAGKAGLGIDWTDVPIGAAALESHGHTMPEGTMETLEGLDGWILGPIGHRDYPKVPGAINPHPILRKGFDLFANVRPTRSYPGIGCLFDDIDLVIVRENNEGFQPDRNVVAGSGEFRPTEDVTISVRVITVEGCRKVVRAALDIARSRPRKKLTLVHKNTVFKLGCGMFVDTAYEVAKEYPDVEVDECIVDTFAMRLLRDPWAYDTVVTTNMFGDILTDEAAGMVGGLGMAPGLCIGRGAKAMAQATHGSAPDIAGKGIANPYAMIESTRMLIEHLGRAHDLPEAVRAAAYMREGLDAALADPASRTGDIKGTGGTADMVAGIVAGIERAKAA

SEQ ID NO: 30716 - protein, 300 aa, Photobacterium profundum SS9
MNNNLTLSQSLKHYQDRSNQHLAQWLEAQPFADQALVKTMKYGTLLGGKRARPFLTYITGQMLGAECADLDTPAAAVECIHAYSLIHDDLPAMDDDELRRGHPTCHIAFDEALAILAGDALQTLAFEILADGKLNDDGNTQRIAMIKELAQASGAAGMCVGQALDLEAEGKHVDLQQLETIHKHKTGALIRCAVRLGALAAGQKGVAVLPQLNQFADAIGLAFQVQDDILDVTSDTETLGKPQGSDLALDKSTYPALLGLEGAQQKTQQLYQEALQALDAIPYNTTQLEVFARYIIERNN

SEQ ID NO: 30717 - protein, 186 aa, Arcobacter butzleri
MSEKNVLDENSKNILLDSIRTINDYPKPGIIFKDITTLLNNKNAFNLLMDHLEERYKSYNLDYIAGVEARGFFFASALASRLKIGFVPVRKKGKLPSTTICEKYELEYGFSEVELHLDAFNNEKNVNVLFVIDDIIVSGGTAYAAANLIKKLNVNLVESCFLMNIAILDGAKKLSEISPVYCVLEI

SEQ ID NO: 30718 - protein, 614 aa, Microcystis aeruginosa PCC 7806
MVELFKGFEQLVELAKTLEEKLEKGEIKTEVQFNSRPLSNIPRAGGIPRSGGVSRPNNAGGDDFEVNRNRDTPNDSGVEDSVTPPEGPTTASLKDVGGLTEVIKELKELIAIPLKRPDLLAKLGLEPTRGVLLVGPPGTGKTLTARALAEELGVNYIALVGPEVISKYYGEAEQKLRGIFEKASKNAPCIVFIDEIDSMAPDRSKVEGEVEKRLVAQLLGLMDGFAQSQGVIVLAATNRPDHLDPALRRPGRFDREVLFRVPDRKGRLEILQILTRSMPLDESVSLDLIADNAVGFVGSDLKAVCQKAAYSALRRQVPTIDSQIPETMTVVQADFLQALKEVKPAVLRSVEVESPHVAWDNIGGLEQIKQTLQESVEGALLHPQLYTQTKAQAPKGILLWGPPGTGKTLLAKAVASQARANFISINGPELLSKWVGASEQAVRELFAKARQAAPCVVFIDEIDTLAPARGRYSGDSGVSDRVVGQILTELDGLQTAATILVIGATNRPDALDPALLRAGRLDLQLKVDLPNASSRLAILGVHNDERPLEDVDLGYWAEATEGWNGADLALLCNQAALMAIRRYRHQGMTDPADIRITTADFNHAYQLLVEQRAN

SEQ ID NO: 30719 - protein, 182 aa, Synechococcus sp. WH 7803
MTGTPESTSLTALQKGLLLVSAIALAVSLFLVRNGGMTESPLDQLARRSLAPEVALSNGKPTILEFYADWCEVCREMAPAMLAMENAHAGELDVVLVNIDNPRWLDLTDRYDVTGIPQLNLFAADGDLRGRSLGGRTEGELNTLAAALVTNAPLPKLTGVGGSSPLPEPASMASAAGPRSHS

SEQ ID NO: 30720 - protein, 612 aa, Azoarcus sp. EbN1
MSDSGRASWSCDASRRPDCTGRAGAVRIRAGSFRRNGMARSLSCATSNESPPMITLKNVTLRRGVKVLLDTASVTLNPGEKVGLVGRNGAGKSSLFGLLTGVLHEDAGDYSIPSQWRMAQVAQDMPETAQSATDFVIDGDTVLLAARAEVHAAEASDDGMRMAHAYMALHDAGAHDAEARAQALILGLGFRSAELTNPVNSFSGGWRMRLQLARALMCPSDLLLLDEPTNHLDLDALVWLEAWLKRYAGTLVVISHDREFLDAVTQVTLHIDNARLVRYGGNYSAFEDMRAEQLALQQSALARQQDRIAHLQKFIDRFKAKASKAKQAQSRVKALERMERIAPVLADAEFNFEFQEPANLPNPMLSMHDASFGYPPPPGAAAGTAPAVIVRHINRSVHAGQRIGILGANGQGKSTLVKTVARTLDVLGGEITEGKGLNIGYFAQQELDVLRPQDTPLEHMVRLAKETLASGRSGWIAAREQDLRNFLGTFNFSGDMVKQAVGTMSGGEKARLVLCMIVWQRPNLLLLDEPTNHLDLATREALSVALNEFEGTVMLVSHDRALLRAVCDEFWLVARGGVEPFDGDLDDYQRYLLDEARRSRDTSVGARQKRAA

SEQ ID NO: 30721 - protein, 974 aa, Marchantia polymorpha
MELRGSASYSIGLTLALLCLICAVPTTAQPGQLNIDCGHLKNYSDYYFNWVTDTGYISTGYTSGQVWASGQWTDFRFFNDTRKKHCYTLPTLPDTTYLVRASFLYGNFSELYGNVSFDLTINSTYWTTINIAPVVDWYAENLGVEVILRRDVIVRSSGTSLFLCLVRKMGLPFITSIQLRKLADNMYEETKQDQILAVEARWAASSYDEVRFPDDPYDRIWQAVDTNTGVSSDQPVDVYGRHDQNLKIENTTEIPTSSGINRPPSKVMQNAYMWNETTDFAWFYLTNLSDLSGQYYTALYFQEIDELANATSTSGSRTISVSLDGVDSVAKDITVTSEVSMLTAVFETTDTSFNFTFTKDADSNLPPMVNALELYSVYAVDPLAFTAPEDVVALRYLQQSLSGIGNWNGDPCFPQPWDWLTCNSGRPARVVKVRLSNMWLKGTITPNITGLTALTDLWLDRNFIGGYLPDPVGMLSLRTIHVQNNSLIGSIPFGFSILPELQELLVQNNNLSGPIPPGLLAPRNGVNFSFVYDGNEFLSKCLPENGPCLPNSSPSGIGPPGADSDRKKAGMSAALIVGAVAGGVGVVLALFFFYCCCLKKTPHADLDKGLGAVGMLKADKDGSQQLQARAFNLAEITTITHNFVRKLGQGSFGPVFYGKLPDGTEVAVKVNAADSSQGTEEFVNEVVLLSRVHHKYLVSLVGYCEAPQQHILVYAFMPNGTLTEHLHGDKAKTEPLTWMERLEIALNSAQGLEYLHAFCNPPIIHRDIKPSNILLDNNLMAKVADFGMSKSAPEDSRTGFSTAVKGTLGYLDPEYLSGWRLTTKSDVYSFGIILLELITGRKPTSVIHFADGTQGNFMGWAKSAQRSGDIHSIVDPDLEGKFNTEAMWKVAEMAWASVEAQGTSRPDMGEIVRGLKEAIALENSDISSKVPGQHDLSYSSSRASYSSSAPLKSQPSYSSISTWDADMAQHHQPR

SEQ ID NO: 30722 - protein, 471 aa, Chlamydomonas reinhardtii
MSAGMAYGALPKFPNFKVHKLLGKGSYGKVYKVERESDKQLYALKEADLGSMSQAERADAVNEVRLLVSITHHNVIRYNEAFLLGNKLCTVMEYAPFGDLRYYISKGAKLRTPFPEEAVWRIFLQLCKGLQALHSQNIIHRDIKPANIFLCANDLLKIGDLGIAKALTSMNFARTQIGTPCYMAPEVWSGRPYSYSSDMWSLGAVLYEMMTFRTPMEGRTMADLRNRIKGGRYTPIPAGRYSAELTNICHSLLATDPAKRPSPTSILGSSAAAKWMHILPAAGPPVARRWTSDGAPPKSGGASLMDTIVVPRDLKQLHKRLPPPSYDSDIVRPSVPPPSSSGAGGPPGVQRSSSWSQGAGIQVPAAASSGGAQGIAPKLPSLPGSKAPSRENSRAPSPDVRALQDNRKGPSGSGAPLPPLFPRVPSGGLNPAAAAAAAAVAAYGQRWTPNAPPLAFAVPRVQVPSRRVSYS

SEQ ID NO: 30723 - protein, 579 aa, Zea mays
MGGGGAIVHGFRRWFHRRSEGSTSNSNQSSLAGEGEADDGSSDLEVIEDPDLLGLRAIRVPKRKMPLPVESHRKNSVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHHQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSCMRKKYPVPFTHKFRHADPLALRLLERLLAFDPKDRPSAEEALADPYFASLANVEREPSRHPISKLEFEFERKKLAKDDVRELIYREILEYHPQMLEEYMKGGEQISFLYPSGVDRFKLQFAHLEEHYSKGERGSPLQRKHASLPRERVVVSKDGNTEQQINDQERSADSVARTTVSPPRSEDADMDDVKPTSLSSRSYLKSASISASKCVVVRNKHPEPEDDGIPEEMEGTVDGLSEKVSRMHS

SEQ ID NO: 30724 - protein, 195 aa, Pyrobaculum aerophilum
  misc_feature (1)..(1): Xaa can be any naturally occurring amino acid
  misc_feature (13)..(13): Xaa can be any naturally occurring amino acid
  misc_feature (51)..(51): Xaa can be any naturally occurring amino acid
  misc_feature (112)..(112): Xaa can be any naturally occurring amino acid
  misc_feature (120)..(120): Xaa can be any naturally occurring amino acid
XHAINIAFFDLIXPVEKTLLILKPDAVARGLVDEIISRFKKAGLKIVALKXVKASPEEIERFYPSSEEWLQSAGQKLLKAYQELGIDPRAKIGTDDPVEVGRIIKRNLVKYXTSGPNVVXVLKGNRAVEIVRKLVGPTSPHSAPPGTIRGDYSIDSPDLAAEEGRVVFNLVHASDSPSEAEREIRFWFREEEVLE

SEQ ID NO: 30725 - protein, 488 aa, Muntingia calabura
  misc_feature (1)..(1): Xaa can be any naturally occurring amino acid
  misc_feature (11)..(11): Xaa can be any naturally occurring amino acid
XGVSTLEKEIXGRISQIIGPVLDVAFTSGKMPNIYNALVVKGRDTIGQQINVTCEVQQLLGNNRVRAVAMSATDGLMRGMEVIDTGAPLSVPVGGATLGRIFNVLGEPVDNLGSVDTRTTAPIHKPAPAFIQLDTKLSIFETGIKVVDLLAPYRRGGKIGLFGGAGVGKTVLIMELINNIAKAHGGVSVFGGVGERTREGNDLYMEMKESGVINEKNLAESKVALVYGQMNEPPGARMRVGLTALTMAEYFRDVNEQDVLLFIDNIFRFVQAGSEVSALLGRMPSAVGYQPTLSTEMGTLQERITSTKKGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKATNLEMESNLK

SEQ ID NO: 30726 - protein, 313 aa, Zea mays
MTSGAAAAAGGLGRTPTWKERENNKRRERRRRAIAAKIFTGLRALGNYKLPKHCDNNEVLKALCREAGWVVEDDGTTYRKGCRPPPGMLSPCSSSQLLSAPSSSFPSPVPSYHASPASSSFPSPTRLDHSSGGSSTHNPAAAAAAAASLLPFLRGLPNLPPLRVSSSAPVTPPLSSPTAAAAASRPPTKVRRPDWDAAADPFRHPFFAVSAPASPTRARRREHPDTIPECDESDVCSAADSARWISFQATTAPASPTYNLVHPASDSMELDGTTAAVEEFEFDKGRVVTPWEGERIHEVAAEELELTLGVGAK

SEQ ID NO: 30727 - protein, 911 aa, Chlamydomonas reinhardtii
MALQWGSFANAGIKELVAGADPTLNIKEGTLGDRYELQREIGSGSYGQAVLATRLEDGMQVVCKQIRLFEMDDKARADTLTEAKVLAQFNHVNIVHYYECVLESGVLNIVMEYANGGDLAAAIQRRQAEKKPYSEDEIMFWFVQIVLALYHVHGRNVLHRDLKSQNIFIAEGNLLKLGDFGIARVLNSDTELARTVIGSPYYLSPEICEDRPYNRKSDVWSLGCVLYELATLRRAFDGQSLPALVVKILRGKYPPVPTRYSTPLRGLIESMLKQNPKDRPSADAILKSDFVRQHVERYAAHVMALGVGAGGEALGEGEDGAAAAAAALGLAELVAANVRPKPSPPSRATRPGAARPPRAPSTAGALTPASSGAPVSPAPGGSGGDMERGSSREVSEAETGVSTPADGSSPNKPPAAPAGGRRAAGQKLVESGWVRQQQDKLAELAGALAAQKAGGVGAEAAAGAMDATLPSAAVGGGGVSQNTAAKAKLAELKLQRDAELEAQRKANAAGEQKAAAAARRNHEEAVAVRGRAAARQKDIERNLAEQKAEMAAKARKAAALAVAIKQREEARKRELDEAAQHMSAHKEQVKAARARINKEQLSELGAQFAARLASGGGASGAGETSSGQVLVVDFTADQPSSSTPVSKASPAHLRHRSPAHGAPVAGRQSPTPAAKAPRARAAAAAGSDSEGAGPSGRGAQKPAADPPWKLRHKPKGEFPEVQIFTPFGSGAVGSAADTAAAESDAGAGNTEEDDEAGQQAAGVLEVLAQIHTVLEGDDDEGGGGHASARPSSAATADEDEGGTGRPGGAAQAAANALKVEQLRIDLEGQLGGAAFLAAYRCLRDMQAAEEADGEGAPGSSTGGGSGGGAAAGGVGVGGGGTQRELERILGPKLHLVRQVHKLITLEDAVFA

SEQ ID NO: 30728 - protein, 437 aa, Trifolium pratense
MNIKLATALTICYVIYISNINAIDPCASQPDDSDLNVIPMYGKCSPFNPPKADSWDNRVINMASKDPARMSYLSTLVAQKTATSAPIASGQTFNIGNYVVRVKIGTPGQLLFMVLDTSTDEAFVPSSGCIGCSATTFYPNVSTSFVPLDCSVPQCGQVRGLSCPATGSGACSFNQSYAGSTFSATLVQDSLRLATDVIPSYSFGSINAISGSSVPAQGLLGLGRGPLSLLSQSGAIYSGVFSYCLPSFKSYYFSGSLKLGPVGQPKSIRTTPLLHNPHRPSLYYVNLTAISVGRVYVPLPSELLAFNPSTGAGTIIDSGTVITRFVEPIYNAVRDEFRKQVTGPFSSLGAFDTCFVKNYETLAPAITLHFTDLDLKLPLENSLIHSSSGSLACLAMAAAPSNVNSVLNVIANFQQQNLRVLFDTVNNKVGIARELCN

SEQ ID NO: 30729 - protein, 525 aa, Chlamydomonas reinhardtii
MARSTYDDFIIKEKIGSGSYGVVFKVVRKVDKHVYAMKEIDLQGMSRKEQEECIRETRVLSSLDSDFIIRYYDSFLEKGKLYIITEYAANGNLHDYIKKQKSRLTEDLIWKLYIQILLGLNHMHSKKILHRDIKTLNVFLDEDLNVKLGDMGVAKILSTNTVFAKTIVGTPYYLSPELCEDKPYNEKSDVWALGVVLYECCTQRHPFDADNQGALILKILRGKFPPVSGYSPDICDLIKRCLTQNANRRPNTYKLLLLPSIRQKGEELGISLPDQASLALMADKNMANAGAAGKAARPKTPQGDMNAPPEVAGTSAGDDKAFVFGSTIRADGAGARPVDVSVSAVEATSGEGAAPGAAPVPVQAAWAVDDAKPKVNRPPAWGLAQQMEELAVDDGEDEDEGKNPYLGVGGDDDEDDDGEGDDDDDYDDNGEYGDEPGEGEPGWSADPTRIAHMKSAMMIQRAACLDLVGEKAFNELYALLKSNQVDEASMTDLSRLVFKIIPYDKSEVIQMMYKLLYLESQLEGQ

SEQ ID NO: 30730 - protein, 426 aa, Pichia pastoris
MSGDHKSFTVFNQEFIIDRDFELIKALGQGAYGVVCSAQYKGNEDGGKVAIKKVTNIFSKKILAKRALREIKLLRHFRGHKYITCLYDLDVIPDQNNNFNEIYLYEELMECDLHHIIKSKQPLTDSHYQSFIYQILGGLKYIHSADVLHRDLKPVNLLVNSDCELKICDFGLARGYSSDAEKNAGFLTEYVATRWYRAPEIILSFQTYTKAIDIWSVGCILAELLGGRPIFRGRDYVDQLNLILSTLGTVSEETLQSIRSERAQDYVRSLPFMPKIPFSQLFPGANPEAIDLLDRMLTVDPTHRITVTEALEHPYLKVWHDPNDEPVCSSKFDFSFEVVDDIETMKQMIVDEVLSLREFVRRPIQEQQLPFTEPDKHFDVSFDQPQIEPPAENYRDDHLPRPHELESQILDLEHELQYGLDRYGTQ

SEQ ID NO: 30731 - protein, 500 aa, Oryza sativa
MDVNQLWLLWATLAVSLLYYISNRRRRVGGRRRCPPGPMPLPLVGNLLNLRGHLPPALARLARTYGPVMMLKMGLTTTVVISSGDAAREAFTKHDRHLAARTVLDVTRSLDFADRSMIWLPSSDTVWKTLRGVTAASIFSPRGLAALRGVRESKVRDLVGYFRGRAGEVVDVRHAVYGCMLSLVSSAFFSVDVVDLSAESENEFRQSMTFLMEVVSKTNVSDFFPFLRPLDLQGWRRLTERYLGRVTCFLDDVIDRRFAADASANRHGDFLDSLLDLVSTGKIVGENVTTILLDVFIAGSDTITATVEWAMAELLRNPSEMAKVRAEMDGALGGKKTVDEPDIARLPYLQAVVKEAMRLHPAAPLLLPHRAVEDGVEVGGYCVPKGSMVIFNVWAIMRDPAAWERPEEFMPERFIRRGDDDEVDFWGKTFEFIPFGSGRRVCAGLPMAERVVPFMLASLLRAFEWRLPDGVSAEELDMRHRFTIANFRAIPLKAVPVVVS

SEQ ID NO: 30732 - protein, 259 aa, Physcomitrella patens subsp. patens
MTGDREKDVGEGIIYKDPDYLAFMQQLAKPAEYLPRVEIQLERREAEKAASIVAGTSKDVVVVTPLTDLVRSLRAAKFTSQRSMSSNSELSARSAESANHAPTPRDELQRKERETLIERKRKEAGERKEEKWDKESVVGSRQAAPAANGDAGVSGNNLWHRSSRTKGKSPMGGSLRLIPYYEAVLHQGQVGRVGKRPPSPRAIRLAGKDHIISFMVSTEAEGQAGNGEEWSVKQVASDGVAAMQSSLENSGRRNVSLEV

SEQ ID NO: 30733 - protein, 290 aa, Methanocaldococcus jannaschii DSM 2661
MAECDGKCDTCPSKNTCPDTKKLLAQQDAKIRENMSKIKHKIVILSGKGGVGKSTVTVNLAAALNLMGKKVGVLDADIHGPNIPKMLGVENTQPMAGPAGIFPIVTKDGIKTMSIGYLLPDDKTPVIWRGPKVSGAIRQFLSDVVWGELDYLLIDTPPGTGDEQLTIMQSIPDIDGAIIVTTPEEVSVLDVKKSIMMAKMLNIPIIGIIENMSGFVCPYCNKVVDIFGRGGGEKAAKELGVEFLGRIPLDIKAREASDKGIPMVLLDCKASEEFKKIVKRIVEKVEGKKE

SEQ ID NO: 30734 - protein, 383 aa, Vitis vinifera
MADGSQHSSIFQKINGQSYLFSTLSPNLQSRNTSVHSLSSAYVNGGLQTSLLPAGSGNGLALVSPLSPIFAHAPAEKGAKGFMIDFLMGGVSAAVSKSAAAPIERVKLLIQNQDEMIKAGRLSEPYKGITDCFARTIKDEGVISLWRGNTANVIRYFPTQALNFAFKDYFKRLFNFKKDRDGYWKWFAGNLASGGAAGASSLLFVYSLDYARTRLANDAKAAKKGGERQFNGLIDVYKKTIKSDGIAGLYRGFNISCVGIIVYRGLYFGMYDSLKPVVLVGEMQDSFLASFLLGWGITIGAGLASYPIDTVRRRMMMTSGEAVKYKSSFDAFSQILKNEGAKSLFKGAGANILRAVAGAGVLAGYDKLQLLVLGKKYGSGGGG

SEQ ID NO: 30735 - protein, 244 aa, Zea mays
MSTVTRAYLDQRLAAANRCSREAAMAGAKAAAVAAVAAAVPTLASVRMLPWARAHLNPTGQALIVSTVAGMAYFIVAVIMVGSPTKGTRFRPLSLNVPKPLFPLAGQPMVHHHISACRRIPNLAQIYLIGFYEEREFALYVSSISNELRIPVRYLREDKPRGSAGGLYSFRDYIMEDSPAHIVLLNCDVCSSFPLPDMLEAHKKYGGMGTLLVNKVSAESANQFGELVADPETNELLHYTENQR

SEQ ID NO: 30736 - protein, 527 aa, Arabidopsis thaliana
MHSSHLLLEEPIRMTSILEPSKSSFFPALTKIVGTLGPKSRSVEVIAGCLKAGMSVARFDFSWCDADYHQETLENLKIAVKSTKKLCAVMLDTVGPELQVINKTEKAISLKADGLVTLTPSQDQEASSEVLPINFDGLAKAVKKGDTIFVGQYLFTGSETTSVWLEVEEVKGDDVICISRNAATLGGPLFTLHVSQVHIDMPTLTEKDKEVISTWGVQNKIDFLSLSYCRHAEDVRQARELLNSCGDLSQTQIFAKIENEEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICCEAEKVFNQDLFFKKTVKYVGEPMTHLESIASSAVRAAIKVKASVIICFTSSGRAARLIAKYRPTMPVLSVVIPRLTTNQLKWSFSGAFEARQSLIVRGLFPMLADPRHPAESTSATNESVLKVALDHGKQAGVIKSHDRVVVCQKVGDASVVKIIELED

SEQ ID NO: 30737 - protein, 113 aa, Glycine max
MAFSMISSPAVTTVNRAGAGMVAPFTGLKFMAGFPTRKTNNDITSIASNGGRVQCMHVWPPIGKNKFETFSYLPHLYYVHISIEFITFLRKMVFCLNSILKLFFSSFTKFSFF

SEQ ID NO: 30738 - protein, 505 aa, Oryza sativa Japonica Group
MYRAASGLGAIKRHGLDGQMLNVAIRCASTSVAQRSSGGFWTWLTGARSNALPPPDFTLPGVTIPPPLPDLVEPGKTKITTLANGVKIASETTPGPSCSVGVYVNCGSVHEAPETLGATQLLKKMAYTTTTNRSHLRVVREIEAVGGNVKASANREMMSYSYAALKTYMPEMVEVLIDCVRNPAFLDWEVKEQIMKLKAELAEASSNPETFLLEALHSTGYSGALATPLIASESSVSRLNTNVLEYFLAENYTAPRIVLAATGVDHDELVSIAEPLLSDMPGVTGPAKPKSTYVGGEYRRTADSSNTDVALAFEVPGGWLKEKEFVTVSVLQTLLGGGGTYSWGRHGKGLHSSLNHLANEFDQIRSIAAFKDVHSNTGIFGIHTSTDAAFVPKAIDLATRELTSLATPGKVDQTQLDRAKATAKSAILMNLESKASATEDMGRQILAFGERKPVEHLLKAVDGVTLKDITALAEKIISSPLTMASHGNVLNVPTYDSVSGKFRSK

SEQ ID NO: 30739 - protein, 488 aa, Bacillus cereus ATCC 14579
MTKNNETGWNLDNSYTTLPQSFYTEIPPTPVSSPELVKLNHSLAISLGLTPEELKKEAEIAIFAGNGLPEGAHPLAQAYAGHQFGHFNMLGDGRALLIGEQITPSGERFDIQLKGSGPTPYSRRGDGRAALGPMLREYIISEAMYALDIPTTRSLAVVTTGEPTYRETKLPGAILTRVASSHIRVGTFQYAAARGSIEDLKSLADYTIKRHYPEIESHENRYTALLQEVIKRQASLIAKWQLAGFIHGVMNTDNITISGETIDYGPCAFMDNYDQGTVFSSIDTQGRYAYGNQPYMAAWDLARLAESLIPILHEDEEEALKIAQDEISKFSVQYEKQWFLGMKKKLGLFSNEEQDHSLIEQLLKMMEKYKADYTNTFRSLTLDAIENTALFESPEFKEWYKLWQSRLDRQEQSKENAYEMMKNNNPSIIPRNHRVEEALEAAVTNDDYSVMEKLLEALSNPYAYSTDQEEYCAPPAPTNRPYRTFCGT

SEQ ID NO: 30740 - protein, 70 aa, Bacillus cereus
RSFFAWLPVPKGYTSEQFSDILLEKAHVAVAPGVGFGKHGEGYVRVGLLHAEDRLREAINRIDKLNFFKK

SEQ ID NO: 30741 - protein, 446 aa, Escherichia coli
MISEHDSVLEKYPRIQKVLNSTVPALSLNSSTRYEGKIINIGGTIIKARLPKARIGAFYKIEPSQRLAEVIAIDEDEVFLLPFEHVSGMYCGQWLSYQGDEFKIRVGDALLGRLIDGIGRPMESNIVAPYLPFERSLYAEPPDPLLRQVIDQPFILGVRAIDGLLTCGIGQRIGIFAGSGVGKSTLLGMICNGASADIIVLALIGERGREVNEFLALLPQSTLSKCVLVVTTSDRPALERMKAAFTATTIAEYFRDQGKNVLLMMDSVTRYARAARDVGLASGEPDVRGGFPPSVFSSLPKLLERAGPAPKGSITAIYTVLLESDNVNDPIGDEVRSILDGHIVLTRELAEENHFPAIDIGLSASRVMHNVVTSEHLRAAAECKKLIATYKNVELLIRIGEYTMGQDPEADKAIKNRKLIQNFIQQSTKDISSYEKTIESLFKVVA

SEQ ID NO: 30742 - protein, 552 aa, Triticum aestivum
MKRVSSHVSIASEAEINLDLSRLLIDKPRFTLERKRSFDEQSWSDLSHRHNDGFDSVANSPAFRTGFESPFSTGAHFGEPSGPHPLVNEAWEALRKSVVHFRGQPVGTVAAVDHASEEVLNYDQVFVRDFVPSALAFLMNNEPEIVKNFLLRTLHLQSSEKMVDRFKLGAGAMPASFKVDRNVNRNTETLVADFGESAIGRVAPVDSGFWWIILLRAYTKYTGDASLSESPDCQKCMRLILNLCLSEGFDTFPTLLCTDGCSMIDRRMGIYGYPIEIQALFYMALRCALQMLKPDGEGKDFIEKIGQRLHALTYHMRNYFWLDFPHLNNIYRYKTEEYSHTAVNKFNVIPDSIPDWVFDFMPCRGGYFLGNVSPAMMDFRWFALGNCIAIISSLATPEQSSAIMDLIEERWDELVGEVPLKIVYPALENHEWRIITGCDPKNTRWSYHNGGSWPVLLWLLTAACIKTGRPQMAKRAIELSEARLLKDGWPEYYDGKLGKFVGKQARKFQTWSIAGYLVARMMLEDPSTLMMISMEEDRPVKPTMRRSASWNA

SEQ ID NO: 30743 - protein, 905 aa, Marchantia polymorpha
MMAFVAEGYRVPYLRIASALLALAVIACFPVSSAERSGLSFACGAPEGFTTNSVLWKSDKDIAPAKSKIAKIGTDYVRYFSEYSDANAHQNLHCYDKLPSITSEGPILLRVTFEYSNYDGLDAPPEFQMWVGASEVAYVNLKKDDPWVEEAVLKYSSDSSTQVLCLVAVKGAPAISFIELRPLPADAYSAGHLLRTLKRIDCGNDNATRRVRFPQDVYDRIWDVDANFPSNSDSFASKVTIDGEDVPERPPMAVLETSRVPSSGTRLAYKFDTETTGFFEIKVYTPSTIPSTLNVNGVSSTESPVVGREVQVTSVSRVPDSSGGVEVVLQGSNGLKPQINALEVFQEIDGIFSNDADAINAIKAYYNIVSNWFGDPCLPVPWNGLECSSDSRVTSLDLSGQNLIKPMNPKIKSLTRLKSLNMSFNKFDSKIPDLTGLINLQVLDLRKNDFFGNLDVLSGLSALTQLDVSFNPRLSGETPSALKRTNLQIDAQGTCVDQPAGCNLSPSPEVSSLLNKNRTGLIVGVVVAVVLAILLALVICIFLIWRRKKPRAGRGEVEGGVDLRNWTAAKVFTFKELETATNHFKKKIGEGSFGPVYLGVLSNGQKVAIKMRHDTSALGADAFANEVYLLSRVNHPNLVSLLGYCQEGKNQYQLLVYEFMPGGTLMDHLYGTMVRLDWITRLRIAIGAATGISYLHNGSDPKIIHRDVKSTNILLDNNLMAKVSDFGLSKLVTRTEATHVTTLVKGTAGYLDPEYFTTNQLTEKSDVYSFGVVLLEIICGREPLTGNRAPDEYNLIAWAKPYLLAKTYEGIVDRGLQNNYNSRSMSLVASLALRCIERDSKNRPTMLQVLRELEEALQYEDRPERTLASPSQPDSAAFDFKSTASDTPPDSAPQLANVPSFTFPR

SEQ ID NO: 30744 - protein, 357 aa, Oceanicola granulosus HTCC2516
MTSNKLNIAVIAGDGIGKEVVPEGLRVLEAAAKRYDLSFDFKEHDFASCDYYGRTGEMLPEDWKTRLEGSDAIFFGAVGWPDVVPDHVSLWGSLLKFRREYDQYVNLRPVRLMPGVPSPLANRAPGDIDFYVVRENTEGEYSSIGGKMYEGTDREIVVQETVISRHGTDRILKFAFELAQSRPAKHLTSATKSNGISITMPYWDERVEEMAKNYGDVKVDKYHIDILTAQFVLNPDWFDVVVGSNLFGDILSDLGPACTGTIGVAPSGNIDPTGRFPSLFEPVHGSAPDIAGKGIANPVGQIWAGAMMLEHLGHKEAADGIVQAIETVLSEQKLRTGDLGGPLGTVDCGKAIADALS

SEQ ID NO: 30745 - protein, 468 aa, Burkholderia sp. 383
MVVQGSGNAVTQQQRSFDDIVAREQGLRHALTSGQMAMIAIGGAIGTGLFLGSGFAIGLAGPSVLVSYAIGALIALLLMGALAEMTVAHPTAGSFGAYAEHYVGPLAGFLVRYAYWFAVVFAIGTEISAIAVFMKYWFPAVPGWYWVIGFSALLIAVNLASVTLYGTVEYAFSLLKIAAIVVFIVLGAYLVWSAPAASGVGFANYTAHGGFMPKGPWGTWVAVIVAIFSYMSIEAVAIAAGEARDPQHAVTRAFRSTVFRLVLFYLLTLSLMLAIVPWTQAGTDESPFVKVMAATHVPYAAGVINFVLLIAALSAMNSQLYVTTRMMFSLSRARLAPAVFGRLGTNGVPRAALWISTSGVAVAAVLVALAPDTAFTVMMAIAMFGALFTWLMIFVTHLRFRSRYRGPALAFRMWGHPFGSLLGAGLVAAILFTTAFTREFRMTMVVGVVFAVLLTLAYALHYRHQHAR

SEQ ID NO: 30746 - protein, 364 aa, Physcomitrella patens subsp. patens
MDMFRKSANKLREQVVKQQHAVLKQLGGHGSGSDVIIDEAESQRHQQLEKLYASTRAAKHFQRELVRGVEGIVSTGSKQLEVANKLADECKKYGTEGVGVGGALSKASLQYGTAKIQMEKERDSMHRVLSTQVADPLRAMVNGAPLEDARQLTQRYDRLRQEAETQASEVSKRRTKDAGGLENVVKLQVAETKMQELSSSMAVLGKEAASAMTAVEAQQQRLTLQRIIALVHAEQAYHQRAAEILDQLQDHLVSELQHSEASVPSSGTTVKTPTFVDADIGDAVQTKRSQTRNYFIAEVTHPFEAESHGELSLSVGDFVVVRQVAPSGWSEGECKGQAGWFPSSYVEARQRMPGDKVTEGFSGV

SEQ ID NO: 30747 - protein, 749 aa, Marchantia polymorpha
MQSPETIVVGVSLGQESQDLLAWACNTAAQSGDHIIALHVIDHSAIIAKELQDGGLEKYKSSVAFGLTSLLDPLKELCTEKELTTQVRVVCGETLDKVLVEEAAALGATLLVLSTSGRRVAPWRIQGTASYCSRHAAPGCSVVVVSNKKILLYKEHRQKLSYDGSVALLTEDTQELLAKSRYKGLEAPFFGPAPKHSSRQSSKQTSPVKASYFDPARDSFSTSRLFKDASPSKCSLIESGRESFSSSKVHSKEVKCTMFELGRDSVDRASPISGCEEHHAEMLSPRNVLDGPGSFADSCTSSPSGSYNPGSWSPSNARKSLLSPLSSSSEEARHSVSERQQKPCLTLWKNMSMRRWHTFPSTNQKAPKRSPSNFLATSVLKLCNGPTPLSPSPSMDRDQAGALLCSALSDKPHWKFFTFEELAIATDNFNPGNIVGKGGYAEVYRGSLSDGSTIAVKKLIKGDTEEEKETFFLTELGIVSHVSHPNTTEIIGFCIEGGLHLVFHFYHHGSLAAFLYGVQPQVLDWAVRFKIAVGVARGLHYLHRQCPRRIIHRDIKASNILLGEDFEPQISDFGLAKWLPELWTHHTVTPVEGTFGYLAPEYFMHGYVDEKTDVFAYGVLLLELITGRRSINAAQQSLVMWARPLLDAENVQELVDPRLAGAFDSEELHRVVLAATLCVRQSSVWRPCMSQVLSLLVDGELEADLPDAVDFLARKSSECGGDSSRFGDNYSSDNYSSDMHRHRALALEF

SEQ ID NO: 30748 - protein, 431 aa, Acidobacteria bacterium Ellin345
MEPSLVVVGLNFKTSPVAVRERFWMSELRRYEALHQLVRAEGIDELVVLATCNRTEFILWTSDAGEAADSVLRFLTHEYGLKMSDWSHFYRLMDDVALNHIFRVASSLDSMVIGEPEIVGQFKNAWSQAQAAGTTGRFLDAVMQKALTVSKRVRNETAIGNAAVSIPYTTVELSKQVLGELFDKAVVLMGAGKMSESAAKYLMNHGASQICVINRTLHKAQEFSEKVGGIAVALEDRAPYLDHADIIVSSTSCPHYVIEKADAERIQAARGGKPIVMVDIAVPRDIDPAVREVPGVHLFDMDDLEKVAKRNESERQVAAVAAEEILADEAKGFRRKLMAERVVPTIVALRNRLDEVCRQELESLRQELGPFTEDQDQAMTALTAHITQRIAGSLARELKELPERSEQDMLTMAVQRLFHLEQPQKAAAGTN

SEQ ID NO: 30749 - protein, 135 aa, Brassica napus
  misc_feature (75)..(75): Xaa can be any naturally occurring amino acid
MNHGQQSGEAKHEDDPALTEFLGSLMDYTPTIPDDLMEHYLAKSGFQCPDVRLIRLVAVATQKFVADVASDALQXHCKARPAPVVKEKKQQKDKRLILTMEDLSKALREYGVNVKHPEYFADSPSTGIDPATREE

SEQ ID NO: 30750 - protein, 726 aa, Aeropyrum pernix K1
MANSSVELRVSEAYPRDVGRKIVRIDRQTAARLGVEVGDFVKVSKGDRSVVAVVWPLRPDDEGRGIIRMDGYLRAALGVTVGDTVTVEKAEKVEPASKVVLAPTEPIRFGRDFVEYVKEFLLRKPISRGETIIVPVLEGLPLVVVSTQPAHFVYVTEATEVEIREKPVREEIERLRGVPKVTWEDIGDLEEAKERIREIVELPMKHPEIFKHLGIEPPKGILLYGPPGTGKTLLAKALANEIGAYFISINGPEIMSKYYGESEQRLREIFKEAEENAPSIIFIDEIDAIAPKREEVTGEVEKRVVAQLLTLMDGLKERGRVIVIGATNRPDAIDPALRRPGRFDREIEIRPPDKRARAEILKVHTRNMPLAEDVDLDKLAEMTHGYTGADLAALAKEAAMAALRRFIREGKINFEAKEIPATVLKELKVTMKDFMEAMKMIRPTLIREIYVEVPEVRWSDIGGLEEAKQALREAVEWPLKHPEIFEKMGIRPPRGVLLFGPPGTGKTLLAKAVATESGANFIAVRGPEILSKWVGESERAIRKIFERARQAAPAVVFFDEIDAIAPARGARFDTSGVTDRIVNQMLAEMDGIQPLSNVVVIGATNRPDILDPALLRPGRFDRLIYVPPPDKEARKEIFKIHTKKVPLGEDVDLEKLAEMTEGYTGADIEAVVREAVMAKLREKLEVGKVEMRHFLEALKKVPPSLTKEDILRYERLAKELKKLTLG

SEQ ID NO: 30751 - protein, 369 aa, Saccharomyces cerevisiae
MLRNTFFRNTSRRFLATVKQPSIGRYTGKPNPSTGKYTVSFIEGDGIGPEISKSVKKIFSAANVPIEWESCDVSPIFVNGLTTIPDPAVQSITKNLVALKGPLATPIGKGHRSLNLTLRKTFGLFANVRPAKSIEGFKTTYENVDLVLIRENTEGEYSGIEHIVCPGVVQSIKLITRDASERVIRYAFEYARAIGRPRVIVVHKSTIQRLADGLFVNVAKELSKEYPDLTLETELIDNSVLKVVTNPSAYTDAVSVCPNLYGDILSDLNSGLSAGSLGLTPSANIGHKISIFEAVHGSAPDIAGQDKANPTALLLSSVMMLNHMGLTNHADQIQNAVLSTIASGPENRTGDLAGTATTSSFTEAVIKRL

SEQ ID NO: 30752 - protein, 515 aa, Pisum sativum
METPPSQQGVVKKKETRGRKPKPKDDQQQTPAKTLKEAKKAQLQQQQQQQLQQQQQQQQHQASVDEKYTQWKSLVPVLYDWLANHNLVWPSLSCRWGPQLEQATYKNRQRLYLSEQTDGSVPNTLVIANCEVVKTRVAAAEHISQFNEEARSPFVKKYKTIIHPGEVNRIRELPQNSKIVATHTDSPDVLIWDVESQPNRHAVLGATNSRPDLILTGHQDNAEFALAMCPTEPYVLSGGKDKTVVLWSIEDHVTSAATDKSGGSIIKPNSKSGEGNDKTVDSPSVGPRGIYSGHDDTVEDVAFCPSSAQEFCSVGDDSCLILWDARVGSSPVVKVEKAHNADLHCVDWNPHDDNLILTGSADNSVRLFDRRNLTSNGVGSPIHKFEAHKAAVLCVQWSPDKSSVFGSSAEDGLLNIWDYEKVGKKIERAGKTINSPPGLFFQHAGHRDKVVDFHWNAYDPWTIVSVSDDCESTGGGGTLQIWRMSDLLYRPEDEVLAELEKFKSHVVACAAKTDT

SEQ ID NO: 30753 - protein, 485 aa, Sinorhizobium meliloti 1021
MGKVTGFLEIDRQVAKYQPASDRIRHFREFTIPMSDQEVQKQSARCMDCGIPYCHGPTGCPVHNQIPDWNDLVYNGNWDEAIRNLHSTNNFPEFTGRVCPAPCEEACTLNLEDVPVAIKTIEQAIADKAYEMGYIVPQPAVTKTGKKVAVIGSGPAGMAAAQQLARAGHEVHVYERESKPGGLLRYGIPDFKMEKNFIDRRVEQMRGEGVTFHCGVNVGVDVAVQKLVDENDAVLYCGGSETPRDAGIPGVEFFGVHDAMPYLVQQNRRVGRENIDSVGWPSEPILAGGKHVVVVGGGDTASDCVGTAFRQGAVKVTQLDIRPQPPEKEDKLAVWPFWATKMRTSSSQAEGAVREFQVATLEFVGDEDGNLTGVKCCQVDERRKPIAGTEFIIKADLAFIAIGFRGPFADSVLKDLGEKLTVNTDRRGSTNVVANERDYRTSVDKLWAAGDIRRGQSLVVWAIREGRQAARAIDEALMGSTVLPR

SEQ ID NO: 30754 - protein, 368 aa, Clostridium perfringens SM101
MNNCIGIINLDENESKIGELVKNRPLAAVPIAGRYRIIDFILSNMTNAGIESLGILSKNKSRSLVDHLTNGRPWDLHRKRDGLRVFNFGERDPYYDDITNLYENLEFLTKSRREYVIMSPSYMICNIDLKEALEYHKKNDNDITVIYKKVKDADSNFIDCDVLNFDECGFIKSIGKNLGREEESSISLEMYILRTDLLIEIIYECIRRGSHRKFKSYLKEFLDEIKVGGFEFKGYLSCVNSLKSYYKANMDLLEEKVYKELFIDNNPIYTKSRDEGPTHYTKNSEVTNSIIANGSYIEGKVENSIIGRRVYVGPEAVIKNCIIMQETVIGENAHLDKIITDKAAVIRDDDKIVGLEYCPMVLSKPNVI

SEQ ID NO: 30755 - protein, 510 aa, Oryza sativa Japonica Group
MAVMEEQQEGAAGVMRRRPKTKIVCTLGPASRSVEMIGRLLRAGMCVARFNFSHGSHEYHQETLDNLRAAMESTGILCAVMLDTKGPEIRTGFLKDGKPVQLKKGQEITVSTDYSIKGDDNMISMSYKKLAVDLKPGSVILCADGTITLTVLHCDKEQGLVRCRCENTAMLGERKNVNLPGVIVDLPTLTEKDKEDILKWGVPNKIDMIALSFVRKGSDLVEVRKVLGKHAKSIMLMSKVENQEGVANFDDILAQSDAFMVARGDLGMEIPIEKIFYAQKVMIFKCNIQGKPVVTATQMLESMIKSPRPTRAEATDVANAVLDGTDCVMLSGETAAGAYPELAVRTMAKICLQAESCVDHAAVFKSITASAPIPMSPLESLASSAVRTANSAKAALILVLTRGGTTARLVAKYRPSMPILSVVVPELKQTDSFDWTCSDEAPARHSLIVRGVIPMLSAATAKAFDNEATEEALGFAISNAKAMGLCNSGESVVALHRIGTASVIKLLTAN

SEQ ID NO: 30756 - protein, 322 aa, Prochlorococcus marinus str. MIT 9312
MEIANDITSLVGNTPLVKLSRIRNYFNCYPEIIAKLESFNPSASVKDRIAYSMLCKAEEEGLITPDKTTLIEATSGNTGIALAMVAAAKGYKLILTMPDTMSIERRAMLRAYGAELQLTPGQEGMKGALDLANELSSSIANSYQFNQFENFANPDIHERTTAQEIWAQSNNNLDGLVTGVGTGGTITGCARFLKKVNPNCKIYAVEPRKSAVISGEKAGSHSIQGIGAGFVPKVLNTKLIDEIIKIDDDEAFYYGRLLARLEGLLSGISSGAALAATIKIGERKELINKRLIVILPSFGERYLSTAMFESNTSIQARTDGYL

SEQ ID NO: 30757 - protein, 267 aa, Zea mays
MAAMTAYKYQAQALMRDYLLADPLVPYTSVLIGIVLCKMAYDFTRILSSFYFKGYTLLTKIQRIEWNNRGMSSAHAIFITAVSLYLVMSTDLFSDRVKGPITFRYSIISTSALGVSVGYFITDLAMIFWLYPSLGGMEYVLHHTVSLVAIAYTMLSGEGQFYTYMVLISETTTPEINLRWFLDTAGLKKSSAYLVNGILMFVAWLVARIFLFMDVFYHIYLHYSQIMQMHAFGYYLTFVVPSVLFVMNTMWFMKILKGVMKTLAKWS

SEQ ID NO: 30758 - protein, 176 aa, Klebsiella pneumoniae subsp. pneumoniae MGH 78578
MSLLNVPAGKDLPEDIYVVIEIPANADPIKYEVDKESGALFVDRFMSTAMFYPCNYGYINHTLSLDGDPVDVLVPTPYPLQPGSVVRCRPVGVLKMTDESGEDAKLVAVPHTKLSKEYDHINDVNDLPELLKAQITHFFEHYKDLEKGKWVKVDGWDNAEAAKAEIVASFERAKQK

SEQ ID NO: 30759 - protein, 495 aa, Vibrio fischeri ES114
MFKNFKIDWMSNIRGDLLAGIVVALALIPEAIAFSIIAGVDPKVGLYASFSISVVIAFAGGRSGMISAATGAMALLMVTLVKEHGLEYLLAATVLTGVFQILAGYLKLGSLMRFVSRSVVTGFVNALAILIFMAQLPELTDVTWHVYAMTVAGLGIIYLFPYLPVIGKLIPSPLVCIIALTIISIWFGIDVRTVGDMGHLPDTLPIFLWPDVPLNLNTLLIVLPYSLGLAVVGLLESMMTATIVDDLTDTSSDKNRECKGQGIANIFTGFLGGMAGCAMIGQSMINIKSGGRGRLSTLSAGVFLLIMVVFLGPWLKQIPMAALVSVMIMVAIGTFSWRSITDLKKHPLSTNIVMLVTVIIVVMTHNLAIGVLVGVLLASLFFANKISRMMVIKNNSEETKSREYIVIGQVFFASSDKFIASFDFKEVIECVTIDLSAAHFWDITSASALDKVVVKFRREGTQVELIGMNQATKTIVDKFGVHDKPEEVEKLLAGH

SEQ ID NO: 30760 - protein, 338 aa, Triticum aestivum
  misc_feature (195)..(196): Xaa can be any naturally occurring amino acid
  misc_feature (265)..(265): Xaa can be any naturally occurring amino acid
  misc_feature (295)..(295): Xaa can be any naturally occurring amino acid
MASSTSTLEIEARDVVKIMLQFCKENSLHQTFQTLQNECQVSLNTVDSMDTFIADINAGRWDAVLPQVAQLKLPRKKLEDLYEQIVLEMAELRELDTARAILRQTQVMGVMKQEEPERYLRLEHLLVRTYFDPNEAYQESTKEKRRAQIAQAIASEVSVVPPARLMALITQALKWQQHQGLLPPGTQFDLFRGTXXAMKQDEEEAYPTTLSHQIKVGEKTHPECARFSPDGQYLVSCSVDGIIEVWGYVSGKLKKDLQYQADESXMMHEDAGLCGDFSRDSEMLALGSRDGKIKXWGLRTGQGLDPSSVNSRRGQGVPFPVWTRIWVPFAHRKNHGLS

SEQ ID NO: 30761 - protein, 327 aa, Robiginitalea biformata HTCC2501
MDLIIIGGGPIGIACGLEAKKKGVSYTIIEKGPIVNSLFNYPVNMQFFSSSERLEIDEIPFISKEAKPKRNEALEYYRRIVTSNQLNIRLFEKVGGIHRGDDGFTVQTSRGEYAARNVIIATGFYDLPNLLGVPGEDLPKVSHYYKDPHFYASQKLAVIGASNSAVDAALECWRKGADVTMIVRGPEIGQRVKYWVRPDILNRIEEGSIRAYYNSEVTRIDEESIEIRTPDGIRSLPNDFVLALTGYQPNFEFLEQAGIRLSDDAKRLPEYNPETMETNVPGLYLAGVICGGMETHKWFIENSRDHARLILDHIAGNMEAAALPGKL

SEQ ID NO: 30762 - protein, 234 aa, Debaryomyces hansenii CBS767
MSYREDRIICTFYTKIGACRHGEKCSRKHVKPSSSDTILLPNLYQNPKLNKNDGEELNPKQVQEYFDHFYKDIFLKFALFGEVYSMVVCENDNNHLNGNVYVKFANEDSAYNAVMLLNQEWFGGRPVHCELSPVESFHDANCRAYESSTCNRGDHCNFMHIHKPTPQLKSSLFKSQEKSTLTKQLQLLRGELTGSLENENVQQDAAGEQISKPAETTSTETVEKLFASSIPSHI

SEQ ID NO: 30763 - protein, 418 aa, Burkholderia sp. 383
MPYQHIKVPEGGDKITVNKDFSLNVSDQPIIPYIEGDGTGFDITPVMIKVVDAAVAHAYKGKRKIHWMEIFAGEKATKVYGPDVWLPDETLQVLKEYVVSIKGPLTTPVGGGIRSLNVALRQELDLYVCLRPVQYFKGVPSPVREPQKIDMVIFRENSEDIYAGIEWAAGSEQAKKVIKFLQDEMGVKKIRFPETSGIGVKPVSTEGTERLVRKAIQYAIDNDRKSVTLVHKGNIMKFTEGLFRDAGYALAQKEFGGELIDGGPWMRVKNPKTGNEIVIKDSIADAFLQQILLRPAEYDVIATLNLNGDYISDALAAQVGGIGIAPGANLSDSVAMFEATHGTAPKYAGKDYVNPGSEILSAEMMLRHLGWTEAADTIIAAMEKSILQKRVTYDFARLMEGATQVSCSGFGEVLIENM

SEQ ID NO: 30764 - protein, 332 aa, Klebsiella pneumoniae subsp. pneumoniae MGH 78578
MKTLGEFIVEKQHEFSHATGELTALLSAIKLGAKIIHRDINKAGLVDILGASGAENVQGEVQQKLDLFANEKLKAALRARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGNTYSINEGNYIKFPQGVKKYIKYCQEEDKATQRPYTSRYIGSLVADFHRNLLKGGIYLYPSTASHPEGKLRLLYECNPMAFLAEQAGGKASDGKERILDIIPESLHQRRSFFVGNNHMVEDVENFIKAFPDA

SEQ ID NO: 30765 - protein, 434 aa, Helicobacter pylori
MPLKSLKNRLNQHFDLSPRYGSVKKIMPNIVYADGFNPSVGDVVKIEKSDGSECVGMVVVAEKEQFGFTPFNFIEGARAGDKVLFLKEGLNFPVGRNLLGRVLNPLGQVIDNKGALDYERLAPVITTPIAPLKRGLIDEVFSVGVKSIDGLLTCGKGQKLGIFAGSGVGKSTLMGMITRGCLAPIKVIALIGERGREIPEFIEKNLKGDLSSCVLVVATSDDSPLMRKYGAFCAMSVAEYFKNQGLDVLFIMDSVTRFAMAQREIGLALGEPPTSKGYPPSALSLLPQLMERAGKEENKGSITAFFSVLVEGDDLSDPIADQARSILDGHIVLSRELTDYGIYPPINILNSASRVAKDIISESQNLCARKFRRLYALLKENEMLIRIGSYQMGNDKELDEAIKKKALMEQFLAQDENALQPFETSFQQLEEILR

SEQ ID NO: 30766 - protein, 110 aa, Arabidopsis thaliana
MGIKILLILGLLTLAVVAESANATWTLTKSCVNGQGCIGEDGELDYLMDSETNRRQLAARRSYISYGALRKNNVPCSRRGRSYYDCKKRKRANPYRRGCSVITHCYRQTS

SEQ ID NO: 30767 - protein, 376 aa, Arabidopsis thaliana
MAIRKEEESREEQSNSFLLDALYCEEEKWDDEGEEVEENSSLSSSSSPFVVLQQDLFWEDEDLVTLFSKEEEQGLSCLDDVYLSTDRKEAVGWILRVNAHYGFSTLAAVLAITYLDKFICSYSLQRDKPWMLQLVSVACLSLAAKVEETQVPLLLDFQVEETKYVFEAKTIQRMELLILSTLEWKMHLITPISFVDHIIRRLGLKNNAHWDFLNKCHRLLLSVISDSRFVGYLPSVVAAATMMRIIEQVDPFDPLSYQTNLLGVLNLTKEKVKTCYDLILQLPVDRIGLQIQIQSSKKRKSHDSSSSLNSPSCVIDANPFNSDESSNDSWSASSCNPPTSSSSPQQQPPLKKMRGAEENEKKKPILHLPWAIVATP

SEQ ID NO: 30768 - protein, 638 aa, Closterium ehrenbergii
MTIQTHKIFRSGAMKLALGVLVLLLGADLISCQTGDTPDPLEASYAGDGAFLHKWQAASFTNFPLSFWHSVVGRPCPAPNSVDIPFAGVTCNDRLFTIGVDLSHPSMPAGTPKLEGVLDWNITGVIYLQTLDLSQNNLHGSIPAQMGLAPALRTLNLENNNFTGRLSPMLCYISTLECLHLAGNNLTGPLPDCWKGKFPCPDFEGNNLTITKGVDCLDVDYKSCVSNFTAITAPKTSSGLSVGVVIGIVFGSLAVVAFCVALVIFIRFKQDQRRKELEAERLAQDIETQISTRHFGTLRRFSVDELSKATNGFDEDNLLGEGGFSKVYKGKLEDGKSVAIKRIKEEKKSGGELMFLAEVELISRAVHRNVMHSEGFCVERGECMLVLPFYANGSVASRTQGKEGNPIDWSTRQKIARGAAEGIAYMHTDCNPKLIHRDIKAANVLLDESDEAVIADFGLAKEMDVQESHATTAVKGTIGHIAPEYFISGQCSEKTDVYAFGVFLLELVSGKDVFELTVAPEAEEILLRDWVANMLRDGKLAEFIDKDLVKLGYDEVEAAKMLQVALLCMKPEAADRPMMDDVAKMLSGRALADKWEKWQEEAAKMSGEDVMAVVNTPAIWENTTTGISLEAFNLSGPR

SEQ ID NO: 30769 - protein, 302 aa, Physcomitrella patens subsp. patens
MGSCDDASIAASLGCVPSKPSELLRASGKFFWRSKVYTEIVSFATPIAVCLLILYISGGCDYLERNGMLCHLERLKEVLPVFRAAPPSVGSINNEDFEPLPVELAKEVPKAQWGDEDVEEVKTNCKVVEKPRTESPSELKPEKKRNKANNVTSKDEPFSDPLTEKLRQRRLVEKADNRNVAALSPGHESKEGNTLEDFIPKSSNDFLTYADLVLDKIRPFEKSFHYMTLLKALVRHSVKNLTATHTKELASSIAVIANEKLRDAEAGRKQKGPKKKQLLVDKPDEDSYSPDAYDDIYDRDYM

SEQ ID NO: 30770 - protein, 387 aa, Microcystis aeruginosa PCC 7806
MKLASRVNQVTPSLTLAIDSLAKEMKKNGEDVCSFSAGEPDFDTPTHIRAAAKKALDEGKTRYGPAAGEAGLRKAIAEKLLRDNQLAYNADNVIVTNGGKQSLYNLIMALIEAGDEVIIPAPYWLSYPEMVTLAGGTSVIVNTSLENQYKITPEQLEAAITPKTKLFVFNSPSNPTGIVYTPEEIAALAKIVVEKDILVVSDEIYEKILYDGAIHRSIASLGPEIFQRSIISNGFAKAFSMTGWRVGYIAGPVEIVKAMTKIQGHSTSNVCTFAQYGAIAALESPQDCIEEMVKAFSERRQYILERVRSLSGLNCPTPNGAFYVFIDISQTGLKSRDFCQKLLETQKVAAIPGIAFGADDCIRLSYATDLKTIEKGFDRIDKFIGTL

SEQ ID NO: 30771 - protein, 334 aa, Oceanicola granulosus HTCC2516
MVDMVNRPYERAFEQHALANPDVLCISADLTSSCEIDKFRDNHPDQFLSMGMAEQNMMSFCGGLGLAGFRPFVHTFGVFTYRRPYDQLMASIAYPRRKVRIMGFLPGITTPGGMTHQAIEDIAVMRSMPNMTILETGDATEVESICAAADSIDGPVYCRVLRGSVPRLFDTPIKVGEMREISLGDDVLIVTAGITTEEAMRATRALEAAGVSVRHLHLHTIKPFDAGALLDHIGAVRGGVITLENHVTEGGIGSLVAEVMADNGIGKKLRRLGLKDTYAHGGSRAYLMRYYGLDALALTRGVEDLLGQPLGITEEDLAQARVEAVHSLAKAEGL

SEQ ID NO: 30772 - protein, 286 aa, Listeria monocytogenes str. 4b H7858
MILPGNETIPYIGLGVFQVTEQEFIAGAVEKAIEVGYRLFDTAAVYNNEAIVGQAIASSAVSREELFISSKVWNGDLGFDETLFAFERTLRNLKLDYLDLYLIHWPVAGKYRDSWRAMERLHDEKLIKSIGVANFKQHHLSDLLVAANEKPVLNQVETHPLLPQNDLRKYLAEQNIAHAAWSPLAKGILMQNPVITEIAKKHQASVDQVILQWHLNRNTIIFPKSITSSRIEENSRLSYFQLDAIDMEKIDRLETGKRVGPDPDDLEYFLSSIERERAYLSGENAE

SEQ ID NO: 30773 - protein, 219 aa, Haemophilus influenzae
MNQLEMKKLAAQAALQYVKADRIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEIEKELNNVAGVVTNGIFALRGADVVIVGTPEGAKVID

SEQ ID NO: 30774 - protein, 346 aa, Synechococcus sp. WH 5701
MSQLLITGGAGFIGSHTCLVLLEAGHHLVVLDDFSNSSPEALRRVQELAGPVAAPRLQLIEGDLRSSGDLERAFAVAPIEAVVHFAGLKAVAESVADPLRYWDVNLSGSRALLAAMVQAGCRTIVFSSSATLYGSPESVPIAESARVAPVNPYGYSKAAVEQMLADVYASEPGWRVARLRYFNPVGAHPSGRIGEDPGGIPNNLFPFLSQVAVGRRPRLQVFGSDWPTADGTGVRDYIHVMDLADGHRAALEVLMAEPPQLLTLNLGSGRGHSVLELLAAFERACGSPVPYDLVPRRPGDVAATVADPSLAQRRLAWRTQRDLDAICRDGWAWQSANPKGYGPRGD

SEQ ID NO: 30775 - protein, 1003 aa, Closterium ehrenbergii
MAAPQPNAIVHLLVVVILSGVLFSGSNVEAKTTKDEIVALEAVKGALRPLTLFASWKGDPCDGAWMGVTCDDNKPQHVVGLKLASLGVTGSISTAIGALTALQWLNLEKNSISGPLPKEVGALGSLLHLELESNRISGPVPKSIKNLNLLTHVDISKNLFTGTAPVFSPTAPLQYLSYSINDFVGPFPESTLSHSSLRLLSIGANGFFGPLPTDFSSLQFLTRLVLGQNDFSGPLPDSLGHLPRIRALDISNNNFSGPIPASYSNIRRLKIKGNKYLVLAPASASAPAPSAEAPASASASAPDSASASAPASASASAPASESAPAPASSSSFSPSSLPAPKSKRAPHSKPAPKSKRAPTSRPLPKHSPPKPSYPPPSKPTPKPSPSKPSPKAPASAPASAPGSAPGAVRVCDTCTPTQLAWSSSADGGGSCLCVYPLRFALRMSMNYSNFDEHAQTDLEMQLANIFAVNKGQVRLLAAQPGSVIASMALGPDSPATTLQPGTVERVTAILKGTSNTQLSLVGFGFIEVLTVEAPAEMLRPPPTQAPGPDGSLGNMESGSPWGTGAIIGVTVGAVAVVALLVLIIVLWRCLPKRKRVSSASPANATKAAAVAAAAAAASNKKKEAARQQLQSWSAGTPSRGPGGSTPLHVPAGSKSPSTRRVPGVVVLSLPELQMATDTFAAERSIGSDPLGTTFIGTLPSGQEIAVKRVEPSVVEGQSDDDFMAVAATMARLKHPNVVQLQGYCIDYGERILVFEHYPNGSLFDHLHHRNHDATKDHGQKLTWQTRIEIAVATARALVYLHEECVPSIIHRNISSRNILLDKRLRARVAGAGLSFLNPVGADEKSMSDQLVGGFAYNAPEYAMSGIYTAKSDVYSYGVVLLELLTGRKPVDPSKPKPESSLVRWAAPLLHDVAELEAILDQKICGPLPDTAKLTTYAEIITRCIQPEPEFRPTMSKIVNDLTRKVLQPSGSRKNGGLPPPSAGALVPTGPGSSAASDTSSMRM

SEQ ID NO: 30776 - protein, 417 aa, Sinorhizobium meliloti 1021
MRDHIQKMQGEEQFSCGVVIVAAGRGERAGQSAEGPKQYRTIGDRPVIAHTLDIFATWPGAGPVVVVIHPDDEELFAAARKRMAGALELTVVHGGATRQLSVLAGLEAVAATGVEYVMIHDAVRPFFDHTLLDRCGAALRDGAQALLPAIAVADTLKRTKAAGLVAETVPRTDLYAAQTPQCFRLEPILSAHRRAAASGRSDFTDDASIAEWAGIPVLLVEGAVDNFKLTLRRDLSMADEKLTRMAIPDVRTGNGYDVHQLVDGDGVTLCGVFIPHGRKLSGHSDADVALHALTDALLATCGAGDIGDHFPPSDPQWKGAPSRIFLEHAARIVRERGGTVTNADISLIAEAPKVGPHRQQMRENLAAILGISLDRCSIKATTNEKLGFVGRNEGIAAIATATVVYASRSKPDVDDRY

SEQ ID NO: 30777 - protein, 494 aa, Synechococcus sp. WH 5701
MSPAASLVPVILCGGTGTRLWPLSRASYPKQYWPLAGSGEETLLQQTQLRLKGLNQLGAPLLICNEDHRFIVAEQMRQIGVEPGAILLEPLGRNTAPAIAVAALHATSRGDDPLLLVLAADHVIQDGARFRATVEAGRAAAEGGLLVTFGIVPTAPETGYGYIEAVEPLPQATPGLGEPPIPTPTPIARFVEKPDAATAEEFLSSGRFTWNSGMFLFRASAILAELERLAPEVVSCCRAAIDHDSADLDFLRLERESFANCPNVAIDVAVMERTGLGAVLPLEAGWSDVGSWSALWDTGARDSDGNVLRGRVISEGSRNCYLRSEHRLVVGLGVEDLVVVETDDAVLVAHRDRAQEVKTIVNRLASSGSPEGKAHRRIYRPWGSYDGIVEGSRWQVKKIVVNPGASLSLQMHHHRAEHWVVVQGTAVVEKDSVEELVGENQSTYIPLGAKHRLSNPGKIPVEMIEVQSGPYLGEDDIVRFDDRYGRSDMSLPVR

SEQ ID NO: 30778 - protein, 322 aa, Sinorhizobium meliloti 1021
MKAVVMKEVGGTDVMEFVDRPEPVARPAHVVVEVAAAGVNFMDIGVRQGMAWTDIPNPKVLGVEGAGRVLAVGDGTGEFAVGDRVAWVYAPGSYAQRQSIPAASLVKIPDTVDDRTAASTMMQGLTASHFATDFYPVQPGDIALVHAAAGGVGLLLTQIIRLRGGRVIGRVSSEDKVAIARKAGAEHVIVDTDGRFADEVLRLTGGEGVNVVYDGSGPKTFKGSIEALRRSGTFCWYGPVLGGPGPLEIMNLPKSIKIGYATFMDHIHTRELLLDRTKQLFDWIEDGSITVTIGETYRLADAAGAHAAMASRATTGKLLLIP

SEQ ID NO: 30779 - protein, 535 aa, Oryza sativa Japonica Group
MGMEVAAARLGPLYTTSDYASVVSINLFVALLCACIVLGHLLEENRWVNESITALIIGLCTGVVILLMTKGKSSHLFVFSEDLFFIYLLPPIIFNAGFQVKKKQFFRNFMTITLFGAVGTMISFFTISIAAIAIFSRMNIGTLDVGDFLAIRAIFPATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKRTWRQQVVIWWAGLMRGAVSIALAYNKFTRSGHTQLHGNAIMITSTITVVLWSTMVFGMMTKPLIRLLLPASGHPVTSEPSSPKSLHSPLLTRMQGSDLESTTNIVRPSSLRMLLTKPTHTVHYYWRKFDDALMRPMFGGRGFVPFSPGSPTEQSHGGR

SEQ ID NO: 30780 - protein, 759 aa, Porphyromonas gingivalis W83
MNSKLEEQARAYHAEGKPGKLEIRPTKPHSTQHDLTLAYSPGVAVPCKDIEQDPAFAYKYTAKGNLVAVISNGTAVLGLGDIGALAGKPVMEGKGLLFKIYAGIHVFDIEIDETDPKRFIEVVKAIAPTFGGINLEDIKAPECFEIEETLKRELDIPVMHDDQHGTAIISSAGLINALMIAGKKIEDVRIVVNGAGASAFSCTKLYESFGARRENILMLDSKGVITADRTDLTEQKRYFATERTDVHTLAEAIAGADVFVGLSRPNVLTQDMVRTMAPNPIVFALANPNPEITYEQATAAREDIIMATGRSDYPNQINNVIGFPYIFRGALDVSAKAINEEMKRAATMAIADLARETVPDEVLRAYGNTQLHFGKDYFIPKPVDPRLIVRVSTAVARAAVESGVAEHPIADWAAYEAELLGRVGLMSHLTRRLHESAKLNPHRVIYAACENPSVLKAAVSARAHGIARPIMLGDEKQIRDFAAELDLSLEGIEIVNYRSDEEKARRHHYARVFAEQNWRRGGNHTEALDKMFDPNYFGMMMVRLGDADAMITGIYSKHSYLAEVAKQTVGLQEGVGHFATMHMVSLKNGPLFLADTLINHNLSAEALVDIAVMAYEKAHCFGVKPVLAIVGFSDFGADSDADSTVEAAKAVAILHEKYPYILVDGEMRVSLALHAEKRDKQYPQNKIKGRNANVLIFPRLSAANACYQLLREADDAEEVLGPIQIGLAKPVYFADHDATVSDILNITAMAVLDSHACLI

SEQ ID NO: 30781 - protein, 247 aa, Physcomitrella patens subsp. patens
DGEFCRSTLEEVKFLQKQRERSNGVVANQLGQPAGGANSNVAEKGEGEGENEEQVLQDTFAQETAVTIEDPNMLKYIEQEMAKKRGRETSEVGEEVKPPEVDLYVIPEHLKVRKRNGEESSTQWTTGIAEVQLPVEYKLKNIEETEAAKKQLQGKRPFVGRGRSQSSIPASYNADYFQRGREYAEKLRSDHPEGYRDKGRGEGRGRGRGGPTGSKSETYDVRNRRQAATDEIMLERFRKRERRLLRR

SEQ ID NO: 30782 - protein, 159 aa, Methanocaldococcus jannaschii DSM 2661
MISKNVRIAKGAVIVGDVTIGDYSSVWYNAVIRGDVDKIIIGNYSNIQDCCVVHCSKGYPTIIGDYVSIGHGAVIHGCRIEDNVLVGMNATILNGAKIGENCIIGANALVTQNKEIPPNSLVLGVPGRVVRELTEEEIKSIKENALRYVKLSETLESYK

SEQ ID NO: 30783 - protein, 594 aa, Gibberella zeae PH-1
MTVVTLPEPFASIPRENFLFGASPLQPLPRISAALGGKVNVYAKREDCNSGLAYGGNKVRKLEYLAAEAQAEGCDTLVSIGGVQSNHTRAVTAVASKLGLKAATVQEHWVDWEDPGYEKVGNIQLSRLMGGDVRLDPSTFGIEHKTTLAKLKDELKSNGQKPYYIPAGASDHPLGGLGFARWAFEVEAQEKELGIFFDTVIVCAVTGSTFAGMIAGFKLAQKKNGSPARKIIGIDASGKVQQTFDQVLRIAKNTAAKIGLSEDDITADDVILDPNYNAKVYGIPDETTLEAMRFGAATEAFITDPVYEGKSLAGMMDLIKTGKIAGGNVLYAHLGGQLALNAYSKFFNLSSKHHQLPQYAHDYLIQDSYVIQSSPDTLENTTLGDLFSGQKSPKQQIDWAIDEPQEIFVHEKLAAVWTGWSIRADDGSIISHKKGLVGLAFTQGRWKVSGLASTERSIDIPNPKDETHLEQDIMKPINALLNDFSHPDWDTLKEWFLPDAGVTLYRPPSEPAPMTLEQSIRRLQNMIKSGITMQEKLHHAQVRKHGDLALVWAPFVVEINGQAMHHGVNAFTLFKKSDKWCFGGCQDYGVPISG

SEQ ID NO: 30784 - protein, 500 aa, Amaranthus hypochondriacus
MAIRVPSRQLFIDGEWREPIKKNRIPIINPSTEEIIGVIPAATAEDVELAVAAARRALKRNKGEDWASASGAHRAKYLRAIAAKITEKKDYFAKLEAMDCGKPLDEAAWDIDDVAGCFEYYADQAEALDAKQKAPIALPMDTFKCHVLKQPIGVVGLISPWNYPLLMATWKVAPALAAGCSAVLKPSELASVTCLELAEVCREVGLPPGVLNILTGLGPEAGGPLACHPDVDKVAFTGSTATGSKVMSSAAQLVKPVTLELGGKSPIVIFEDVDLDKAAEWTAFGCFWTNGQICSATSRLLVHESIAAEFLDRLVKWCKNIKISDPFEEGCRLGPVVSKSQYEKVLKFISTAKSEGATILCGGSRPEHLKKGYYVEPTIISDVSTSMQIWREEVFGPVLCVKTFGSEDEAIELANDTQYGLGAAVLSKDLDRCERITKALQAGIVWVNCSQPCFCQAPWGGTKRSGFGRELGEWGIENYLNIKQVTEYISDEPWGWYKSP

SEQ ID NO: 30785 - protein, 277 aa, Oryza sativa Japonica Group
MHRARLLVVVVTAVVTLLLLAPAAGAEEDDQFGYIPGTPRGPENWGSLKPEWATCSSGEMQSPINLGLLDLTLAPGLGDLNYTYRNANATVVNRGHDIMVRFDGGDDAAAAGGLVINGTAYRLRQVHWHAPSEHAVDGRRYDMELHMVHLNTQNQTAVVGILYAIGAQDEFLHKLEPYIIEVADQKDKEKIVNGGVDPNVAKEHDIVYYRYMGSLTTPPCTEGVIWTIVRKVHTVSLSQLALLKAAVVNGNEKNARPLQDVNNRNIGLFIPLPLINV

SEQ ID NO: 30786 - protein, 347 aa, Mycobacterium sp. JLS
MVTPTPNRRVVVSSLDDVVVETETADTPRPGEVRVGTSLVGICGSDLHAACGRHPFIDLPYRPGHEAVGVVDAVGAGVDESWLGTRVTIEPNLACGHCTQCRAGRYNICRELLVFGCQTAGALADSFTIPVDRVVALPDELDDRHAILIEPLATPVHTVRRAAGLVGDLRDRAVVVIGAGPIGLFTLLAARHAGARVVVADLLESKRARAERLGAVGSFDPTGDDAVATAQRLLGGPAAVVVDCVSRESTVALAVDLVDKGGAVMIVGVAEGSTPVPLGLIQDRELALVGNLMYVREDFTAAMDLLASGIVPVDEIISADFDLDHAAQAFSASADPENVKVLVTVGS

SEQ ID NO: 30787 - protein, 438 aa, Fulvimarina pelagi HTCC2506
MAQMRAFQSAREKGAEIPEVVCFEKQSDWGGLWNYSWRTGLDEYGDPVHGSMYRYLWSNGPKECLEFADYTFEQHFGRPIASYPPRAVLFDYIKGRVEKAGVKDWVRFGTAVRMVRYQKDRKMFEVTVHDRPNDRMYTEEFDHVVVATGHFSTPNVPEFKGFATFNGRILHAHDFRDAREFTNKDVLIIGRSYSAEDIGSQCWKYGAKSITSSYRSKPMGFHFPDNWEEKPLLTEVDGNTAKFKDGTTKHIDAIILCTGYLHHYPFLEDDLRLRSENRLWPLNLWKGVVWETNPQLFYIGAQDQFYTFNMFDAQAWFARDVMMGRVSLPSADAMREDSLSWRKREESLETDEDMIVFQGENVKELINTTDYPPFDVDGVNRTFLEWEHHKHENIMGYRNLGFKSLMTGTLAPAHHTPWAEALDDSLESYLQTVREAAE

SEQ ID NO: 30788 - protein, 255 aa, Mycobacterium sp. JLS
MTQKNPFDLTGRTALVTGGNQGLGRAFAFGLAQAGATVAISGRSAERNAKVVEEAAAEGFALHPITADITRQDDVDRMTAEAISALGHLDILVNNAGTCYHAESWDVTEEQWDSVFDLNVKALWACSLAAGAHMRERGSGSIVNIGSMSGLIVNRPQMQPAYNASKAAVHHLTKSLAAEWGPLGIRVNALAPGYCKTEMAPVDKPEFKQHWIDDTPMLRYAMPEEIAPSVVFLASDAASFITGSVLVADGGYTAW

SEQ ID NO: 30789 - protein, 385 aa, Saccharomyces cerevisiae
  misc_feature (1)..(1): Xaa can be any naturally occurring amino acid
  misc_feature (201)..(201): Xaa can be any naturally occurring amino acid
  misc_feature (219)..(219): Xaa can be any naturally occurring amino acid
  misc_feature (245)..(245): Xaa can be any naturally occurring amino acid
  misc_feature (289)..(289): Xaa can be any naturally occurring amino acid
  misc_feature (313)..(313): Xaa can be any naturally occurring amino acid
  misc_feature (358)..(358): Xaa can be any naturally occurring amino acid
  misc_feature (370)..(370): Xaa can be any naturally occurring amino acid
XTKSVDTLLIPGPIILSGAVQKALDVPSLGHTSPEFVSIFQRVLKNTRAVFKSAAASKSQPFVLAGSGTLGWDIFASNFILSKAPNKNVLVVSTGTFSDRFADCLRSYGAQVDVVRPLKIGESVPLELITEKLSQNSYGAVTVTHVDTSTAVLSDLKAISQAIKQTSPETFFVVDAVCSIGCEEFEFDEWGVDFALTASQXAIGAPAGLSISLCSSRFXDYALNDSKNGHVHGYFSSLRRWTPIXENYEAGKGAYFATPPVQLINSLDVALKEILEEGLHKRWDLHREXSDWFKDSLVNGLQLTSVSRYPSNXSAHGLTAVYVADPPDVIAFLKSHGVVIAGGIHKDIGPKYIRIGHXGVTACNKNLPYXKNCFDLIKLALQRKK

SEQ ID NO: 30790 - protein, 58 aa, Zea mays
MKICDYDNLVEDLSRDFEYETHPLYLLYRNAAQEVNGIWFDNQHYCEAVTSLFGRCRM

SEQ ID NO: 30791 - protein, 438 aa, Haloquadratum walsbyi
MRFTPSSFSPRGSVKVIMSLELSAAAPAIPPEATDGVWLADIETGETYAPFEEIRYTSDEDNLLEVRYADLPTFEDFQGQGRGVWRYHAALPFENGVSLPEGDTPLHRAPSIRDAAGVRSLRIKHEGMNPTGSFKDRGMTVGVRVAKELGVGRLACASTGNTSAALAAYGARGGMQTLVLLPAGKVAAGKIAQAALHDARILEVDGNFDDCLDIVQDLARRGEVYLLNSLNPFRLEGQKTIGLEILERFYEEYGRFPDRIILPVGNAGNTSALYKAFRELVQSGALRPSEVPKLTGVQAAGAAPMVEAVEHGWSDIERWDDVETRATAIRIGNPVNAPKALPGIRETGGTAIAVTDDEITVAQRDLAREGIGVEPASAASVAGLKKLRGRSRIDSDEDVVCLTTGHLLKDPDEAFKAGGNPEPVGGDTDAVLEHIGAN

SEQ ID NO: 30792 - protein, 396 aa, Debaryomyces hansenii CBS767
MAPKKKVVQEKPILLGRPGNNLKSGIVGLANVGKSTFFQAITRCPLGNPANYPFATIEPEEARVIVPSSRFNKLVDIYKPKSEVPAYMTIYDIAGLTKGAHAGEGLGNNFLANIRAVDAIFQVVRCFEDADIIHINDEVNPAADLEIVHDELRLKDIEFATKHLEGIDKITKRGGQSLEVKQKKEEAELVKKIIQLLEDGGRVANQKWTTKEVEIINSMFLLTAKPTIYLVNLSERDYVRKKNKHLLKIKEWVDAHSPGDLIVPISVSLEEKLAGMETDDERDAYCKELGAQSALPKIIVSMRQKLDLISFFTGGPDEVREWTIRRWYTAPQAAGTIHTDLERTFILAQVIKYDDLIEYGDEKSVQAAGKLMQKGKDYFVEDGDIIFVKAADGKAR

SEQ ID NO: 30793 - protein, 274 aa, Saccharomyces cerevisiae
MVAPTALKKATVTPVSGQDGGSSRIIGINNTESIDEDDDDDVLLDDSDNNTAKEEVEGEEGSRKTHESKTVVVDDQGKPRFTSASKTQGNKIKFESRKIMVPPHRMTPLRNSWTKIYPPLVEHLKLQVRMNLKTKSVELRTNPKFTTDPGALQKGADFIKAFTLGFDLDDSIALLRLDDLYIETFEVKDVKTLTGDHLSRAIGRIAGKDGKTKFAIENATRTRIVLADSKIHILGGFTHIRMARESVVSLILGSPPGKVYGNLRTVASRLKERY

SEQ ID NO: 30794 - protein, 283 aa, Pseudomonas fluorescens Pf-5
MTDSARLLNKHSFVELGARQRARALLDAGSFRELLDPFQRVMSPWLERQGVVPQADDGVVIAKGSIAGSPVVIAAIEGAFQGGSLGEVGGAKIAGALELAAEDNRNGIPTRAVLLLETGGVRLQEANLGLAAIADIHAAIVDLRQYQPVVGVVAGSVGCFGGMSIAAGLCSYLLVTQEARLGLNGPQVIEQEAGLEEYDSRDRPFIWSLTGGEQRFASGLVDRYVADDVALIQAQVRELLALGLPSRQRSREAELYLQRLSRLDTTPQIDAATVRDLYQGDRP

SEQ ID NO: 30795 - protein, 424 aa, Closterium ehrenbergii
MGNCLGGGGGGGGGGGGGPDVKSADATVPDNASKPANNGYEAPVPPPPEPAKKDPSPPPAPPAQDNALMGLDIPRPGVATFELRTFKYKELQKATQQFKEPENVLGEGGFGKVYKGFLKDWEGSKDPFPIAVKKLNPNSFQGQQEWLAEILLLSRIRHPNLVKLLGYCAENGEGMLVYEFLGKGSLDYHLFPEPKEDEPVPAQPLPWEVRLRIALDAAAGLAYLHENNVIHRDFKAPNILLDDDWSAKLTDFGLAKGADTDQTHVTTRIMGTMGYLDPKYMETGQLTKKSDVYAFGVMLLELLTGKRAMDQTQQGMPPLTAWAQQYLNQRKPDIGALVDPCLLDQFTTKAAQRAAHKLAISAKHCIEEDPNLRPLMSDMVETLRPLVAAAAEQSAAAAAAAAAAASAAAVTAEAPASQGMGCMV

SEQ ID NO: 30796 - protein, 445 aa, Synechococcus sp. WH 5701
MTFPTLLLEIGNHNGEVAETLIGVGRFLLIFLAARTLAELMVRLQLPTILGELVAGVLIGLSGLHLILPPETGAELSNWFTSAVGSLADLPPDAVQAIYIETFPNLQAVATLGLFALLFLTGLESELDELVAVGAQATTVAVTGVALPFALGTFGLLYFFDVPMIPAVFAGAAMTATSIGITASVFGELKYLKTREGQTVIGAAVLDDILGIVILAVVVAVAGGGSFELGPIVKLLLAAAVFVSASLFLSRTAAPAFDWLLDRLKAPGEVVVASFVVLCVCCFAAQAIGLEAALGAFAAGLILSGSRHTHAIQETVKPLVSLFATIFFVLIGTSMDLSVLNPMDPANRPGLVMAAFLLVVAIIGKVASGWTYVSKEKTNRLVVGLGMMPRGEVGLIFLGLGTQAGLLTPALEAAILLMVIGTTFLSPILLRVVLSRQEKLAEQPA

SEQ ID NO: 30797 - protein, 457 aa, Sinorhizobium meliloti 1021
MNKHFDAVIIGAGQAGPSLAGRLSGVGKTVALIERKLFGGTCVNTGCMPTKAMVASAYAIHTARRGAEYGMTTGPVSVDFGRVMARKEKVRLDARSGVEKWLKGMKNCTVFEGHARFEGPREVRIGDELISGERIFVNVGGRAAVADLPGVNDVPYLTNSSIMDLAELPEHLVVVGGSYIGLEFAQMFRRFGSDVTVIEKGARLIGREDPEVSDAIREILENEGVRIRTNAECIRFSNHADSVAVGVDCTSGEPEVSGSHVLLATGRHPNTDDLGLDKAGVKTDERGYIEVDDSLRTNVPHIFAMGDCNGRGAFTHTSYNDFEIVAANLIDNDPRRVSDRIQTYALYIDPPLGRAGMTETEARKKGHKLLVGTRPMTRVGRAVEKGETQGFMKVIVDAETDEILGASILGTGGDEAVQSILDVMYAKKPYTMIARAVHIHPTVSELIPTVFGDLSSA

SEQ ID NO: 30798 - protein, 1511 aa, Saccharomyces cerevisiae
MPEAKLNNNVNDVTSYSSASSSTENAADLHNYNGFDEHTEARIQKLARTLTAQSMQNSTQSAPNKSDAQSIFSSGVEGVNPIFSDPEAPGYDPKLDPNSENFSSAAWVKNMAHLSAADPDFYKPYSLGCAWKNLSASGASADVAYQSTVVNIPYKILKSGLRKFQRSKETNTFQILKPMDGCLNPGELLVVLGRPGSGCTTLLKSISSNTHGFDLGADTKISYSGYSGDDIKKHFRGEVVYNAEADVHLPHLTVFETLVTVARLKTPQNRIKGVDRESYANHLAEVAMATYGLSHTRNTKVGNDIVRGVSGGERKRVSIAEVSICGSKFQCWDNATRGLDSATALEFIRALKTQADISNTSATVAIYQCSQDAYDLFNKVCVLDDGYQIYYGPADKAKKYFEDMGYVCPSRQTTADFLTSVTSPSERTLNKDMLKKGIHIPQTPKEMNDYWVKSPNYKELMKEVDQRLLNDDEASREAIKEAHIAKQSKRARPSSPYTVSYMMQVKYLLIRNMWRLRNNIGFTLFMILGNCSMALILGSMFFKIMKKGDTSTFYFRGSAMFFAILFNAFSSLLEIFSLYEARPITEKHRTYSLYHPSADAFASVLSEIPSKLIIAVCFNIIFYFLVDFRRNGGVFFFYLLINIVAVFSMSHLFRCVGSLTKTLSEAMVPASMLLLALSMYTGFAIPKKKILRWSKWIWYINPLAYLFESLLINEFHGIKFPCAEYVPRGPAYANISSTESVCTVVGAVPGQDYVLGDDFIRGTYQYYHKDKWRGFGIGMAYVVFFFFVYLFLCEYNEGAKQKGEILVFPRSIVKRMKKRGVLTEKNANDPENVGERSDLSSDRKMLQESSEEESDTYGEIGLSKSEAIFHWRNLCYEVQIKAETRRILNNVDGWVKPGTLTALMGASGAGKTTLLDCLAERVTMGVITGDILVNGIPRDKSFPRSIGYCQQQDLHLKTATVRESLRFSAYLRQPAEVSIEEKNRYVEEVIKILEMEKYADAVVGVAGEGLNVEQRKRLTIGVELTAKPKLLVFLDEPTSGLDSQTAWSICQLMKKLANHGQAILCTIHQPSAILMQEFDRLLFMQRGGKTVYFGDLGEGCKTMIDYFESHGAHKCPADANPAEWMLEVVGAAPGSHANQDYYEVWRNSEEYRAVQSELDWMERELPKKGSITAAEDKHEFSQSIIYQTKLVSIRLFQQYWRSPDYLWSKFILTIFNQLFIGFTFFKAGTSLQGLQNQMLAVFMFTVIFNPILQQYLPSFVQQRDLYEARERPSRTFSWISFIFAQIFVEVPWNILAGTIAYFIYYYPIGFYSNASAAGQLHERGALFWLFSCAFYVYVGSMGLLVISFNQVAESAANLASLLFTMSLSFCGVMTTPSAMPRFWIFMYRVSPLTYFIQALLAVGVANVDVKCADYELLEFTPPSGMTCGQYMEPYLQLAKTGYLTDENATDTCSFCQISTTNDYLANVNSFYSERWRNYGIFICYIAFNYIAGVFFYWLARVPKKNGKLSKK

SEQ ID NO: 30799 - protein, 549 aa, Ostreococcus tauri
MDNIENLRGTAVLDSPSLNKGTGFTFTQRERLGLRGLLPRKYESPEIQVSRAWHQLCAFEEDINRYVYLENLHMQNERLFYRVLVEHLEDLMPIVYTPTVGDAVVNFDSLYRNRCGMYFSRLDSGVMRTMLDNWPSSDVEIIVVTDGGRVLGLGDWGTNGMAISVGKVSLYCASGGFDPAKAMPVCLDLGTNNTALTEHEYYLGSNESRLTGDAHLAVVTEFCLAVKDKFPNCLIQFEDFKTEDAFRILEHLRRKVLCFNDDIQGTGATILAGLINALRAQGTSTRDCRIIFFGAGSSAIGVATQIMQLLISEGLSETQAKHAIWLMDSKGLITDTREDYDNLSSQKRKFAQHGEEPCPDLGELIQRVKPHALFGLSGFGPVFTREHIELMCEHIGKPIVFPLSNPTSKAEITAQDAYTWSKGKCLFAAGSPFAPVTIEGNTYVPGQGNNMFIFPGVGFGAVSVRAEYIPDSFFLCAARALATIVPEDEVRAGKIYPSVSAIRAISKTVAVAVAEHAYEVGVAQLYPKPGDMDAFITERMWYPMNDGAV

SEQ ID NO: 30800 - protein, 676 aa, Ostreococcus tauri
MSASSSAKTRDEDDRVGAEDVDDEEGGGNVGDAGGDDDGGDDDNYEDKEEEEGDDDDDDDDDDGTRASNTAHVGAANCEGDDCSDSLNEQVYAVMEDVATKTALDTQTSVDDILALATGTSDQSPRTMQEEAMDERVAAFSMTVMICILLLTIVLGVVLKHYKSKWLHSSGAALLLGIAVGCFVFLTLEASYDTMPANMRYGIKAFASSMRFDTKFFFLVLLPPLVFEAGYTLHPTTFFNNADAVSMFAFVGSLSSAITTGVMMYVAGLTGLSYKFSLKSAMLFGALISSTDPVTTLSIFSSTPVSQDLHAIIMGESIMNDAITIVLFESLLLGASATDTMTVVDMLQQDASFLPLILEAIGTFMLAFSQATLVGVGIGCFSALLHKYVRTTNDFEEGWVVDSALVLLLPYLSYSLAESFELSGIVAVLFTGIVMGRYTRPNLARAPRMVTMCVFKIFSFLSETFVFVYMGSAMYSFRSAHIVTAIVGLLVTYISRAANIFPGSFLLNVTSARKNPAHSITPRMQIILWFSGLRGAVAFALAEKARRDLGEQGHVMFDVTLFIVAFTIVIQGGMTTWLLNKLSEPATTTSDPSNPEKRVLSNISRLISSVETNIIEPILSRTPAVNSSERTSLLHGDYAGGREEAAEPPLSGHSVGLASESVEAAVDGTFTQRGDL

SEQ ID NO: 30801 - protein, 420 aa, Streptomyces anulatus
MTITPPALSVFETLESEVRSYCRGWPAVFDRAQGARLTDEDGHSYLDFFAGAGSLNYGHNNPVLKRALIDYIERDGITHGLDMATTAKRAFLETFQNVILRPRDLPYKVMFPGPTGTNAVESALKLARKVKGRESVVSFTNAFHGMSLGSLAVTGNAFKRAGAGIPLVHGTPMPFDNYFDGTVPDFLWFERLLEDQGSGLNKPAAVIVETVQGEGGINVARAEWLRALQELCLRQVMLLIVDDIQMGCGRTGGFFSFEEAGIVPDIVTLSKSISGYGLPMSLCLFKPELDIWEPGEHNGTFRGNNPAFVTAAAVLDAYWADGQMEKQTLARGEQVEQTLLAICAEEPTAQFRGRGLVWGMEFEDKARASAVCARAFELGLLLETSGPQSEVVKLLPPLTITPEELDEGLRTLARCVRETA

SEQ ID NO: 30802 - protein, 798 aa, Candida albicans SC5314
MVDESKQLQGNKDGDKHQTQESTNTSGNSEPSAPTPAQVPSVQQQQQQQKSSTQNQQSTTGSARSSQGRSNQPQYSQADLNRIVLEYLNKKGYHRTEAQLRLESSNIPTPAVPLATPATTELASVNEIGDNKDLKEKLTKAEQELKELRDKQSKIEKELREAKDREVKISKEKELKQLKELEKKTKRESDPEIYFTAYSMLRRWVGSSLDLYKPELSRVLYPLYIHCFLELISKGFSSEAKLFFDKFRSDHLVLHGIEVEKFAGLSLPEHLEENDLAVAYRKYKYRILVSKTSLNLLIYFLHENEAVGGGILIRIINQYLDPVISTNRPDKIDQEGEANPEEGISEYVTDTNEVKKFNEQNVKLGKLPIDPDVAKEVEAELKIKDEKIEPVNNKTLTKEFQDMTKPDQDSPVRESLPLPLKDANDIKKMIIQVEDSRSKIKLGAIQASLPSVCMYTFHNTNNNMTCIEFNDDSTLVAAGFQDSYIKLWSLDGKPLKSVLKRDRHKPQENTRKLIGHSGPVYGVSFSPDNKYLLSCSEDKTVRLWSLDTYTALVSYKGHTQPVWDVKFSPLGHYFVTASHDQTARLWATDHIYPLRIFAGHINDVDCVEFHPNSNYVFTGSSDKTCRMWDVHTGNCVRVFLGHTNSVNCLAVSPDGRWLASGGEDGIICVWDIGSGRRLKSMRGHARASLYSLAFSRDGTVLVSGCADNSVRVWDVKKNTNDAGPEPEAFNNNVNGNETNSDGTSSTQQQQQPQQQQQSKKESIATSDHMNAFFTKKTPVYKVQFTRRNLCLAAGAFQG

SEQ ID NO: 30803 - protein, 416 aa, Virgibacillus pantothenticus
MQIFEELESAVRSYSRGWPTIFEKAKGYKLWDIDGNMYIDFFAGAGALNYGHNHDTMQEKLIAYIQDDHIIHSLDMGTTPRKTFLETFHNTILKPRNLDYKIMFPGPTGTNTVESALKIARKVTGRDTVISFTNAFHGMTIGSLSVTGNSFKRHGAGVPLHHSVSMPYDKYVNDQDSIAYLERFLEDSGSGVALPAAIILETVQGEGGINAASIEWLQKIASICERWDILLIIDDVQAGCGRTGTFFSFEPAGIAPDIVCLSKSIGGIGLPMAITLIKPEYDQWGPGEHNGTFRGNNLAFIAATEALTAFWQDNTFSKSIIQKSKLVRQRIDRIIDKFPSLQGEARGRGLMQGIVIPEPNCASEICKAAFDIGLIVETSGPNDEVVKFLPPLIIDKEGINQGFDILEVSMEHVLKK

SEQ ID NO: 30804 - protein, 461 aa, Synechococcus sp. WH 5701
MSSLPSPASADPLTEPQLSWQQRKLDLLSQGVSYALASFVDLHGTSKAKAVPLDHFEAMLAGSELFTGAALDGVPQDVSDDEVAAIPDLATATVLPWRRDVVWLASSLHLHGQPFEACSRNILIRALDEAQRMGFRFNLGIETEFFVLRRGADGALRPASSRDTLEKPCYDLTGLLDNLPWLDELVQAMNDLGWGVYSFDHEDGNGQFETDFAYAEALTMADRLTFFRLMLKEITHRHGLIASFMPKPFSDRTGSGAHFNMSLADPATGRNLFAGDTPGAITPLAEQFIAGILRHAPAICAVIAPTVNSYKRLVAQGSMSGFTWAPVFICYGNNNRTNMLRIPSAGGRVECRAADSACNPYLGAAMILAAGLEGIREELDPGDPNLVNAYRLSAEQRAERGLRVLPRTLGDAIEAFAADPLSRSVFGDAMADAFIDYKRAEWAEYHGCVSDWELTRYLEFL

SEQ ID NO: 30805 - protein, 181 aa, Glycine max
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIANKA

SEQ ID NO: 30806 - protein, 411 aa, Triticum aestivum
  misc_feature (184)..(184): Xaa can be any naturally occurring amino acid
  misc_feature (343)..(343): Xaa can be any naturally occurring amino acid
  misc_feature (349)..(349): Xaa can be any naturally occurring amino acid
  misc_feature (358)..(358): Xaa can be any naturally occurring amino acid
  misc_feature (367)..(367): Xaa can be any naturally occurring amino acid
  misc_feature (378)..(378): Xaa can be any naturally occurring amino acid
  misc_feature (403)..(403): Xaa can be any naturally occurring amino acid
WKGGSAGEILLLGIRYTVHNRARDFRKTRVFTFPPPVHPPESNGIFLPPLHYYSRCREGADSSAVYCVSFSSSVFFLSHPRLRRAPATDRRGMAATATKLSSGHEMPAVGLGVWRMDSAAVRGLIHSALRAGYRHFDCAADYKNEAEVGDALAEAFKTGLVKREDLFITTKLWNSDHGHVVEAXCKDSLKKLRLDYLDLYLIHFPVATKHTGVGTTGSALGDDGVLDIDTTITLETTWHAMEDLVSMGLVRSIGISNYDIFLTRDCLAYAKIKPAVNQIETHPYFQRDSLVKFCQKHGISVTAHTPLGGSTANTEWFGSVSCLDDPVIKSLAEKYGNTPAQLXVLRWGXLQRNTVVIXPKTSKAEKXCRKNLAVVRLXTSPSEGHGKRSKAFDRNYRTNQPAXSGGIRHLP

SEQ ID NO: 30807 - protein, 339 aa, Physcomitrella patens subsp. patens
MPYARNAVSVKASSTSRNTLTRAELGDSLEEFLAKATTDKNLARLLVCMGEALRTIAFKVRTASCGATACVNTFGDEQLAVDMLADKLLFEALRHSHVCKYACSEEEPILQDMEGEGFSVAFDPLDGSSIVDTNFTVGTIFGVWPGDKLTGITGRDQAASAMGIYGPRTTYVVAINGFPGTHEFLLMDDGKWQHVKETTEIKEGKLFSPGNLRATFDNADYEKLINYYVSEKYTLRYTGGMVPDVNQIIVKERGIFTNVTSPTTKAKLRLLFEVAPLGLLIENAGGYSSDGKQSVLDKVVVNTDDRTQVAYGSRDEIIRFEETLYGDSRLKAELAAATV

SEQ ID NO: 30808 - protein, 900 aa, Oryza sativa Japonica Group
MAPMLLFAALMLASLSEAAADDGIGGQSGFVSIDCGREANYSDYKDPKTGIVYVSDEPYIDAGAGENHRISATATATAADSYLLQTLRSFPSGPRNCYALPTVAGTKYLVRLGFLYGNYDGENSSSSSASSLRFDLHLGAQRWATVDDVVVQTGGISRMYEVVFMGWARWAPACLVNVGGGTPFVSSVELRPIDDELYPSVKTSESLSLFKRSDMGADTTTLTRYPADEHDRIWKGTGNPGSTDISTQEKIQSENSFEVPLPVLQTAITTPGGNDTTLTVAWQDTRSSSEYMVFLHFADFQKIQPRQFNVTLNDIPIGSNGRSLMFSPSPLDSSSVYSSDGYRADDGNYNLVLRRTAASALPPMLNAMEIYTVITHDSPRTFHKDFDAIMDIKYEYGIKKNWMGDPCFPSEFIWDGIKCSTAGDDNTSRIISLDLSQSNLQGVVSINFTFLTALNYLNLSGNQLNGPVPDSLCKNIAGLYIFSYTSDGDICNNRTSSSRSTNRSTTILAISIVTPVLAVAILLAFLLWRAKGKHNGLTSFGISLISYNWFMQKPVSTFDPPRVPDPKKAPGSTTDHWSHLPINGSRQFTYEELKNFTLNFQRFIGQGGFGHVYYGCLEDGSEVAVKMRSESSLHGLDEFLAEVQSLTKVHHRNLVSLVGYCWEEHYLALVYEYMPSGSLCDHLRGKRDVGETLNWAKRVRIMLEAAQGLEYLHKGCNLPIIHGDVKTNNVLLGENLKAKLADFGLSKMYISDSQTHISVTAAGTVGYIDPEYYQTGRLTESSDVYSFGVVLLEVVTGELPILAGHGHIVQRVERKVTSGSIGLVADARLNDSYDISSMWKVVDTAMLCTTDVAIQRPTMSTVVLQLKECLALEEAREDRNRAGPTNDAVDVVSTFGPSAR

SEQ ID NO: 30809 - protein, 1311 aa, Bacillus anthracis str. Ames
MLDWMKKLFNKEEEQTAMNKEVPKQVESQPKIPRVNHHTEAREAQMASRNAGKCRFPLVPDNGFDEEDVIETGHFEEQPVQAVTYENEPIQRGIKVERSRRQYVEKVVSTYEEPEMQYEPEREPVVKKASTPAQESNRRPFRPTEMISPIYGYNRPSVEKKEEKQEEVKEREDLEISVEGKSVVDAWLEKKGYTLSDFSEGQAPTSSSHRAANEQGERQYEESKKEEKSVVDQWLEKNGYEIERQEPIVEEKEVVQEMSAPQEVPAAELLHETIAERMEGAKQESDVVDKNILQEELVDSKVEHEDTILSEEIKRSTEIEQPTIEVEKQAPEESVIVKAEEKLEETIVVEIPEEVEVIAEAEEPEEVEVIAETEESEEVEVIAETEESEEVEVIAETEELEEVEVTAETEELEEVEVVAETEELEEVEVIAETEKLEELEEVEVIAETEESEEVEVIAETEAPEEVEPVALEEMQQEMVLNEAIEQKNEFIHVAVADEQTKKDVQSFADVLIAEEQSVVEETPIVEEQPVAEEAPVVEEQSVVEETPIVEEAPVVEGQSVVEEAPIAEEQPVAEETSVVEEQPVAEETSIVEEQPVAEEAPVVEEQPVVQKEEPKREKKRHVPFNVVMLKQDRARLMERHASRTNGMQSSMSERVENKPVHQVEEQPQVEEKPMQQVVVEPQVEEKQMQQVVEPQVEEKPMQQVVVEPQVEEKPMQQVVVEPQVEEKPMQQVVVEPQVEEKPMQQVVVEPQVEEKPMQQVVVEPQVEEKPMQQVVVEPQVEEKPVQQVVEPQVEEVQPVQQVVAEQVQKPISSTEVEEKAYVVNQRENDVRNVLQTPPTYTIPSLTLLSIPQQAALDNTEWLEEQKELLDTTFNNFHVGAHVINVSQGPAVTRFEVQPDPGVKVNKITNLSDDIKLSLAAKDIRIEAPIPGKSAIGIEVPNKESKPVFLREILRSPVFTKSESPLTVALGLDISGDPIVTDIRKMPHGLIAGATGSGKSVCINAILTSILYKAKPHEVKLMLIDPKMVELAPYNSVPHLVAPVITDVKAATAALKWAVEEMERRYELFAHAGARDLTRYNTIVSGREIPGETLPYIVIVIDELADLMMVAPGDVEEAICRIAQKARACGIHLLVATQRPSVDVITGLIKSNIPTRIAFTVSSQVDSRTIIDIGGAEKLLGRGDMLFLGNGTSKPVRVQGVYVSDDEIEKTVDHVKKQMKPNYLFKQEDLLAKTEQAESEDELFLDACQFVVEQGGASTSSVQRKFRIGYNRAARLIEEMESQGIISEGRGTKPRDVLISEDEFAAMQETNV

SEQ ID NO: 30810 - protein, 400 aa, Glycine max
MQAAATTPLYQLVSFKPKLQTFPSKSQLCPLGTPFCRLGMASVSGFRLRPLRAVGGSSSSSASGDDGFVTLIEYVAKEGMNVKDDLVVLLDHIQYACKKIAALVASPFNYSLGKQTALGSVGSDRDAPKPLDIVSNEIILSSLRKSGRVAVMASEENDAPTWISDDGPYVVVTDPLDGSRNIDASIPTGTIFGIYKRLEELDDLPTEDKAMLNSLQSGSRLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVAMNPRDHLRLVYEANPLSFIVEQAGGRGSDGKNRILSLQPVKLHQRLPLFLGSLEDMEELESYGDIQQKVNPGYEV

SEQ ID NO: 30811 - protein, 447 aa, Closterium ehrenbergii
MGGCLTVEVVASEEDFPLPAKSPRQKPGGGGAAPLSPAKGVGAESKPIRREGDGKGGRGKGGRDPGGGNGKRGGGGADSPSHLREVSSSVSATTSSCGSTFSRMPVCVTSSAASASSSDGREREGTNGGLRRFRLSELRAATSSFSQNNFLGEGSFGQVFRGRLKHGGAGEGVEVAVKRLNPDSQQGMDEWLAEIVLLRKLNHPHLVNLMGYCSERKEALLVYELCDNGSLDDHLFPSDTSQVMDWNTRVRVAQGTAEALLYLHENRIIHRDLKPSNILLDKGMQARVTDFGMAKQCMGSATHVSTRVMGTLGYLDPEYMETGFLREKSDVYSFGVILLQLLTGREAASDTNQAALIDWMLPQLQISSSPSSQSLSTQPSPPSTSQPSSSPLRIDPSRWIDPVFEGRFSRSGAIVVAMIARQCVAEECDDRPDMADVVVAMKQVHCI

SEQ ID NO: 30812 - protein, 494 aa, Salmonella enterica subsp. enterica serovar Typhi str. CT18
MSDVTLLAEVTTFLRQRHGQFIAGERQAGNGTNFSVTNPATGKIIADVVSTTPAQAKEAMQSARRAFDVWRKMPTLQRGALLLKLADTLAAHREELAQLESVCSGKTIMLSRGLELDQSVAFLRYFAGWAGKITGETLNVSLPSMGEERYTAFTQRQPIGVVVGIVPWNFSIMIAIWKLAAALVCGCTIVIKPSEYTPLTLLRVAELAKEAGFPDGVINVVNGAGGEIAQQLIAHPDCAKVSFTGSVATGEKVRRSATSSGKRVTLELGGKNAALFLNDLTAQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLMHEETFGPVCSFIGYQNEKEALSHINDSPFGLAASVWSENISKALRYAEDIDAGMVWVNMHTFLDPAVPFGGMKGSGIGREFGSAFIDDYTELKSVMVRY

SEQ ID NO: 30813 - protein, 534 aa, Bordetella petrii
MAILSSRPGPGSPDFAANSAAYEALRAPLLAARERAIAGGGERARQAHLARGKLLPRERINTLLDAGTPFLEVGQLAADGAYDGQSPGAGIITGVGIVSGRACMIMANDATAKGGTYYPLTIKKQVRAQAIARENGLPCVYLVDSGGAFLPLQGDIFPDEQHFGKIFRNIAEMSALGLKQVAAVLGACTAGGAYIPAMCDETVIVDKAGMIYLGGPQLVQAATGELVDAQELGGADTHTRLSGVADHFANDELHALELVRGILGRCEAPALAPPPRPCRPPRYEAAELPGLIPANPKQAMPMLDVLARLLDGSELVQYRERYGTSLICGTGAIGGYPVGVLANDGVLLGQSAQKAANFIELCCQENIPLVFLHNISGFMVGVQYEQGGIAKDGAKMVNAVSTARVPKFSVIVGGSYGAGAYAMCGRAFGPRFMAMWPNARTSVMGGEQAATVLALVRGEQLARQGKEFSAEEAEAYKAPIRDTYGAESTALNAASRLWVDSVIEPADTRDWLTLGLALAAAGPKEPTRFGVFRM

SEQ ID NO: 30814 - protein, 851 aa, Ostreococcus tauri
MAGGPTLANEIARAMRDSPLYVTIPAVMMTIILAIFILDQLSHGPLKGRRSPPVISVAPVWGGMVAFLAGPMRLMREAMPKYGEVFTVPVFHKRITFLIGPKVSEHFFKAKDTEMSQKEVYEFNVPTFGKGVVFDVDHTTRAEQFRFFADSLKSNRLRMYVGMMVKEAEDFFAKWGDEGEVNLLDELSELIVLTASRCLLGREIRETLYSEVTELVHDLDKGMVPLSVFFPYAPIEAHRKRDKARKKLAQIFDKVIQARRESGASEPDVLQTFIDARYKNGSKLSNDQVLGMLIAVLFAGQHTSSITSTWTGLLSIANKERVFPALEEEQRKIIKAHGNELDFDILAKMDELHFAVKEALRMHPPLIMLLRYAQSAFEVETTEGKKYTVPKGHIVATSPAFAHRLDSVYSEPDTYKPGRFREPNAEDKAAFASFIGFGGGRHGCMGETFAYMQIKTIWSILIRNFEFDMVGDLPEPDYEGMVVGPKHAGRSAIVTAGGRRLRHIYLQTHPTRASAFVRVTASTPRVAPHLASPCVAPLASPATPSRACTKRTRPRTHRAPSSVDARPRARRYAMTRGFTASASSQKTRSGSKRATMPITAEEMTYDKIVRVTDSKQRLAPRDGTFYGAPPKTWAERELETVDARELEALDALFETYVEGAYVEGSGLPTYEEALAGRENLRERAESERAASASDEGETVDSASESADEEKETAPFVRVPIRDAAGRSYGTGRRKTAVARVWLAPGPGEHKVNGRPYDEYFSSPTVRGEMVAPFFVSDTVGLFTAVVDVRGGGISGQAQACRHGISVALQNYDPVFRPALKAAGYLTRDSRIVERKKPGKAKARKSFAWVKR

SEQ ID NO: 30815 - protein, 310 aa, Staphylococcus aureus subsp. aureus Mu50
MAQKPVDNITQIIGGTPVVKLRNVVDDNAADVYVKLEYQNPGGSVKDRIALAMIEKAEREGKIKPGDTIVEPTSGNTGIGLAFVCAAKGYKAVFTMPETMSQERRNLLKAYGAELVLTPGSEAMKGAIKKAKELKEEHGYFEPQQFENPANPEVHELTTGPELLQQFEGKTIDAFLAGVGTGGTLSGVGKVLKKEYPNIEIVAIEPEASPVLSGGEPGPHKLQGLGAGFIPGTLNTEIYDSIIKVGNDTAMEMSRRVAKEEGILAGISSGAAIYAAIQKAKELGKGKTVVTVLPSNGERYLSTPLYSFDD

SEQ ID NO: 30816 - protein, 121 aa, Staphylococcus aureus subsp. aureus Mu50
MQDTIFLKGMRFYGYHGALSAENEIGQIFKVDVTLKVDLAEAGRTDNVIDTVHYGEVFEEVKSIMEGKAVNLLEHLAERIANRINSQYNRVMETKVRITKENPPIPGHYDGVGIEIVRENK

SEQ ID NO: 30817 - protein, 487 aa, Pachira aquatica
  misc_feature (3)..(3): Xaa can be any naturally occurring amino acid
  misc_feature (9)..(9): Xaa can be any naturally occurring amino acid
  misc_feature (486)..(486): Xaa can be any naturally occurring amino acid
GVXTLEKEXLGRISQIIGPVLDVAFPPGKMPNIYNALVVKGRDTAGQQINVTCEVQQLLGNNRVRAVAMSATDGLMRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESKXK

SEQ ID NO: 30818 - protein, 484 aa, Neurada procumbens
  misc_feature (1)..(1): Xaa can be any naturally occurring amino acid
  misc_feature (481)..(481): Xaa can be any naturally occurring amino acid
XGYQSLGRISQIIGPVLDVAFPPGKMPNIYNALVVKGRDTTGQQINVTCEVQQLLGNNRVRAVAMSATDGLTRGMEVIDTGAPLSVPVGGATLGRIFNVLGEPVDNLGPVDTRTTSPIHKSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEDHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESXLKK

SEQ ID NO: 30819 - protein, 326 aa, Aspergillus fumigatus
MAEFVRAQIFGTTFEITSRYTDLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENKRIRAGEALAHEYLSPYHDPTDEPEAEEKFDWSFNDADLPVDTWKIMMYSEILDFHNIDQGNDAGQVLMEGGVAQAQQNYA

SEQ ID NO: 30820 - protein, 392 aa, Prochlorococcus marinus str. MIT 9312
MKAMILAAGKGTRVQPITHIIPKPMIPILQKPVMEFLLELLKEHGFKEIMVNVSHLAEEIENYFRDGQRFGVEIAYSFEGRIEDGELIGDALGSAGGLKKIQDFQKFFDETFVVLCGDALVDLDLTEAVKKHKEKGAIASLITKKVTRDQVSSYGVVVSDENGRIKAFQEKPSIDKALSDSINTGIYLFEPEIFNYIPSGEKFDIGADLFPKLVEMDLPFFALPMDFEWVDIGKVPDYWSAIRNVLQGKVRQVEIPGKEIKPGVFTGLNVAANWDKVDITGPVYIGGMTRIEDGATIIGPAMIGPSCCICEGATIDNSIIFDYSKIGKGVRLVDKLVFGRYCVGKNGDHFDLQDASLDWLITDSRRSDMTEPSPQQKAMAELLGTDLINIPE

SEQ ID NO: 30821 - protein, 319 aa, Clostridium perfringens SM101
MENHSKNIKIFTGNSHPELAREIAKALNIPLGKAEVSTFSDGEISVNIKETVRGCDVFIVQSTCSPVNNNLMELLIMIDAFKRASAGRINAVIPYYGYARQDRKAKSRDPITAKLVADLLTAAGADRVLTMDLHAAQIQGYFNIPVDHLLGSPILAKYFVEKGLADRDDVVVVSPDLGSVTRARKFADKLNAPIAIIDKRRPKANVSEIMNIIGDVKDKVCILIDDMIDTAGTITNAANALKDLGAKNVYACCTHGVLSGPAFERINNSAIEELVMLNTIALPEGDGLNKFKSLSVAPIMADAINRIYDDEPLIGLFQD

SEQ ID NO: 30822 - protein, 74 aa, Triticum aestivum
QSPKLYQASVIAPVNIAVVKYWGKRDSVLNLPCNSSISVTLSQDDLRTHTTASCSPAYDTKDNLVLNSAQEDIT

SEQ ID NO: 30823 - protein, 539 aa, Clostridium perfringens SM101
MKKGIAASKGYAIGTVFIQEHEEIIISDAKVSDIAAEKEKLSKALAQSKEQLEAIKEKTANEIGEHEAQVFEAHLMLLDDVEFTGQMEMTIENDQLNAMKAVQNVTDTFVMIFDSMDDPYMRERAADIKDVSKRIIANLAGKGGNGMENVGANTVVVAHDLTPSDTAQLDRSKVIGFLTNIGGRTSHSAIMARTLEIPAVVGLGDITTSVKNGDTVIVDGIEGVAIINPDEATINEYKARLEKFKAEQEELKKLIDVKTTTKSGRRIEVCGNIGKPEDIDQVLANGGDGVGLFRTEFLYMDRDEAPTEDEQFEAYKYVLEKADGKQVVIRTLDIGGDKTLPYLPLPEEMNPFLGYRAIRLCLDRKDIFRVQIRALLRASVYGNLAVMFPMISGLEEFQQAKAFVEECKGELKAEGIAYSDSIQWGIMVEIPAAAVYADELAKHVDFFSIGTNDLIQYTLAADRMSEKVSYLYNPMHPAVLRLIKMTIDGAHKHGKWVGMCGEMAGDERAIPTLVEYGLDEFSMSATSILTAKKIIMEQE

SEQ ID NO: 30824 - protein, 309 aa, Burkholderia sp. 383
MTAKTIRHYLQFTDFSLEDYEYVLERTGILKRKFKNYETYHPLHDRTLAMIFEKSSTRTRLSFEAGIFQLGGHAVFMSTRDTQLGRGEPVEDSAQVISRMVDIIMIRTFEQEVIKRFADNSRVPVINGLTNEYHPCQVLADIFTYYEHRGPIAGKTVAWVGDANNMLYTWIEAAQILGFKLRLSTPPGYALDMKLVSPDSAPFYEVFEDPNEACKGADLVTTDVWTSMGFEAENEARMQAFADWCVDEEMMGHANPDALFMHCLPAHRGEEVTAGVIDGPQSVVWDEAENRLHVQKALMEFLLLGRLKH

SEQ ID NO: 30825 - protein, 208 aa, Robiginitalea biformata HTCC2501
MKIRSAEFVVSNTDVSRCPAEPLPEYAFIGRSNVGKSSLINMLTDRKHLAKISGRPGKTQLINHFRINDNWFLVDLPGYGYARTSKKDKAAFQKLIHRYFRERRQLLSAFLLVDIRHEPQPIDLEFMEWLTGEGIPFALIFTKADKLKPGAVSRQTDGYLQAMRNAGWEADPPFFVTSSLKGIGKDEVLAYIGEINQNFREASGGPPQ

SEQ ID NO: 30826 - protein, 1497 aa, Vitis vinifera
  misc_feature (170)..(170): Xaa can be any naturally occurring amino acid
  misc_feature (173)..(173): Xaa can be any naturally occurring amino acid
  misc_feature (185)..(185): Xaa can be any naturally occurring amino acid
  misc_feature (284)..(284): Xaa can be any naturally occurring amino acid
  misc_feature (305)..(305): Xaa can be any naturally occurring amino acid
  misc_feature (1281)..(1281): Xaa can be any naturally occurring amino acid
  misc_feature (1298)..(1298): Xaa can be any naturally occurring amino acid
  misc_feature (1307)..(1307): Xaa can be any naturally occurring amino acid
  misc_feature (1446)..(1446): Xaa can be any naturally occurring amino acid
MSLTSLYILFPLILTTGFGSSSEEHDALPLNYLQVRPGSSSFKITLFADLHFGESAWSDWGPLQDVNSIKVMSVVLDQETPDFVVYLGYVITANNIAIGNASLYWEEAMSPTRARGIPWASVFGNHDDAPFEWPLEWFSATGIPHTHCTLPNSSVSGEEECSFRGTRRIXLMXNEIKQNNLSYSXNGPKDLWPSISNFVLQVSSSQDPDSAVALLYFLDSGGGSYPEVISSSQAEWFNRKSQELNPSSRVPEIIFWHIPSKAYKKVAPKLGIHKPCVGSINKEXVATQEAEMGIMKLLVKRPSVXATIMDWTGAAPTRSYGYALLDTQKPKSWRCLFTRFKLKQCPTLAAPRRTLTEARAEQRKHALTVALATAAAAEAAVAAARAAAEVVRLTCSPPSYYHTCDKRNQNLAAIKIQTAFRGYLARKALQALKGLVRLQALVRGQIVRRQAITKLKCLPSTANTRAQVNIGGVLTTEETYKDGNNRKFLRPKKECGGREIKAYVIEQLEGSGQRSWDYNILSQEDVETIWLRKQEALIRRERMKKYSSSHRERINAQMPEETEPYKENGRQSCQLVRWMDSMEHKRKEAENSKAAADSNLLNGHINGTTNIELRNGWKQNSTEGSDMPFSLPRRSFCHRKHNSVIDDSSFPSSPVFPTYMAATESAKAKARALSTPKQRLGFLDSCFDQSSPYTNRPSFWSSLNGESISSSGRSGYSWQNTHEQPNNPSAIIPCSGAVSPPILPKFPNLLTAIMSLMCLFLLSQLILTVGFGNSAEQHEGTVALRTLRRNYVEVQQRSSFKIALFADLHFGEDAWTNWGPRQDVKSIKVMSTVLDQENPDFVVYLGDVITANNVAIGNASLYWDQAISPTRERGIPWASVFGNHDDAPFEWPLEWFSAPGIPHTHCNLPNSSVSGEEECFRGTPRIELMKNEIQRNTLSYSRNGPIDLWPSISNYVLKVSSSQDPDSAVALLYFLDSGGGSYPEVISSAQAEWFNRKSQELNPNSSVPEIIFWHIPSKAYKEVAPMFRIHKPCVGSINKEKVASQEAEMGIMKLLVERPSVKATIMDWTGAAHMRSYGYALPGTQAMEHSQYLKVYHCFQKSKRWKWVFTRLKLKQCPALAAPCRTLTEARDEQKKHAMTVALATAAAAEAAVAAAHAAAEVVRLTGTPQSYHTYDKGNQNLAAIKIQTAFRGHLARKALRALKGLVRLQALIRGQILRRQVITTLKCLPSTANNQAQVNKRGVLTANESYKDSDNRKFLRPKELGGREIKDYVIEQLEGXSKKSWDCSMLLKEDMEXIWLRKQEAXTKRERMKKYSSSHRERINAQMTEETESYKENGKWNSQFEQWMDAREYEREELENSKSTIHLNMLNSDKNGTTNVKLRNACKQNSIEGSNLPFSHSRRSFCHRKHNSEADNRSFPSSPVFPTYMATTESAKAKARSMSMXKQRVGFLDSCFDHSSAYKNRLSFWSSFNGESISNIGKNGTPQNSVTMKSFN

SEQ ID NO: 30827 - protein, 255 aa, Trichodesmium erythraeum IMS101
METETIVLLSKREIEKMRQAGRLAARLLNHLEPLVKPGVTTLELDEEAERWTQAHGARSAPLGYRGFPKSICTSINEVICHGIPSEKQVLKEGDIINIDVTPILDGYHGDTSKTFFVGTPSPLAKKLVEVTEKCMYLGIAEVKPGNKIGDIGAAIQEYAEAQGFSVVRDFVGHGVSKIFHTAPQIPHYGTRGKGKKLRAGMVFTIEPMINEGTWEGLVLEDGWTAITIDRKLSAQFEHTVAVTETGVEILTQYEG

SEQ ID NO: 30828 - protein, 169 aa, Zea mays
  misc_feature (77)..(77): Xaa can be any naturally occurring amino acid
  misc_feature (124)..(124): Xaa can be any naturally occurring amino acid
  misc_feature (153)..(153): Xaa can be any naturally occurring amino acid
EMQRVRYFTFVMLIRMVQEKIPRNTTFLMPSDRLLSRPFLSQVLEFLSRHSITVPLVFNYLIRLPNGTIVPSSHPPXGDTITVTNIKRQKFYFTGIELTSPDLYHLGELFRCHGIKGIIKQTAXRVKAATCTRYAAPTSAAPEKTLTKNQSLXTSSLPPPNTGSSTIPA

SEQ ID NO: 30829 - protein, 575 aa, Photobacterium profundum SS9
MISGILASPGIAFGKALLLQEEEIVLSKTPISADQIDNEIQCFFDARKKSAEQLEVIKEKARITFGEEKEAIFEGHIMLLEDEELEEEIIAFIKDKKATAALAIHSIIEEQAMTLESLDDEYLKERATDIRDICNRFVKNALGISIVNLSAINEEVILVANDLTPSETAQINLDYVLGFITDIGGRTSHTSIMARSLELPAIVGTNDITTRVQDGDMLVLDAINNQVVINPTEGELAKFKAIRDQHQAEVEELAKLKDLPAITLDGKQVEVCGNIGTVKDCDGINRNGGEGVGLYRTEFLFMDRDSLPTEEEQYKAYKDVAEAMHGETVIIRTMDIGGDKDLPYLDLPKEMNPFLGWRAIRISLDRREILRDQLRGILRASAHGKIRIMFPMIISIEEIRELKAAIEEYKAELRTEGLAFDEQIEIGVMVETPAAAAIAHHLAKEVSFFSIGTNDLTQYTLAVDRGNELISHLYNPLSPAVLLVIKQVIDASHKEGKWTGMCGELAGDERATLLLLGMGLDEFSMSGISIPRIKKVIRNANFADVKAMAEQALAMPTAAEIEAHVEKFIAEKTIC

SEQ ID NO: 30830 - protein, 232 aa, Pseudomonas fluorescens Pf-5
MSTIADNIAQVAERIRNACQAVQRDPHSVQLLAVSKTKPAAALREAHAAGLRDFGENYLQEALGKQQELADLPLSWHFIGPIQSNKTRAIAEHFDWVHSVDRLKIAQRLSEQRPAELPPLNICIQVNVSGEASKSGCAPADLPALASAIGALPRLQLRGLMAIPEPTEDRAAQDAAFAAVQRLNNDLRDSLKLPLDTLSMGMSHDLEAAIAQGATWVRIGTALFGARDYSQS

SEQ ID NO: 30831 - protein, 483 aa, Paramelhania decaryana
  misc_feature (2)..(2): Xaa can be any naturally occurring amino acid
  misc_feature (8)..(8): Xaa can be any naturally occurring amino acid
IXTLEKEXLGRISQIIGPVLDVAFPPGKMPNIYNALVVKGRDTVGQQINVTCEVQQLLGNNRVRAVAMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALAMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMES

SEQ ID NO: 30832 - protein, 272 aa, Pseudomonas fluorescens Pf-5
MNTTRIAFIGAGNMAASLIGGLRAKGLEASQIRASDPGEQTRAKVAAEHGIQVFADNAEAIEGVDVIVLAVKPQAMKAVCQALRPSLKPQQLVVSIAAGITCSSMNSWLGAQPIVRCMPNTPALLRQGVSGLYATAEVSAQQRQQAEELLSAVGIALWLDQEQQLDAVTAVSGSGPAYFFLLIEAMTAAGEKLGLPRETAAQLTLQTALGAAHMAVSSDVDAAELRRRVTSPAGTTEAAIKSFQAGGFEALVEKALGAAAHRSAEMAEQLGQ

SEQ ID NO: 30833 - protein, 863 aa, Nitella axillaris
SSSSSSSSSAAAAAAAAPSSLSSRPFVWTPPADSRPYCRPCPTNQVLRPFEGCDCVWPMMVILIIQSNSTSFPMHQDEFRREIANGIKLDVEQVMIRNVTDVAPGDDSSLEVTLWLLPRTGERLSQDQATTIESALRGRSIKLNSSLFGSYAIESILCPGEIESAAPERPSPFLPLSATSVKSRNEGEKPMPIWFVPVIVLSSVAAIAILLGSAWVLLICFDKREKKKRAATVATKAARREALHAKTSIKQSRAGPFALAQIPTAGGVGSFLGSARAYTLAEMKAATNDFKAANILGVGGFGKVYKGVLENGTPVAVKVLIRNDCQGGREFVAEVTMLSRVHHRNLVKLLGVCHEDGVRMLIYELVPNGSVESHLHSAHKAIKPLGWDKRMKIALGSAHALAYLHEDSNPSVIHRDFKASNILLEDDYTPKVSDFGLAKSAVEGQRFSISSRVMGTFGYVAPECSMTGRIELKSDVYSYGVVLLELLSGRKPVDLTQPEGQQNLVTWARPLLEDTGEDGCGIERLIDPSLRDGPMIEDIGHVAFIARMCVEPEASNRPSMGEVVQALKLVYTEDEPFSESSVKPIRKQPTTLYSGLLVGYDASASPSVERPRSHAPAASNNPHSKSIEMSSTDAEIGCDNEGPSVGDALINVNPPLTTGETACHVDATNRPPSHAVKIGKSKSISWDESMIARGQGVDWQKRPAPSRPAPNSRSKLKFLSMPFPNTLKRRSDDDSSARKEVRASRLGRIGMLDRAAGPGRAGKPQAPNAAMTVSGIPQSTQSGPIVAMGLGASYGYGYGYGYGYGHEDGGSEKNSTKLSSLDYDTSDDFGSRVWKKRPIGAAAVANGFPLDESPQWHCQVIEH

SEQ ID NO: 30834 - protein, 334 aa, Triticum aestivum
  misc_feature (255)..(255): Xaa can be any naturally occurring amino acid
  misc_feature (313)..(313): Xaa can be any naturally occurring amino acid
KISRVNEVSWRACRARETCLPRVRKALVQSDAGKYVAWSGVDQPELAAEGLGCGLLLLRPLSFALPHYADCHKFGYVLRGSGVAGVLPVATGDASPAARERVVRLEAGDVIATRTGEVSWWYNDSDGDAGDLSIVFMGDTERAVSPGDMSYFFLPGGNSVPGGFDAGLLAGAWPGVTKEQAAAVFRSQPAVLLTGLSKKLPGVRPREDDRKRLVGNPRPSPCKEPLKTLTAADMVRRWAALGDQRGFSAGSSPAXARAPWVLREGAAQLVYVARGSARVQVSSSAGGETLLLDEEVAAGSVFVVPRFAVTLIXARADGAHWVSLIKTARPRGTT

SEQ ID NO: 30835 - protein, 364 aa, Oryza sativa Japonica Group
MSDGKDSLDLSGLGAAVPNAKELSAEDKANLVESIKNTLQGLAARHTDVLESLEPKVRKRVEVLREIQSQHDDLEAKFFEERAALEAKYQKMYEPLYSKRYEIVNGVVEVDGVTKEAADETPAEQKEEKGVPEFWLNAMKNHEILSEEIQERDEEALKYLKDIKWYRISEPKGFKLEFYFDTNPFFKNSVLTKTYHMIDEDEPILEKAIGTEIEWFPGKCLTQKVLKKKPKKGSKNTKPITKTENCESFFNFFSPPQVPDDDEEIDEDTAEQLQNQMEQDYDIGSTIRDKIIPHAVSWFTGEAAQDEDFEGIMDDEDDDDEDDDDDEDEDDEGDDEDDEDEKKGGRVPAGEGQQGERPAECKQQ

SEQ ID NO: 30836 - protein, 322 aa, Photobacterium profundum SS9
MSKIYEDNSLTIGNTPLVRLNRVSNGNVLAKIEARNPSFSVKCRIGSNMIWDAEKKGTLKEGIELVEPTSGNTGIALAFVAAARGYKLTLTMPESMSLERRKLLKALGANLVLTEAPKGMKGAIEKAEEIVASDPSKYLLLQQFNNPANPEIHEKTTGPEIWDATDGEIDVFVSGVGTGGTLTGVSRFIKHQKGKAITTVAVEPTESPVITQTLNGDDVKPAPHKIQGIGAGFIPGNLDLTLIDEVELVSSEDAIAMTRRLMEEEGILAGISSGAAVVAANKIAARPEFAGKKIVVVLPSSGERYLSTALFAGIFTEKENQQ

SEQ ID NO: 30837 - protein, 477 aa, Phaleria capitata
NLGRISQIIGPVLDVAFPPGKMPNIYNALVVKGRDTAGQQINVTCEVQQLLGNNRVRAVAMSATDGLMRGMEVIDTGTPLSVPVGGSTLGRIFNVLGEPIDNLGPVDTRTTSPIHKSAPAFIQLDTKLSIFETGIKVVDLLAPYRRGGKIGLFGGAGVGKTVLIMELINNIAKAHGGVSVFGGVGERTREGNDLYMEMKESGVINEKDLAESKVALVYGQMNEPPGARMRVGLTALTMAEYFRDVNKQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARTRKIERFLSQPFFVAEVFTGSPGKYVGLAETIRGFKLILSGELDGLPEQAFYLVGNIDEATAKATNLEMESK

SEQ ID NO: 30838 - protein, 204 aa, Triticum aestivum
  misc_feature (76)..(76): Xaa can be any naturally occurring amino acid
SVFAGIAQGPEDPILGVTVAYNKDPSPVKVNLGVGAYRTEEGKPMVLNVVRRAEQMLIQNESRVKEYLPITGLADXRTGSLRVGGEFLARHYHERTIYIPQPTWGNHPKVFTLAGLTARSYRYYDPATCGLDFQGLLEDLSSAPSGAIVLLHACAHNPTGVDPTLEQWEQIRQLMRSKALLPFFDSAYQGFASGSLDKDAQSVR

SEQ ID NO: 30839 - protein, 382 aa, Oryza sativa Indica Group
MGKGGKGAEAAAAAVAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQASKQFSSISISLQEEDAILINVVLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 30840 - protein, 213 aa, Staphylococcus aureus subsp. aureus Mu50
MLKRMRDDIKMVFEQDPAARSTLEVITTYAGLHAVWSHLIAHKLYNQKKYVAARAISQISRFFTGIEIHPGAKIGKRLFIDHGMGVVIGETCTIGDNVTIYQGVTLGGTGKERGKRHPDIGDNVLIAAGAKVLGNIKINSNVNIGANSVVLQSVPSYSTVVGIPGHIVKQDGVRVGKTFDHRHLPDPIYEQIKHLERQLEKTRNGEIQDDYII

SEQ ID NO: 30841 - protein, 272 aa, Oryza sativa Japonica Group
MARRRVAALASQLLRRQLLMRRPPPRFLSSAAAAASGPLDRLRSPPFARTAARHGSPALSPWSRFGGQKRGMFIQTQSTPNPQSLMFYPGKPVMEVGSSDFPNARTAMTSPLAKALFAIDGVTRVFFGSDFVTVTKSEETSWDYLKPEVFAVIMDFYSSGQSLFLDSSTAASMDTAIHEDDSEIVAMIKELLETRIRPAVQDDGGDIEYRGFDPETGIVKLKMQGACSGCPSSSVTLKSGIENMLMHYVPEVKGVEQELDGDEEAELTGQLE

SEQ ID NO: 30842 - protein, 145 aa, Actinidia deliciosa
MEQDFHAERIKEFLREVAIMKRLRHPNIVLFMGAVTQPPNLSIVTEYLSRGSLYRLLHKPGAREVLDERRRLSMAYDVAKGVNYLHNRNPPIVHRDLKSPNLLVDKKYTVKVCDFGLSRLKANTFLSSKSAAGTPEWMAPEVQRD

SEQ ID NO: 30843 - protein, 486 aa, Bradyrhizobium japonicum USDA 110
MLPRSAGAGRNKVAVARCPFGQPTGALVMSMQNVAAPALQFTAPRRNELTHIPGDEGWPVIGKTFQVLADPKGHIEANGAKYGPVYRTHVFGETNVVLLGPEANELVMFDQQKLFSSTHGWNKVLGLLFPRGLMLLDFDEHRLHRKALSVAFKSGPMKSYLSDLDRGISARVAQWKAKPGEMQLYPAMKQLTLDLAAASFLGADIGPEVDEINRAFVDMVAAAVAPIRRPLPGTQMARGVAGRKRIVAYFRQQIPLRRGNHGGDDLFSQLCRATHEDGALLSEQDIIDHMSFLMMAAHDTLTSSLTSFIGELAANPDWQDRLRAEVLALGLAPGAPSSFDDLEKMPLSEMAFKEALRIKPPVPSMPRRAMRDFTFKGFRIPAGTAVGVNPLYTHHMKDIWPEPDRFDPLRFTEEAQRNRHRFAWVPFGGGAHMCLGLHFAYMQAKCFARHFLQNIEVSLAPGYKPDWQMWPIPKPRDGLKVRVKAV

SEQ ID NO: 30844 - protein, 180 aa, Streptococcus agalactiae A909
MVKKENIPNLLTVVRILMIPLFIVLTSVTTSTTWHIVAAIVFAIASLTDYLDGYLARKWQVVTNFGKFADPLADKMLVMSAFIMLVGLDLAPAWVSAIIICRELAVTGLRLLLVETGGTVLAAAMPGKIKTATQMFAVIFLLVHWMTLGNIMLYIALFFTLYSGYDYFKGAGFLFKDTFK

SEQ ID NO: 30845 - protein, 323 aa, Bacillus subtilis subsp. subtilis str. 168
MADLFSTVQEKVAGKDVKIVFPEGLDERILEAVSKLAGNKVLNPIVIGNENEIQAKAKELNLTLGGVKIYDPHTYEGMEDLVQAFVERRKGKATEEQARKALLDENYFGTMLVYKGLADGLVSGAAHSTADTVRPALQIIKTKEGVKKTSGVFIMARGEEQYVFADCAINIAPDSQDLAEIAIESANTAKMFDIEPRVAMLSFSTKGSAKSDETEKVADAVKIAKEKAPELTLDGEFQFDAAFVPSVAEKKAPDSEIKGDANVFVFPSLEAGNIGYKIAQRLGNFEAVGPILQGLNMPVNDLSRGCNAEDVYNLALITAAQAL

SEQ ID NO: 30846 - protein, 355 aa, Vitis vinifera
  misc_feature (141)..(141): Xaa can be any naturally occurring amino acid
MTTKHWGMIILLTKFEKKFQAIPEDEMPEILRGNCSPNSSIKTASPNIGMLWTGEAPEVSALEGNMEAYFNMLQGFLFLSHGSTVGAGPTLSSSIHASVKQVVDSSFRLLKESVSSYGSRNRDQKLSIPQLVGAVWEACSXLKKTPATNITAIGRTMTQVAVSMKDVLREMKELKPASSDPTDETSDEASNKAESIPENDDNSSEGDLGNDLSPEEMKIAVSVISVVTEILAVIKELIRCITGLVKQEDANKSSNFVDSLEKLLKLCQGIGVQVDELGACLYPPQEIPAMKAAAEKISGSVDEIQAEIENLGGTTETFIQACNVLRSSLGQLNSLVGDSSTADLVPEMQNLAVTS

SEQ ID NO: 30847 - protein, 778 aa, Isatis tinctoria
MEPKTYFLSIVFLLFVSSSTSSSDILKKQTYIIQLHPNSETAKTFTSKFEWHLSFLQEAVLGVEEEDEEASSRILYSYGSAFEGFSAQLTESEAERLRNLPQVVAVRPDHVLQVQTTYSYKFLGLDGLGNSGVWSQSRFGQGTIIGVLDTGVWPESPSFGDTGMPSIPRKWKGVCQEGENFSSSSCNRKLIGARFFIRGHRVANSPLESPNMPREYISARDSTGHGTHTASTAGGSSVSMASVLGNGAGVARGMAPGAHIAVYKVCWFNGCYSSDILAAIDVAIQDKVDVLSLSLGGFPIPLYDDTIAVGTFRATEQGISVVCAAGNNGPIDSSVANTAPWVSTIGAGTLDRRFPAVVRLANGKLLYGESLYPGKGLKKAERELEVIYVTGGEKGSEFCLRGSLPREKIQGKMVICDRGVNGRSEKGQAIKEAGGVAMILANIEINQEEDSIDVHLLPATLIGYAESVLLKAYVNATARPKARLIFGGTVIGRSRAPEVAQFSARGPSLANPSILKPDMIAPGVNIIAAWPQNLGPTGLPYDSRRVNFTVMSGTSMSCPHVSGITALIRSTYPNWSPAAIKSAMMTTVDLYDRRGKVIKDGNTPAGLFAVGAGHVNPQKAINPGLVYNIQPVDYITYLCTLGFTRSDILAITHKNVSCSGILRKNPGFSLNYPSISVIFKRGKTTEMITRRVTNVGSPNSIYSVNVKAPTGIKVIVNPKRLVFSHVDQTLTYRVWFVLKKGNRGGNVATFAQGQLTWVNSRNLMQRVKSPISVTSKNH

SEQ ID NO: 30848 - protein, 353 aa, Thermotoga sp. RQ2
MRHKIRLIDFILLRFIEERMKVARDVAREKKKTDSPIDIRDIEEQKIKEILDRTDLNPVRMRRIFEEIMKLAKEEEYRLLGISRTVAVLGPMGSFSDEMAMKLIGSRIPLKYCSTTDEIIEMVEKGEVDYGIVPIENSTYGTVIPVLDALLNHEVEVFGEAKLEIHHCLVSKKKLDLKEIKRIYSHPQAISQSLGFINTYLSHAEIRYTSSTSDAVNLLDDESAAIMSESAAKMYGLLILRRSIQDLKEKNITRFYIIRRKTGKMEGKYTSLFFGVQDRPGSLKAVLDIFASRGINLRKLESRPARTFLGDYVFFVEVEAPLKEEDIRDLEKVTAFYKIIGVFDEVEELDVFK

SEQ ID NO: 30849 - protein, 253 aa, Bordetella petrii
MHRLEGKVAFITGGGAGIGCASALLFAQEGAQVVIAERDTAAGEQTAAIVEKSTGRPARFIHTDVTEPESLEAAVKRTVAEFGRFDVLYNNAGGSTVRDSRVTDAPVDEFWSKMKLDLFGTWLGCRYGIQAMMDAGNGGSVINSTSIFALIGTHGKDAYTAAKGAVSALTRSMAVEYAQYRIRVNAVAPGATATERVLKLLKDDGVTSKSLDGQLFGLVQPEDIAHAALYLASDESRSTTGHILAVDGGLTIS

SEQ ID NO: 30850 - protein, 326 aa, Arabidopsis thaliana
MAASNGEKSLIVSFGEMLIDFVPTVSGVSLADAPGFIKAPGGAPANVAIAISRLGGRAAFVGKLGDDEFGHMLAGILKQNGVSAEGINFDTGARTALAFVTLRSDGEREFMFYRNPSADMLLRPDELNLDVIRSAKVFHYGSISLIVEPCRSAHLKAMEVAKEAGALLSYDPNLRLPLWPSKEEAQKQILSIWDKAEVIKVSDEELMFLTGSDKVDDETALSLWHSNLKLLLVTLGEKGCRYYTKSFRGSVDPFHVDAVDTTGAGDSFVGALLCKIVDDRAVLEDEARLREVLRLANACGAITTTKKGAIPALPTESEVQSLLKGN

SEQ ID NO: 30851 - protein, 451 aa, Ipomoea trifida
MSSNTGGHRHCYRRLCSYYFLIFQILILPTLHAPLALNSITPTHPLAVDQTLVSSNALFELGFFTPENSGRWYVGIWYKDIEEKTVVWVANRNSPLTNSTGRGVLRIGDDGNIYLVDGDGNSIWGSSSTTRPGTTVAELLDSGNFVLRRENDRTEENYLWQSFDYPTDTLLPGMKLGCDSKTGLNRYISSWKTATDPAEGDFSFKLDTHGLPEAFLRKKNDVIYGSGAWNGIRFSGVPEMNPTAVITFSFVTTKSENYYTFSLHNETIFSKLQVSHGGYLERYMWIPTNKIWNKFWYAPADQCDYYKECGPYGICDTSISPVCECLVGFGPRNRQAWDLRDGRDGCVRVHDLECESDGFLAMNYMKLPESSSAFVDAGMSFDECTAMCKRNCSCAAYANSNITGDGSGCVMWTTELLDMRQYTAAEGGQVLYVRVAASDVGTFVLRSHLAF

SEQ ID NO: 30852 - protein, 222 aa, Zea mays
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLKREFGPKLKEHMQYCVDHPEEVSKLAKVKAQVSEVKGVMMENIEKVLDRGEKIELLVDKTENLRSQAQDFRQQGTNVRRKMWLQNMKIKLIVLGIIIALILIIILSVCHGFKCGSK

SEQ ID NO: 30853 - protein, 310 aa, Bacillus cereus ATCC 14579
MKKVLFLGDPGIDDSLAIMYGLLHPDIDIVGVVTGYGNVTQEKATSNAAYLLQMAGREDIPVINGAKIPLSGDITTYYPEIHGTDGLGPIKPPKTFSPNIKPFCTFFDLLEKYKGELIIVDAGRSTTLATAFILEKPMMKYVKEYYIMGGAFLMPGNVTPVAEANFHGDPIASQLVMQNAKNVTLVPLNVTSEAIITPEMVKYITKHSKTSFNKLIEPIFTYYYKAYRKLNPKIKGSPVHDVVTMMVAANPSLLDYVYRRVDVDTAGIAKGESIADFRPQPDAKALKNWVRIGWSLHYKKFLEDFVKFMT

SEQ ID NO: 30854 - protein, 285 aa, Burkholderia sp. 383
MSVADAAPPSSSDLTPTPEIQLDVDRARRFGGVARLYGAPAAAAFERAHVAVIGIGGVGSWVAEALARNAVGTLTLIDLDNVAESNTNRQIHALDGNFGKPKVDAMAERIALIDPACRVNRIEDFVEPDNFDALLGGGFDYVIDAIDSVRTKVALIAWCVAKRQPLVVVGGAGGQLDPTRIRIDDLALTIQDPLLSKVRAQLRKQHGFPRGPKARFKVSAVYSDEPLIYPEAAACDLEDGAEPSAAAHVAGLNCAGFGSSVCVTASFGFAAAAHALRAIAAQAAG

SEQ ID NO: 30855 - protein, 451 aa, Ipomoea trifida
MRAAMESGSRLFWYFLILQILIPTTAIAVDTITPTQPLTQNQTLVSAGGVFQLGFFSPGGNSGGLYVGIWYKEIQDRTIVWVANRDKPLRNNSTGFLKIGEDGNIHLVDQTENSIWSSSNSNQSVPENTVAQLLDSGNLVLRRENDENPENYLWQGFDYPTDTLLPGMKLGWDSKTGRNRYISSWKTPTDPSEGDITFKLDINGLPEAFLRKKDNIITRSGGWNGIGFSGVTEMQTKEVIDFSLVMTKHEVYYTFEIRNKTLLSRLVANYTEILERYTWVPENRIWNRFWYAPKDQCDNYGECGTYGICDTDKSPVCGCLVGFEPRKQQAWSLRDGSGGCFRHDQLDCETDGFLTMNNMKLPESSTSFVDVTMSLDECKEMCVRNCSCTAYSNYNISNGGSGCVIWTAELLDMRQYTAEGGQLLYIRVPASDAGAFFSSFLFGTVKTIQKT

SEQ ID NO: 30856 - protein, 494 aa, Bacillus cereus ATCC 14579
MSQLAVNLHEKVEKFLQGTKKLYVNGSFIESASGKTFKTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGVGLNPETTIGPLVSEEQQKRVMGYIEKGIEEGAEVLCGGSNPFDQGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 30857 - protein, 249 aa, Lactobacillus reuteri
MRVPIIAGNWKMHKDVQEAVSFIEKIKNQLPPADQLETAIAAPTLCLVPMVKAAKESPLKIMAENCYYKNEGAYTGETSPYALYQAGIHHVILGHSERRTYFNETDELINKKVKAALVNGLCPIVCCDDTMRRRVAGKKVHWVVSRILADLHGLTNDEICHVTVAYEPSWAIGTGESADPEQAAEGCYLIRQTISDMYGDEVANNVRILYGGSVTTSNINALMAKNDIDGVLVGAASLNPETFLQLVHH

SEQ ID NO: 30858 - protein, 191 aa, Zea mays
  misc_feature (176)..(176): Xaa can be any naturally occurring amino acid
MPRITSVESPGCPPLRAITTDILGLIKVVEARARPAGVAKVVETWGEPDASRAILVASLADRAVDPVLAVARKNGVVELLNPLNGDALAVVKSSRTDQTVGAVENDPLVALHLFRKHAPDLTTLGTFLACTEKGKASVRSVAKENTVSDSDVGPSSTWEVCNKGTLAVSSVEVGEXYAMVGGNGMKVNLWD

SEQ ID NO: 30859 - protein, 337 aa, Zea mays
MEEIIPHPHLHALASTTLAIVAVMVMVLPSTTAGGRLCRESCGDIPVRYPLGIDDGCGSPYYRNMLTCADNATLRLRTPSGTYPVGGADYSDPHLVVTDPSMWTCARPFTSVHAAPFSLDTSTRFSLSPRNEYLFFDCDEARVIVAPRPASCDRYPGRCDSACDSAGYLCRNLPGCALEEGSNQSCCAYRPRAAESLRAMLRHCGAYTSVYWRAAGDRSFPPYDQVPAYGVRVDFEVPVTTRCLQCQDKRRGDGGTCGFDPATRDFVCICGDGRNSTTDCADGHSSGHHGSAGIVAASAVASVSAAIGIWGLVWYIRKIKPSKVVTCGVQSNENRFF

SEQ ID NO: 30860 - protein, 434 aa, Magnetospirillum magnetotacticum MS-1
MSHILRKFPNDPAKPRVVKAEGLYIHTEDGRKLLDMTAGTTTFGVLGYSHPEVLAAMQAQMGKFCHIDYNTWVDPNLEELAALLLSRAPRGLDKVYFPGNSGSEAMEAAMKLSYHVHHDSGKPGKTHYIARLQSFHGATLHGISISELPILAFYEPLLPDGRSKIAQHNPSLNRLPGESMEDYARRSAKELEDKILEIGPDKVGAFIGETMLGSLVGDVPPAPGYWKLIREVCDRYDVHLILDEIYCGLGRSGRIYCCDWDGIVPDFVCIGKNLAAGHAPLSAVVTNHRVEDIIAKGQGRIQHGHTHQGYSLGVAAALAVQRIVHTDAMLDHIQARGRQIVDTITTRLGGHPFFKEVRGRGLLQSFEYDCADKNGFGMTLAKRMLDEHATVINAKWHRVSFTPGYIITEAQLGRVLDDFVAVFESTASGWKTAG

SEQ ID NO: 30861 - protein, 399 aa, Bacillus subtilis subsp. subtilis str. 168; identical to SEQ ID NO: 1260

SEQ ID NO: 30862 - protein, 329 aa, Magnetospirillum magnetotacticum MS-1
MADPRPVLIAGGAGYIGSHVALALADAGRPVVILDDLSTGRQALVPEGAVFVRGDMGDRALVRRLLAEHGCSGVMMFAGSIIVSESFREPLPYWRNNAGSGLAFVETCVEAGIRHFVYSSTAAVYGTPDTLPISESAALRPISPYGRSKLAVEWALSDICETAPTRFAALRYFNVAGADHRGRSGQVSPVATHLIKIAVEAALGRREGMAIYGDDYPTADGTCIRDYIHVTDLAEAHVLALAHLERGGESLIANCGYGHGFSVREVIDVVRRVSGRDFPVHSSERRRGDPPALVADSGLLKAKLGWVARRDDLELMVRSALEWEAKQQP

SEQ ID NO: 30863 - protein, 255 aa, Bacillus subtilis subsp. subtilis str. 168
MIMNLTDKTVLITGGASGIGYAAVQAFLGQQANVVVADIDEAQGEAMVRKENNDRLHFVQTDITDEAACQHAVESAVHTFGGLDVLINNAGIEIVAPIHEMELSDWNKVLQVNLTGMFLMSKHALKHMLAAGKGNIINTCSVGGLVAWPDIPAYNASKGGVLQLTKSMAVDYAKHQIRVNCVCPGIIDTPLNEKSFLENNEGTLEEIKKEKAKVNPLLRLGKPEEIANVMLFLASDLSSYMTGSAITADGGYTAQ

SEQ ID NO: 30864 - protein, 86 aa, Zea mays
AIPSAGAFLKQGGAEAVYAFCTPAVFSPPPIERLFGGVFGEVFVTNSLLLPGGKCFPPLTVLLVGNLVGGAIWHVFWEGSVRRLFP

SEQ ID NO: 30865 - protein, 310 aa, Staphylococcus lentus
GFGRIGRLAFRRLQEVENIEVVAINDLADDAMLAHLLKYDSTQGRFKDEVEVIEGGFRVNGKEIKTFENPNPKELPWGDLDIDVVLECTGFFADKEKAHAHIAAGAKKVLISAPASGDLKTIVYNVNHDELDGSEEIVSGASCTTNCLAPMAKVLNDEFGIVEGLMMTIHAYTGDQNTLDAPHAKGGFRRARAAAENIVPNSTGAAKAIGLVIPELKGKLDGSAQRVPVATGSVTELTAVLDKEVSIEEINEAMKNATNDSFGYTEDEIVSSDVIGITYGSLFDATQTRVMTVGDRQLVKTAAWYDNEMS

SEQ ID NO: 30866 - protein, 470 aa, Bacillus subtilis subsp. subtilis str. 168
MQNHKNELQRSMKSRHLFMIALGGVIGTGLFLGSGFTISQAGPLGAIAAYIIGGFLMYLVMLCLGELAVAMPVAGSFQAYATKFLGQSTGFMIGWLYWFSWANTVGLELTSAGILMQRWLPSVPIWIWCLVFGIVIFLINALSVRSFAEMEFWFSSIKVAAIILFIVIGGAAVFGLIDFKGGQETPFLSNFMTDRGLFPNGVLAVMFTLVMVNFSFQGTELVGIAAGESESPEKTLPKSIRNVIWRTLFFFVLAMFVLVAILPYKTAGVIESPFVAVLDQIGIPFSADIMNFVILTAILSVANSGLYAASRMMWSLSSNQMGPSFLTRLTKKGVPMNALLITLGISGCSLLTSVMAAETVYLWCISISGMVTVVAWMSICASQFFFRRRFLAEGGNVNDLEFRTPLYPLVPILGFCLYGCVLISLIFIPDQRIGLYCGVPIIIFCYAYYHLSIKKRINHETIEKKQTEAQ

SEQ ID NO: 30867 - protein, 310 aa, Staphylococcus piscifermentans
GFGRIGRLAFRRIQDVEGIDVVAVNDLTDDEMLAHLLKYDTMQGRFTEEVEVVDGGFRVNGKEVKSFEEPDASKLPWKDLDIDVVLECTGFYTSDEKAKAHIDAGAKKVLISAPATGDVKTIVYNVNQDTLDSSDVIVSGASCTTNSLAPVAKVLNDSFGLVEGFMTTIHAYTGDQNTQDGPHRKGDKRRARAAAQNIVPNSTGAAKAIGKVIPEIDGKLDGGAQRVPVATGSLTELTVVLDKEVSVDEVNEAMKQASNESFGYNEDEIVSSDVVGMTFGSLFDATQTRVMTVSGRQLVKVAAWYDNEMS

SEQ ID NO: 30868 - protein, 310 aa, Staphylococcus schleiferi
GFGRIGRLAFRRIQDVENIEVVAVNDLTDDDMLAHLLKYDTMQGRFTEEVEVIDGGFRVNGKEAKSFSEPEPAKLPWGDLGVDVVLECTGFFTDKEKAEAHIQAGAKKVLISAPAKGDLKTIVYNVNHDDLDGSETVVSGASCTTNSLAPVAKTLHDEFGIVEGLMTTIHAYTGDQNTQDAPHRKGDKRRARAAAENIIPNSTGAAKAIGLVIPEIAGKLDGGAQRVPVATGSLTELTVVLDKEVTVEEVNKVLKAATNEPFGYTEDEIVSSDVVGMTYGALFDATQTRVMTVGDRQLVKVAAWYDNEMS

SEQ ID NO: 30869 - protein, 310 aa, Staphylococcus xylosus
GFGRIGRLAFRRIQNVDGIDVVAVNDLTDDEMLAHLLKYDTMQGRFTGEVEVENDGFRVNGQEVKSFSEPDPSKLPWKDLDIDVVLECTGFYADKEKAEAHINAGAKKVLISAPATGDLKTIVYNTNHQELDGKETVVSGASCTTNSLAPVAKVLNDDFGLVEGFMTTIHAYTGDQNTQDAPHAKGDKRRARAAAENIIPNSTGAAKAIGLVIPEIDGKLDGGAQRVPVATGSLTELTVVLDKNVSVEDVNAAMKNASNESFGYTEDEIVSSDVVGMTYGSLFDATQTRVMTVGDRQLVKVAAWYDNEMS

SEQ ID NO: 30870 - protein, 311 aa, Staphylococcus capitis
GFGRIGRLAFRRIQDVEGLEVVAVNDLTDDEMLAHLLKYDTMQGRFTGEVEVIDGGFRVNGKEIKSFDEPDASKLPWGDLDIDVVLECTGFYTDKDKAQAHIDAGAKKVLISAPATGDLKTIVFNTNHDELDGSETVVSGASCTTNSLAPVAKVLNDEFGLVEGLMTTIHAYTGDQNTQDAPHRKGDKRRARAAAENIIPNSTGAAKAIGKVIPEIDGKLDGGAQRVPVATGSLTELTVVLDKQDVTADQVNEAMKQASDESFGYTEDEIVPSDVVGMTYGSLFDATQTRVMTVGDRQLVKVAAWYDNEMS

SEQ ID NO: 30871 - protein, 130 aa, Oryza sativa
  misc_feature (85)..(85): Xaa can be any naturally occurring amino acid
  misc_feature (98)..(98): Xaa can be any naturally occurring amino acid
DTTVATLQGLKSTAVMPVARRSGNSSLGNVSNGGRIRCMQVWPIEGMKKVETFCYLSPMTVEDLLKHIEYLLRYKWVPCLEFRQXVGSRYRENHRTRXYYDGRYWTMWKLPMFRGTDATQVLKELEEAKK

SEQ ID NO: 30872 - protein, 349 aa, Bacillus cereus ATCC 14579
MLTQEQIMNALKHVEDPELHKSVVELNMVRNIQMNGTEVKLEVVLTIQGCPLKAKIQQDIEESLHAIGASKVEVTFGSMTQEERAALTEKLKRNTRTETGMPSMLRPDSGVRFITVTSGKGGVGKSTVTINLATALARMGKKVGILDADIYGFSIPAMMETNKKPTMIDQTAIPVISHGVKIMSMGFFTEGNNPVMWRGPMLNKWIQNFLANTHWGELDYLLLDLPPGTGDVAIDVAAMIPQAKEIIVTTPHNIASFVASRVGVMAKHTKHEILGIVENMAYYEEQDGSKNYLFGKGGGEMLAEQLQTEVIAKIPFAKREENNGSSVYDEDSLVGEVFTSLAEDIIYRG

SEQ ID NO: 30873 - protein, 404 aa, Bordetella petrii
MATTRKAAVVGGSLGGLFAANLLLRAGWDVDVYERVGDELAGRGAGIVTHPELLDVLGRIGVESDESVGIEVAERVTLALDGSVLASRPLPQLLTAWGRLYSILKARFPESRYHRGHALERITQDEHTATLVFVGGARVSADLVIAADGLRSTIRQALLPEVRPEYAGYIAWRGLVEESALSPRTRQELCPYFAFGLPPHEQMIAYPVAGSADAEAGARRFNFVWYRPADAQTTFRDMVTDSQGQVWMDGIPPPLIRPEIVQHARDAAHSVLAPQFAEVVEKTENLFFQPIFDLESQRLAVGRIALLGDAAFVARPHCGMGVTKAAGDARALVDALDGTQDVIHALQAYERDRLAFGKFIVGHARDLGRYMQAQLRDEKEREMAERYRTPEAIMRETAVAPAWQ

SEQ ID NO: 30874 - protein, 463 aa, Oryza sativa Japonica Group
MEFLSSVSYLFKALCTCGVAFVTGWFAHWVYRWMNPQCDGKLPPGSMGLPLVGETFRFFRASASIDMPSYYKERLKRYGPIFKTSLVGQPLVISLDPEVNRFVFQQEGKLFRSWYPETTNTIFGKKSLTTYSGAVNKFVRSFASKLFGPTNLKESLLPELESAVRESFATWVMNPSIEVKDGISNMIFDLVAKKLIGFNPTKSRELRKNFQEFFQGMVSFPIYFPGTSFYRCMQGRRNVHKTLTDLLKERLSAPGEKYNDLIDQIIEELQSENPVIDVNFAVDVLSALLFASFATLSSTLSVGFKFLTDNPKVVKELKEEHTTILNKRGSLNSGFTWEEYKSLMFTSQVVHEITRISNVAPGIFRKTLADVKVKGYTIPAGWLVMISPMAVDLNPTLFEDPLEFNPWRWTDKTKQSELLRNYMPFGGGIRLCLGAEFSKLFIALFIHVLVTEYRSLIGLYNSN

SEQ ID NO: 30875 - protein, 488 aa, Rhopalocarpus sp. Chase 906
  misc_feature (4)..(4): Xaa can be any naturally occurring amino acid
  misc_feature (7)..(7): Xaa can be any naturally occurring amino acid
  misc_feature (486)..(487): Xaa can be any naturally occurring amino acid
SGVXTLXKRNLGRISQIIGPVLDVAFPPGKMPNIYNALVVKGRDTVGQQINVTCEVQQLLGNNRVRTVAMSATDGLMRGMEVIDTGAPLSVPVGGATLGRIFNVLGEPVDNFGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESXXK

SEQ ID NO: 30876 - protein, 571 aa, Physcomitrella patens subsp. patens
MAKGTIADSAAWKKLQGHVEDINKTHLRDLLKDEKRCQGMIKEVDGIVFDYSRQRATAETVEGLLSLAQAAKLSEKIEAMWSGQRINETEDRAVLHVALRAPRDAEILCDGKNVVLEVWATLDKIKAFAERLRSGDWIGATGKPLTDVVAIGIGGSFLGPLFVHSALETDPSAQELSKGRSLRFLSNVDPVDASIALKGLSQETTLVVVVSKTFTTAETMLNARTCRTWITSKLGADAVSKHMIAVSTNLKLVKEFGIDPENAFAFWDWVGGRYSVTSAVGVLPLSLHYGFEKVEEFLQGTWSMDQHFRNTPLEKNLPVLLGLLSVWNVTFLGYPARAILPYSQALQKLAPHIQQVSMESNGKGVAIDGTRLPFEAGEIEFGEPGTNGQHSFYQLIHQGRTIPCDFIGSVKSQKPIYMIGEKVSNHDELMSNFFAQADALAYGKTREDLQAENVKESLVPHKVFTGNRPSLSILLPALNAYTVGQLLSLYENRIAVQGFVWGINSFDQWGVELGKSLATKVRSQLNEARTKDAPVQGFNYSTTYLLKHYLKGKTSVANSDPKNVFPSEFQS

SEQ ID NO: 30877 - protein, 293 aa, Thiomicrospira crunogena XCL-2
MTTPSKIAIFGEVLFDCFPTGEKVLGGAPFNIAWHLQALGDSPIFISRVGTDELGKKIILSAQEWGLKPDHIQLDPSHPTGQVAITVEEDEPHYLITPDCAYDFIDQHLIKLPSPPDILYHGTLALRNTASRQALDALAQTTNAPLFLDVNLREPWWHQDDVEQWLSRATWVKLNIEELKTLGFSGETIESDMRSFQKEFALEQVIVTRGAQGTIVLTQENQFHSKKPEALARFVDTVGAGDAFTAVYIHGLMSKWPIEKTLTAAQEFASQVIGIRGATSTDPAFYQEFIDTL

SEQ ID NO: 30878 - protein, 189 aa, Vitis vinifera
MRISNIPIDMIYTSALIRSQMTAMLAMTQHHTKRQSIPVIAAWQLNERMYGELQGLNKQETADRYGKEQVHEWRRSYDIPPPNGESLEMCAERAVAYFREHIEPQLLSGKHIMIAAHGNSLRSIIMYLDKLTSQEVISLELSTGIPMLYIFKEGKFIRRGSPIGPAEAGVYAYTKSLAQYRQKLDDMLH

SEQ ID NO: 30879 - protein, 424 aa, Bacillus subtilis subsp. subtilis str. 168
MSAKQVSKDEEKEALNLFLSTQTIIKEALRKLGYPGDMYELMKEPQRMLTVRIPVKMDNGSVKVFTGYRSQHNDAVGPTKGGVRFHPEVNEEEVKALSIWMTLKCGIANLPYGGGKGGIICDPRTMSFGELERLSRGYVRAISQIVGPTKDIPAPDVYTNSQIMAWMMDEYSRLREFDSPGFITGKPLVLGGSQGRETATAQGVTICIEEAVKKKGIKLQNARIIIQGFGNAGSFLAKFMHDAGAKVIGISDANGGLYNPDGLDIPYLLDKRDSFGMVTNLFTDVITNEELLEKDCDILVPAAISNQITAKNAHNIQASIVVERANGPTTIDATKILNERGVLLVPDILASAGGVTVSYFEWVQNNQGYYWSEEEVAEKLRSVMVSSFETIYQTAATHKVDMRLAAYMTGIRKSAEASRFRGWV

SEQ ID NO: 30880 - protein, 207 aa, Magnetospirillum magnetotacticum MS-1
MSDAIQNPTSLVTKAAPDFTAPAVMPDNEINPAFNLKSYLAGSYGIVFFYPLDFTFVCPSEILAHDHRVKAFAERNTKVIAVSVDSHFTHLAWKNTPVDKGGLGNVQFPMVADLTKDIAKSYGVLLPGGVALRGTFVIDKNGVVQSAHVNNLPLGRNVDEALRLIDALQFHEEHGEVCPAGWNKGKAGMKANPNGVAEYLAKHASEL

SEQ ID NO: 30881 - protein, 278 aa, Kineococcus radiotolerans SRS30216
MDGGGPGPATPRAVASWPGCENAGVVTSDVTPQRELADLSKRPQQVSAMFDDVAEKYDRTNDILSAGQDRWWRRAVRRAVDARPGEKVLDLAAGTGRSSEPFADRGVLTVPCDFSTGMVRAGKRRRPDLGFVVGDATRLPFADGVFDAATISFGLRNVVDPDAGLREMARVVRPGGRLVVCEFSTLPNPLLRKAYDTYLHHGLPRVAKLVSSHGDAYGYLVESIDAWPDQAGLAGRIAAAGWQRVAWRNLSFGVVAVHRAVRSPGPVPTPPEDVAPRP

SEQ ID NO: 30882 - protein, 198 aa, Prochlorococcus marinus str. MIT 9312
MFLVIDNYDSFTYNLVQYLGELSVEHEITKELIVKRNDEITLEEIIKLNPSGILLSPGPGNPDQSGICLPILKKLSKNIPTLGVCLGHQALAQAFGGKVIVGKELMHGKTSKIFHNQKGLFKDIETPFVATRYHSLIVDSSSLPSCFDINATLEDSTIMAISHKEYKHLHGVQFHPESVLTQFGHKLISNFLKMAEQK

SEQ ID NO: 30883 - protein, 278 aa, Corynebacterium sp. ATCC 31090
MTVPSIVLNDGNSIPQLGYGVFKVPPADTQRAVEEALEVGYRHIDTAAIYGNEEGVGAAIAASGIARDDLFITTKLWNDRHDGDEPAAAIAESLAKLALDQVDLYLVHWPTPAADNYVHAWEKMIELRAAGLTRSIGVSNHLVPHLERIVAATGVVPAVNQIELHPAYQQREITDWAAAHDVKIESWGPLGQGKYDLFGAEPVTAAAAAHGKTPAQAVLRWHLQKGFVVFPKSVRRERLEENLDVFDFDLTDTEIAAIDAMDPGDGSGRVSAHPDEVD

SEQ ID NO: 30884 - protein, 1444 aa, Saccharomyces cerevisiae
MAPNKSDAQSIFSSGVEGVNPIFSDPEAPGYDPKLDPNSENFSSAAWVKNMAHLSAADPDFYKPYSLGCAWKNLSASGASADVAYQSTVVNIPYKILKSGLRKFQRSKETLTFQILKPMDGCLNPGELLIVLGRPGSGCTTLLKSISSNTHGFTLGADTKISYSGYSGDDIKKHFRGEVVYNAEADVHLPHLTVFETLVTVARLKTPQNRIKGVDRESYANHLAEVAMATYGLSHTRNTKVGNDIVRVVSGGERKRVSIAEVSICGSKFQCWDNATRGLEFIRALKTQADISNTSATVAIYQCSQDAYDLFNKVCVLDDGYQIYYGPADKAKKYFEDMGYVCPSRQTTADFLTSVTSPSERTLNKDMLKKGIHIPQTPKEMNDYWVKSPNYKELMKEVDQRLLNDDEASHEAIKEAHIAKQSKRARPSSPYTVSYMMQVKYLLIRNMWRLRNNIGFTLFMILGNCSMALILGSMFFKIMKKGDTSTFYFRGSAMFFAILFNAFSSLLEIFSLYEARPITEKHRTYSLYHPSADAFASVLSEIPSKLIIAVCFNIIFYFLVDFRRNGGVFFFYLLINIVAVFMSHLFRCVGSLTKTLSEAMVPASMLLLALSMYTGFAIPKKKILRWSKWIWYINPLAYLFESLLINEFHGIKFPCAEYVPRGPAYANISSTESVCTVVGAVPGQDYVLGDDFIRGTYQYYHKHKWRGFGIGMAYVVFFFFVYLFLCEYNEGAKQKGEILVFPRSIVKRMKKRGVLTEKNANDPENVGERSDLSSDRKMLQESSEEESDTYGEIGLSKSEAIFHWRNLCYEVQIKAETRRILNNVDGWVKPGTLTALMGASGAGKTTLLDCLAERVTMGVITGDILVNGIPRDKSFPRSIGYCQQQDLHLKTATVRESLRFSAYLRQPAEVSIEEKNRYVEEVIKILEMEKYADAVVGVAGEGLNVEQRKRLTIGVELTAKPKLLVFLDEPTSGLDSQTAWSICQLMKKLANHGQAILCTIHQPSAILMQEFDRLLFMQRGGKTVYFGDLGEGCKTMIDYFESHGAHKCPADANPAEWMLEVVGAAPGSHANQDYYEVWRNSEEYRAVQSELDWMERELPKKGSITAAEDKHEFSQSIIYQTKLVSIRLFQQYWRSPDYLWSKFILTIFNQLFIGFTFFKAGTSLQGLQNQMLAVFMFTVIFNPILQQYLPSFVQQRDLYEARERPSRTFSWISFIFAQIFVEVPWNILAGTIAYFIYYYPIGFYSNASAAGQLHERGALFWLFSCAFYVYVGSMGLLVISFNQVAESAANLASLLFTMSLSFCGVMTTPSAMPRFWIFMYRVSPLTYFIQALLAVGVANVDVKCADYELLEFTPPSGMTCGQYMEPYLQLAKTGYLTDENATDTCSFCQISTTNDYLANVNSFYSERWRNYGIFICYIAFNYIAGVFFYWLARVPKKNGKLSKK

SEQ ID NO: 30885 - protein, 310 aa, Staphylococcus carnosus
GFGRIGRLAFRRIQDVEGIDVVAVNDLTDDEMLAHLLKYDTMQGRFTEEVEVVDGGFRVNGKEVKSFEEPDASKLPWKDLDIDVVLECTGFYTSEEKAKAHIDAGAKKVLISAPATGDVKTIVYNVNQDTLDSSDVIVSGASCTTNSLAPVAQVLNDSFGLVEGFMTTIHAYTGDQNTQDGPHRKGDKRRARAAAENIVPNSTGAAKAIGKVIPEIDGKLDSGAQRVPVATGSLAELTVVLDKDVTVDEVNEAMKQASNESFGYNEDEIVSSDVVGMTFGSLFDATQTRVMTVSGRQLVKVAAWYDNEMS

SEQ ID NO: 30886 - protein, 234 aa, Triticum aestivum
QIRQLMRSKALLPFFDSAYQGFASGSLDKDAQSVRMFVADGGELLMAQSYAKNMGLYGERVGALSIVCGSADIAVKVESQLKLVIRPMYSNPPLHGASIVATILKDSAMFDEWTLELKAMADRIISMREQLFNALKIRETPGDWSHIIKQIGMFTFTGLNSDQVAFMRQEYHIYMTSCRCHTCRSNKTEVNDNIATPSHNKILNSLQQFPRGSTRGVLLAELENLPCRLIKLVV

SEQ ID NO: 30887 - protein, 201 aa, Porphyromonas gingivalis W83
MEIKKAAFVISNTDVRKCPDTRLPEYAFIGRSNVGKSSLINMLTGQKGLAMTSQKPGKTQLINHFIIDDSWYLVDLPGYGYARLGASNRESLRRIIETYILCREQLSSLFVLIDCRHEPQKIDLEFLQWLGENGIPFSIVFTKADKLSFSRLKENTEAYKQKLLETWEELPPVFITSSEKKTGKEELLDYIDSINQELATK

SEQ ID NO: 30888 - protein, 310 aa, Staphylococcus cohnii
GFGRIGRLAFRRIQDVEGIDVVAVNDLTDDEMLAHLLKYDTTQGRFTGEVEVEENGFRVNGLEVKSFSEPDPSKLPWGDLDIDVVLECTGLFTDKEKAEAHINAGAKKVLISAPAKGDLKTIVYNTNHDTLDGSEDVVSGASCTTNSLAPVAKVLNGEFGLIEGFMTTIHAYTGDQSTQDAPHRKGDKRRARAAAENIIPNSTGAAKAIGLVIPEIDGKLDGGAQRVPVATGSLTELTVVLDKNVSIEDVNNAMKNASNESFGYTEDEIVSSDVIGMTYGSLFDATQTRVMTVGDRQLVKVAAWYDNEMS

SEQ ID NO: 30889 - protein, 484 aa, Salmonella enterica subsp. enterica serovar Typhi str. CT18
MAEKKSQGVKWLPFILILVIAAGLWQLTPPSGLSAPAWHSAIIFVATIASIVAKVLPIGAVGIIGITVFALAYAAGDKTASGAITTALSELNSSLIWLIVVAFMIARGFIKTGLGRRIALQMIRLLGKRTLGLAYGLAFADLILSPAMPSNTARCGGVIYPIADSLARSFDSHPEDESRSKIGTFLITCIGNVNDVTAALFMTGYTGNLLAVKLAANAGVTLSWGSWFIAALLPCLVSFLIVPLLVYWLTRPEIKHTPDAPDLARKELAQMGSMARGEWLMLATVGVLLVLWIFGSSLGVDATTASFVGLSILLLSGVLTWEDVKSEKGAWDTLIWFAALLMMANQLKKLGFTSWFGNLIGDSIGSTMHGTSWIIILLLLNAAYFYTHYFFASGNAQIAALYAVFLGVGLHLNIPAAPMALMLAFTSSLYCSLTQYTHARGPILFGAGYVPTGIWWRTGFIISLFNQAVFLTVGLAWWKVLGLY

SEQ ID NO: 30890 - protein, 310 aa, Staphylococcus equorum
GFGRIGRLAFRRIQDVEGIDVVAVNDLTDDEMLAHLLKYDTTQGRFTGEVEVEKDGFRVNGQEVKSFSEPEPSKLPWKDLDIDVVLECTGFFADKEKAEAHIDAGAKKVLISAPATGDLKTIVYNTNHSELDGSETVVSGASCTTNSLAPVAKVLNDDFGLVEGFMTTIHAYTGDQSTQDAPHRKGDKRRARAAAENIIPNSTGAAKAIGLVIPEIDGKLDGGAQRVPVATGSLTELTVVLEKDVSVEDVNAAMKNASDESFGYTEDEIVSSDVIGMTYGSLFDATQTRVMTVGDHQLVKIAAWYDNEMS

SEQ ID NO: 30891 - protein, 373 aa, Fulvimarina pelagi HTCC2506
MSRTDQKKLEEKEMQTSTLRTTGGRGRLFDSVLDTIGDTPVIRVNNLRVGDTTLYVKAEFFNPAGSVKDRLALNIIEDAERRGLLKPGQTVIEATSGNTGIGLAIVCAQKGYPLVVTMADSFSVERRKLMRMLGAKVVLTPRAEKGYGMYRKAVELAEANGWFLARQFETKANADIHAATTAREILGDFAGQRLDWFVTGYGTGGTVSGVGRVLRKERPETRIVLVEPANAALLSSGVAQNRGSDGAPTSGHPAFEPHPIQGWTPDFIPYVLQEAVSGHFYDEVVKIAGPEAIKWTRELARREGIFCGISSGATFAVARQIAETAPAGSVILCMLPDTGERYLSTPLFEGIEADMDVEEMALSHSTASARFAA

SEQ ID NO: 30892 - protein, 310 aa, Staphylococcus haemolyticus
GFGRIGRLAFRRIQDVGGIEVVAVNDLTDDEMLAHLLKYDTMQGRFTGEVEVVDGGFRVNGKEVKSYEEPDASKLPWGDLDIDVVLECTGFYTDKEKAEAHINAGAKKVLISAPAQGDVKTIVFNTNHNDLDGSETVVSGASCTTNSLAPVAKVLSDEFGLVEGLMTTIHAYTGDQMTQDGPHKKGDKRRARAAAQNIVPNSTGAAKAIGKVIPEIDGKLDGGAQRVPVATGSLTEVTVVLEKDVTVEDVNKAMKNASNESFGYTEDEIVSSDVVGMTYGSLFDATQTRVMSVGDRQLVKVAAWYDNEMS

SEQ ID NO: 30893 - protein, 483 aa, Burkholderia sp. 383
MQTVSMLIGGERRHSSSGATFVRRNPLDGEVASEAPAGTVDDARAAADAAARAFPDWAALGPGARRALLLKAAAALEAKHDQFVAAMAAETGASALWAGFNVHLAASGLVEAASLTTQVGGELIPSDVPGSLAMGVRQPAGVVLGIAPWNAPVILATRALALPLACGNTVVLKGSELCPVTHGLIVEALQEAGLPPGVVNFVTNAPEDAGAIVDALIAHPAVRRVNFTGSTRVGWIVAEACARHLKPSVLELGGKAPFVVLDDADLDAAVAAAAFGAFANSGQICMSTERIVVDASIADAFVAKLADKAASLPLGDPRNGPVVLGSLIDMKAVERCNALIDDALAHGATLVCGGKADSTLFPATLLDHVTPAMRIYAEESFGPVKGIVRVDGEEAAIRCANDNAFGLSSAVFSRDVARAMRVAARIESGICHVNGPTVHDEAQMPFGGVKDSGFGHFGGKAGIAAFTDLRWITVQTAPRHYPF

SEQ ID NO: 30894 - protein, 390 aa, Robiginitalea biformata HTCC2501
MIEEARRLSAVKEYYFSSKLREVRGLMAEGRPVINMGIGSPDLAPSQAVLESLTASVREAGAHQYQSYQGLPELRQTISEFYNRKFGVSLDPDSEILPLMGSKEGIMHISMAFLNPGDKVLIPDPGYPTYAAVTRLVGAEPIHYRLSGESGWFPDLEALSQSDLSGVKIMWASYPHMPTGAKASREQLSELVAFAHRHQILLVNDNPYSFVLAREPISILDIPEASGHVLELNSLSKTFNMAGWRVGMALGDKRLIAAVLKVKSNMDSGMFYGIQKGAIAALKSDPEWFKGLDAIYSRRRAAVHELADLLGCSYDKEAVGMFVWARLPKGSPDAETYIDGLLYNHNIFVAPGTIFGSRGAGYIRFSLCVPEEKIREALGRIQTAVTKKEV

SEQ ID NO: 30895 - protein, 723 aa, Thermotoga sp. RQ2
MWLLFLIPLVALGFAAANFAAVVRKPEGTERMKEISSYIRSGADSFLAHETKAIFKVAIVIAILLMIFTTWQTGVAFLLGAVMSASAGIVGMKMATRANVRVAEAARTTKKIGPALKVAYQGGSVMGLSVGGFALLGLVLVYLIFGKWMGQVDNLNIYTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQKIGENLVHQVPKETIQALISYPIFFALAGLGCSMLGILYVIVKKPSDNPQRELNISLWTSALLTVVLTAFLTYFYLKDLQGLDVVGFRFGAISPWFSAIIGIFSGILIGFWAEYYTSYHYKPTQFLSKSSIEGTGMVISNGLSLGMKSVFLPTLTLVLGILFADYFAGLYGVAIAALGMLSFVATSVSVDSYGPIADNAGGISEMCELDPEVRKITDHLDAVGNTTAAIGKGFAIGSAIFAALSLFASYMFSQISPSDIGKPPSLVLLLNMLDARVIAGALLGAAITYYFSGYLISAVTKAAMKMVDEIRRQAREIPGLLEGKAKPDYNRCIEITSDNALKQMGYPAFIAILTPLVTGFLLGAEFVGGVLIGTVLSGAMLAILTANSGGAWDNAKKYLEAGNLEGYGKGSEPHKALVIGDTVGDPLKDTVGPSLDILIKIMSVVSVIAVSIFKHVHLF

SEQ ID NO: 30896 - protein, 310 aa, Staphylococcus hyicus
GFGRIGRLAFRRIQDVENIEVVAVNDLTDDDMLAHLLKYDTMQGRFTEEVDVIDGGFRVNGKEVKSFSEPEPSKLPWKDLEVDVVLECTGFFTSKEKAEAHIEAGAKKVLISAPGTGDLKTIVYNVNHEELDGSETVVSGASCTTNSLAPVAKTLHDEFGIVEGLMTTIHAYTGDQNTQDSPHRKGDKRRARAAAENIIPNSTGAAKAIGLVIPEIAGKLDGGAQRVPVATGSLTELTVVLEKEVSVEEVNNAMKNATNESFGYTEDEIVSSDVVGMTFGALFDATQTRVMTVGDRQLVKVAAWYDNEMS

SEQ ID NO: 30897 - protein, 276 aa, Robiginitalea biformata HTCC2501
MKPRKIAIQGIEGSNHHKVASEYFGQGIELVECMSFTGLVDSLLEGKAEKGVMAIENSIAGSIIPNYNLVCDNGLHIIGEHYLNVHHHLMALPGQRLEDIRVVRSHPMALLQCGDYLKEKPQMTVVEDADTAEPARKIAREQLKGVGAIAPALAAELFGLEILASEIQTINNNATRFIIVKTVNKEWPRDAINKASMRFLTDHKRGSLATVLNVMSDCNLNLTKIQSLPVIDTPWKYSFFVDVTFEAYAQFEKAKSLLAIMTEDFRVLGEYKNARI

SEQ ID NO: 30898 - protein, 264 aa, Vitis vinifera
MSACKDQDPRIHGIKTKIRVVPNFPKPGFSSFDRPFFFVALFSSRVNAGELKKSKFLSAGFLLFYNPRKQKPTLSSAMTRTTTRIMFQDITTLLLDPKAFKDTIDLFVERYKGKNISVVAGKVWKVGPVEVLVLKLGTITCDMVWRGIEARGFIFGPPIALAIGAKFVPLRKPRKLPGEVISEEYILEYGRDCLEMHVGAVEPGDRALVVDDLIATGGTLCAAMNLLERVGAEVVECACVIELPDLKGRDRLNGKPLYILVEYH

SEQ ID NO: 30899 - protein, 639 aa, Ustilago maydis 521
MPPTTHLRGPPDDPSAEWIIQKYGGTSVGKFLHTIAQQIVPSYLAGNKVAIVCSARSGQTKALGTTNLLLQAAGEALDEALTPAASLSNSVTSIANGAQTPVHRPGSAFSRKSSSRGTPLGRVESLSSTTLDNKLQQLTLNTTTTAAANTEQSTAAKSDAGSDSDTDIAIGFNATVDRILSDHLASARKAVINDRLLLEQLERDITEDCDRLRDFLLAAKIIEEISPKSKDIIIGVGERLSCRIAVGALRDAGVDAELVTLESIVDPSFSAHAVQDSQGEFTLDQTFYDSLSQALGQRLNACSGVPVVTGYFGNVPGSLLSQIGRGYTDLCAALCAVGVNAKELQIWKEVDGVFTADPRKVPTARLIPAITPEEAAELTYYGSEVIHPFTMEQAIKKAIPIRIKNVENPTGMGTVIFPDVPEGHDGSEDKLVDGHVDQPRPPMTPSASKSNFSAWGSSANAQATRPVMGERKLPTAVTIKDNVLVLNVHSNRKTVSHGFFAKIFGTLDKYGVVVDLISTSEVHVSMAMAAALRPRTLEKVKADLQKVGTVSVLTDMAILSLVGKHMRNMVGVAGRMFTVLADGNVNIEMISQGASEINISCVLHEKLAVKALNLIHYSVLEVSPKPSNSEAGAFGRSFF

SEQ ID NO: 30900 - protein, 434 aa, Cytophaga hutchinsonii ATCC 33406
MKLYSTNHQVPEVNLKEAVFKGLPDDNGLYMPENIPTLPASFFENIDTLSFQDIAFEVCKALIGDEVPEKEIRSIVDDVLTFDAPVVKVENNIYVLELFHGPTLAFKDFGARFMARLMSYFLQKEKKDIMILVATSGDTGSAVAQGFLDKAGIKVTILYPSKKVSDLQEKQLTTLGKNITALEVLGTFDDCQRMVKQAFLDKEITSKINLSSANSINISRLIPQSFYYFYAYAQAKKLGKKVVFSVPSGNFGNICAGLIAKKMGLPIDMFVASTNANDIMPKYINTGVFEAKPSVATISNAMDVGNPSNYPRVIELYGKDINALRKDVVGKAYTDEETAAAVKSVYKATGYVMDPHGAVGYLGLKEYFEESGKDATGIFLATAHPAKFIEVVNDIIEKDVEIPAQLKELINKKQESIVIENDFEKLKSFLLTAL

SEQ ID NO: 30901 - protein, 476 aa, Pseudomonas fluorescens Pf-5
MSAEIAYLQDSLQQQDELLELFEAQRRAFAANPMPPAAQRQQWLKALQELLNNERQALIDAISQDFSNRSADETLLAELMPSLHGIHYASKHLKKWMKPSRRAVGLAFQPASAKVVYQPLGVVGIIVPWNYPLYLCMGPLVGALAAGNRVMLKLSESTPATGQLLKQLLARVFPEDLVCVVLGEAEVGMAFSKLRFDHLLFTGATSIGKHVMRAAAENLTPVTLELGGKSPAIVSSTVPLKDAAERIAFGKTLNAGQTCVAPDYVLVPEERVGAFVEAYRQVVRGFFPTLADNPDYTAIINQRQLTRLNGYLSDATSKGALLVPLFEQSQERRLGHSLLLNVSDDMTVMQDEIFGPILPIVPYRTLDQAFAYITQRPRPLALYYFGYDKAEQQRVLNETHSGGVCLNDTLLHVAQDDLPFGGIGPSGMGHYHGHEGFLTFSKAKGVFIKQRFNAARLIYPPYGKSIQKLIQKLFIR

SEQ ID NO: 30902 - protein, 141 aa, Glycine max
  misc_feature (54)..(54): Xaa can be any naturally occurring amino acid
  misc_feature (63)..(63): Xaa can be any naturally occurring amino acid
  misc_feature (76)..(76): Xaa can be any naturally occurring amino acid
  misc_feature (121)..(121): Xaa can be any naturally occurring amino acid
GSRRIEQRYCQMASPLLNRGVTAPMWPLKAIPDEAYKKDFLLYVIRHGLLSMSXPKPCCMTAXRNLKNYREPYKEXRNSLGTALIVKLKAYGRADAQKLVLDIDLGLGNHVTSPMFKRLIXRLTRTYWGLALHGRAPPVRV

SEQ ID NO: 30903 - protein, 174 aa, Porphyra yezoensis
MKHTLSVLVQDEAGVLSRISGLFARRGFNIASLAVGPAEQIGVSRITMVVQGDNRTIEQLTKQLYKLVNILNVQDVTNIPSVERELMLIKIQINSQTRTEALEIVRIFRAKIVDIAEDLLIIEVTGDPGKIVAIEQLLTKFGIIEIARTGKILLVRTSKINTEYLKNRVVAYGT

SEQ ID NO: 30904 - protein, 196 aa, Triticum aestivum
  misc_feature (87)..(87): Xaa can be any naturally occurring amino acid
  misc_feature (91)..(91): Xaa can be any naturally occurring amino acid
  misc_feature (100)..(100): Xaa can be any naturally occurring amino acid
  misc_feature (110)..(110): Xaa can be any naturally occurring amino acid
  misc_feature (129)..(129): Xaa can be any naturally occurring amino acid
  misc_feature (134)..(134): Xaa can be any naturally occurring amino acid
  misc_feature (138)..(138): Xaa can be any naturally occurring amino acid
  misc_feature (144)..(144): Xaa can be any naturally occurring amino acid
  misc_feature (146)..(146): Xaa can be any naturally occurring amino acid
  misc_feature (151)..(151): Xaa can be any naturally occurring amino acid
RRALRELLFCTPGALQYLSGVILFEETLYQSTKGGKPFVDILKAGNVLPGIKVDKGTIELAGTNGETTTQGFDDLGKRCAKYYEAGXARFXKWRASLKIXAPTEPSQSPXDQEPQGLVRYPSTGKENGXVPIVXPEIXVDGLKXFXRCAYXTFPCGQKAKTTSDPRQKAEPKRGPKDNFEPKGLGVPQPGKGGYYQ

SEQ ID NO: 30905 - protein, 683 aa, Arabidopsis thaliana
MESMTPISCPTTPRWNQDRPFLTGRFHQETRASSKFADSKRFTLDSSSSSGVEQAIGCYDTPVQELIVIDDLLSALVGIEGRYISIKRFHGKEDSIAFQVDPSMDLALQELAKRIFPLCEYYLLIDQFVESSSQFKNGLVNHAFAAALRALLLDYQAMVAQLEHQFRLGRLSIQGLWFYCQPMMGSMRALAAVIQQASTKQFVGSGVLNLLQSQAKAMAGDNSVRSLLEKMTECASNAYLSILERWVYEGIIDDPYGEFFIAENRSLKKESLSQDSTAKYWSQRYSLKDTIPGFLANIAATILTTGKYLNVMRECGHNVQVPISERSKLTIFGSNHHYLECIKAAHEFASIELVNLIKDKYDLVGRLRSIKHYLLLDQGDFLVHFMDIAREELNKKVHEISVEKLQSLLDLALRTTAAAADPRHEDLTCCVDRASLLTTLGMHKDTDSNSIEDPMSITGLETFSLSYKVQWPLSIVISKKALSKYQLIFRFLFHCKHVERQLCGAWQIHQGIRSMNSKGTAILRSSLLCRSMLKFISSLLHYLTFEASLNVLEPNWHVMHDRLQSTRSVDEVIQHHDFFLDKCLRGCLLLLPDVLKKMEKLKSVCLQYAAATQWLISSSIDINSQSHPQKTMIRDTTVTESIFNFEREFNSELQSLGPVLSKGSQAEPYLTHLSQWILGVSKE

SEQ ID NO: 30906 - protein, 995 aa, Ostreococcus tauri
  misc_feature (995)..(995): Xaa can be any naturally occurring amino acid
MRSSASTARAGSIGRRTARARGGGRSARARASPGTSKRVRELRDEGAYAVGDAARALERRGRRVVRLEIGQPQFETPENVCEAGVGAIERGETRYSAPAGTAALREAVRGYVARTRGVTYDVDEVIVGPGAKPGLFLPALAIVDEGDEVVYPDPGFPTYAAMVSTAGGTRVPVALTNDGSSFDMDALERAVNEKTKMIVINSPGNPTGGVMPRADVERVAALAKKFNCWVLSDEIYSRLRYDDDGNGASESDDGLEDIFSIAALDGMKERTILVDGFSKTYCMTGWRLGWMCCPKALAERIRLLTVHSVGCVAPFTQAAGVEALTGPQDSVRAMREEYRARRDYLVDALNAIPGIRCPKPQGAFYVFPEFTYDCTAKELADYLLEDAGVALLPGTDFGVRGEKHLRLSYVGSMDDLREAVALMTTSLRRKFPRELRFDVIPSLRAPRRPSARRARNRLTRGPFDVRNTLPRTHRRDARTSSRVRRRDAPSGVPSTDVDLDRSPHRSFALGVVVVEARRRKIARKTSPARTMMENDHSADVERRSAGARAEETSSERTEMRSRASRSTRGGRWTLAVTCALGALSARGARAQTPPTDAACDYYMQVGGAGEAASGGGTSDVPFGSLEEAQLALTAGDTLCVRGGQYRLNTFIGAEILVRGNATHPITIKGLKGSDGNLPTFLFKSGVAFDFRGAKYINFESLDVDGSAYNVPLRAVLTAHWWRDKPSPRVKIGQTCFRLRENTRHVNISHCACHDVHSNAVNVVDAYYTRIAHNAFYRIGFYRFKGEVAAVKRTFVKASQEVEEDGYRLDIEGNVIWNVESHLYQRTENASTGNILETNALNFDSVTDLDSKIRVQGNLLAFNGGPDLKFKNAPYLVVMSNTMHASPTVDSVMISDGTSDTSRLIMKNNMFFATQSSKSVIDIDVSMLNSTISDDDTILNNFVSGGGGFVNGTQAGFSVIDASEPVFANVSAGDFRILSTTTGVDATDMPGVSDSX

SEQ ID NO: 30907 - protein, 539 aa, Polaromonas sp. JS666
MQHQKILILDFGSQVTQLIARRVRDAHVFCEVHPCDVTDDWVRDYARDGTLKGVILSGSHASIYEETTDKAPQAVFELGLPVLGICYGMQAMAHQLGGKVEGGHKREFGSADVRARGHTALLKDIADYTTPEGQGMLDVWMSHGDKVTEMPPGFKLMASTESCPIAGMADEDRRFYAVQFHPEVTHTKQGNAILKRFVLDICGTRQDWVMGDYISEAVEKIRQQVGDEEVILGLSGGVDSSVAAALIHRAIGDQLTCVFVDHGLLRLNEGDMVMDMFVGKLHARVVRVDASEQFLGHLAGVSEPEAKRKIIGREFVEVFKAEAARLKAGDGGHKGAKWLAQGTIYPDVIESGGAKSKKAVTIKSHHNVGGLPEQLGLKLLEPLRELFKDEVRELGVALGLPHDMVYRHPFPGPGLGVRILGEVKKEYADLLRRADAIFIEELRNFRDAETGKTWYDLTSQAFTVFLPVKSVGVMGDGRTYDYVVALRAVQTSDFMTADWAELPYALLKKVSSRIINEVRGINRVTYDVSSKPPATIEWE

SEQ ID NO: 30908 - protein, 261 aa, Ostreococcus tauri
MPPRTVKPREAETRASAPVDAHAEMNLTVLRASDASIESIVAQSKHCVLYGFDVNSRSWVRKSVEGALFVVRRSSAPRDAFVVLNRAGSENFTREIGGEAFELERSPPYLMYRVGREVHGIWFHDESECETMCEAFERVMSGSSVGSVSAGGSIDERATSDSLSALFASASVSGGENPKRDVKASVVNGSNGTTVPRVLQPPRKVMGTSTEAPRATRSKSASVATTAMAVVKPAAVRAALLELIEDDTFIDRITKAIARHS

SEQ ID NO: 30909 - protein, 637 aa, Arabidopsis thaliana
LNQFGLIRNLTDVKVLSEWGILFLLFEMGLELSLARLKALAKFAFGMGLTQVLLCTAAFTAFELPPNGAIGTKILEFLFHSRPDLVNIRSIDEAVVIGAALSLSSSAFVLQLLAEKGELPTRFGSATLGILLLQDIAVVPLLVILPVLESQDIGGESIWPMLAKESAKALGGLGILSLGGKFFLRRIFEVVAETRSSEAFVALCLLTVAGTSLVTQWLGFSDTLGAFLAGALLAETNFRTQIEADIRPFRGLLLGLFFVTTGTSIDMEVLFREWPNVLSLLGGLIVIKTLIITAIGPRVGLTIQESVRVGFLLSQGGEFAFVVFSLANRLGVLPNELNKLLIIVVVLSMALTPYLNQLGRKAADFLDERLDPGEKIGEDVNFDVSESIVIIGFGQMGQVLANFLSTPLVSDSDLVGWPYIGFDLNPAVVKESRKLGFPILYGDGSRPSVLQSAGVSSPKAIMIMYKGKKRTTEAVQRLRLAFPGSPIYARAQDLPHLLELKKAGATDAILENAETSLQLGSKLLTGFGVMSDDVSFLSKVFRDSMEIQAQEEITASETNAGLKPMQMKASDINVVSAATQKQVQLMKPMQMKASDSNSDSAAEILQETAGLSQPPEIDDSSVNIDNGFVGKADKAQD

SEQ ID NO: 30910 - protein, 482 aa, Schoutenia glomerata
  misc_feature (3)..(3): Xaa can be any naturally occurring amino acid
  misc_feature (8)..(9): Xaa can be any naturally occurring amino acid
  misc_feature (481)..(481): Xaa can be any naturally occurring amino acid
EKXNLGRXXQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVGNIDEATAKATNLEMESKXK

SEQ ID NO: 30911 - protein, 575 aa, Gibberella zeae PH-1
MAADLANRIGELNPFSSKNKHLNDEDYGEEIDNNTVAGGGHTGRRIVTDLRVSSALREFIANEKILSKKEAGVKSDDASRALLELVSKPHIRVPPELTDRSHPLPEYYISSSHNTYLMAHQLYGSSCATAYETAIKTGARCVEIDAWDNGDNKDEPKVTHGYTLVSNISFRAVCETIRDSADQEELDSRKLGFRPSPILLSLENHCDAYGQMRLVNIMQEVFGHRLLSKAVREIGHNEQAGSGDHVRLEDLGAKIAVIVEYHFPGEPSDSDSHSDDASDGEEEKAARKEYKEKKNDEVCSVIIPELAELGVYAQSVKPVDNSWYEEGTLTNGPHHHLINVSESGLAKHLPEHTSAISRHNAQHLMRVFPKGTRISSTNLKPVPYWGIGAQICALNLQRFGASNQLNEALFSGTDGYVLKPAALRAGGNGKLSTGRSKRLRLHVAGATDVPLGEDSTKPYLTCTLHHPDDLKNEPPKRKTEPYKQHKLEFLHRGPNPPPTDPLWDETLTWEYEDNELVFLRMLIKSDDSWAVNPIYAVAAVRLLYVVPGWSFIRMLDPKGHETQCSILVNFEIMDA

SEQ ID NO: 30912 - protein, 551 aa, Magnetospirillum magnetotacticum MS-1
MDAQVKPGHDEQRVMPMSVIKSSVNPRSDEFKANAEATQDLVDDLKKVVAQVKMGGGQAMRERHIARGKLLPRERIRRLLDVGSPFLEFSQLAAWDMYSKDVMGAGIITGIGSINGQECMIVANDGTVKGGSYYPLTVKKHLRAQDIAKENNLPCVYLVESGGANLPNQDEVFPDRDHFGRIFYNQAQMSALGIPQISVVHGSCTAGGAYIPAMSDESVIVRNQGTIFLGGPPLVKAATGEVVSAEELGGADVHCRVSGVTDHYAQDDGHALAIARRIVGNLNRTKPTSLKMAAPEEPLYDPKEIYGIIPKDRRKPYDVREVIARIVDGSRLDEFKQTYGTTLVCGFAHIWGYPVGIVANNGILFSESAQKGAHFVELCSQRGIPLIFLQNITGFMIGKKYEAGGIAKDGAKMVTAVACAKVPRFTVIMGGSFGAGNYGMCGRAYQPRMLYMWPTGRVSVMGGEQAANVMAQIKKDAMEAKGQSWPAEEEEAFKAPIRDQYETQGHPYYAGARLWDDGLVDPAETRMVLALSLSASFNAPIEPTKFGVFRM

SEQ ID NO: 30913 - protein, 342 aa, Porphyromonas gingivalis W83
MKQKILVTGGTGYIGSHTTVELQQAGYRVVSVDNFSNSNAAVLDGIARITGVRPDFYEADCNDTEAMERVFTAHPDIAGVIHFAASKAVGESVQKPLLYYRNNILSLLNILELMERFGTRGIVFSSSCTVYGQPEVLPVTEEAPIQEALSPYGNTKQINEEIIRDAIHAGAGYKAILLRYFNPIGAHPTAHIGELPNGVPQNLIPYLTQTAAGIRAELSVFGDDYDTPDGSCIRDYIYVVDLAKAHVAAIERMLNEEKASDSLEVFNIGTGRGVSVLELIRTFERVTGVAVPHRIVGRREGDIEQVWAEPKKANEVLGWKALESLEDTLLSAWRWQQRLSEK

SEQ ID NO: 30914 - protein, 297 aa, Vitis vinifera
MMLFLLQVIIPGPFYVSYPEMARLADATPVILPTLISNNFRLDPEVLKSTISEKSRVLILCSPSNPTGSVYPKKLLEEIADIVAKHPRLLVIADEIYEHIIYAPAIHTSFASLPGMWERTLTVNGFSKTFAMTGWRLGYLAGPKHFVAACGKIQSQVTSGASSISQKAGVAALGLGYRGGEAVAKMVKAFEERRDFLVESFRELGGVKISEPQGAFYLFLDFSSYYGAEAEGYGIIKDSESLCKYLLDKAQVALVPGDAFGDDKCIRISYAASMSNLQAAMERIKGAIVHLKATVPA

SEQ ID NO: 30915 - protein, 302 aa, Antirrhinum majus
MVSSHRSLMEQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEETWPGVTSLPDFKSAFPKWPAKELAAVVPNLDASGLDLLDKMLRLDPSKRITARNALQHEYFKDIGFVP

SEQ ID NO: 30916 - protein, 247 aa, Magnaporthe grisea 70-15
MGESRQELVQWLNSLLQLNITKVEQCGTGAALCQVFDSIFLDVPMSRVKFNVNSEYAYIQNFKVLQNTFTKHQVDKPIPVAGLVKCKMQDNLEFLQWVKRFWDQYYPGGEYDAVARRKGAPLGAAGGGGGGAAVRAPVAGGAARRAGGTTPTTGAARAGLGVSKANPALAQENATLKETVVGLERERDFYFSKLRDIELLVQNAVEEDPEIEKQEDGLVKQIQAILYSTEEGFEIPAEGEVDDQETF

SEQ ID NO: 30917 - protein, 402 aa, Prochlorococcus marinus str. MIT 9312
MSKLSLSSLDKTNLEGKKVLVRVDFNVPLNEDGQITDDTRIRAAIPTIEYLINHSAKVILAAHFGRPKGQVNEKMRLTPVAARLSELLGQNVALTNSCIGDEAVAQSNSLSNGDVLLLENVRFFGEEEKNDLEFAKKLASHADMYVNDAFGAAHRAHASTQGVTNYLSPSVAGFLLEKELKYLQGAIDSPKRPLAAIVGGSKVSSKIGVLDSLLDKCDKIMIGGGMIFTFYKARGLDVGKSLVEEDKLELAKDLEAKAKAKGVELLLPTDVVLADEFSPDANSKISQIDSISGNWMGLDIGPDSIKVFQNALAECKTIIWNGPMGVFEFDKFADGTNAIATTLADLSAFSEVCTIIGGGDSVAAVEKAGLAEKMSHISTGGGASLELLEGKTLPGVAALNDA

SEQ ID NO: 30918 - protein, 299 aa, Staphylococcus kloosii
GFGRIGRLAFRRIQNVDGIDVVAVNDLTDDEMLAHLLKYDTMQGRFTGEVEVEENGFRVNGQEVKSFSEPDPSKLPWGDLDIDVVLECTGLFADKDKASAHIDAGAKKVLISAPATGDLKTIVYNTNHNELDGSESVVSGASCTTNSLAPVAKVLNDEFSLVEGLMTTIHAYTGDQSTQDAPHRKGDKRRARAAAENIIPNSTGAAKAIGLVIPEIDGKLDGGAQRVPVATGSLTELTVVLEKDVSVEDVNNAMKNASNESFGYTEDEIVSSDVIGMTYGSLFDATQTRVMTVGDSSIS

SEQ ID NO: 30919 - protein, 457 aa, Bacillus subtilis subsp. subtilis str. 168
MNSSIPSIISKHKAYFAAGHTRPLESRLNILRKLKQAVRTHEADLIAALYQDLHKSEQEAYSTEIGIVLEEISFVMKRLRKWSKPKRVKTPLTHLGSKSIIIPEPYGTVLVIAPWNYPLQLALSPLIGAIAAGNTVVLKPSEYTPAVSAILSKLISSVFPTDYVAMAEGGPDVSTALLQQPFDYIFFTGSVAVGKIVMEAAAKQLIPVTLELGGKSPCIVHKDADIQLAAKRIVFGKFTNAGQTCIAPDYLFVHEDIKTKLTEEMKRAIREFYGPQPERNPQYGKIVSERHYQRLLSFLNDGIPLTGGQSDPNHHKIAPTILEQVRDDSPVMQEEIFGPILPLFTYRNIGEVIEKVQSRPKPLALYLFTTNKEIERAVLGNLSFGGGCVNDTLMHVATPYLPFGGVGESGIGSYHGFDSFNTFTHKKSVVKQTNRFDFAFRYPSSKNGLRMIRKILK

SEQ ID NO: 30920 - protein, 304 aa, Porphyromonas gingivalis W83
MKHIVSIDQCSAEDILRILDRAELFEKNPNRHLLEGKVVATLFFEPSTRTRLSFETAVNRLGGRIIGFSDASTSSSTKGESLKDTISMVGNYADLIIMRHYLEGAARYASEVSRVPVVNAGDGANQHPSQTLLDLYSIRKTQGTLYDRTIAMVGDLKYGRTIHSLIEGMSHFRPRFIFVAPEELSLPEEYKQFCREHDLPYTETKHFDEEVINNCDILYMTRVQRERFTDLEEYERVKDVYVLTNAMLSDSRPNLRVLHPLPRVGEIAYDVDDNPKAYFIRQALNGLYTRQSIICEVLGIDVAN

SEQ ID NO: 30921 - protein, 311 aa, Staphylococcus lugdunensis
GFGRIGRLAFRRIQDVEGIEVVAVNDLTDDDMLAHLLKYDTMQGRFTSEVEVVDGGFRVNGKEVKSFEEPDASKLPWGDLGVDVVLECTGFYTDKEKAEAHIHAGAKKVLISAPAKGDVKTIVYNTNHSDLDGSETVVSGASCTTNSLAPVAKVISDEFGLVEGLMTTIHAYTGDQMTQDGPHRKGDKRRARAAAQNIVPNSTGAAKAIGKVIPEIDGKLDGGAQRVPVATGSLTELTVVLEKQDVTVEQVNEAMKKASNESFGYNEDEIVSSDVVGMTYGSLFDATQTRVMSVGGRQLVKVAAWYDNEMS

SEQ ID NO: 30922 - protein, 310 aa, Staphylococcus saprophyticus
GFGRIGRLAFRRIQNVDGIDVVAVNDLTDDEMLAHLLKYDTMQGRFTGEVEVEKDGFRVNGQEVKSFSEPEPSKLPWKDLDIDVVLECTGFFADKEKAEAHINAGAKKVLISAPATGDLKTIVYNTNHQELDGSETVVSGASCTTNSLAPVAKVLNDDFGLVEGFMTTIHAYTGDQSTLDAPHRKGDKRRARAAAENIIPNSTGAAKAIGLVIPEIDGKLDGGAQRVPVATGSLTELTVVLEKNVSIEDVNAAMKNASNESFGYTEDEIVSSDVIGMTYGSLFDATQTRVMTVGDRQLVKVAAWYDNEMS

SEQ ID NO: 30923 - protein, 310 aa, Staphylococcus sciuri
GFGRIGRLAFRRLQEVENIEVVAINDLTDDAMLAHLLKYDSTQGRFKDEVEVIEGGFRVNGREIKTFENPNPKELPWGDLDIDVVLECTGFFADKDKASAHIEAGAKKVLISAPASGDLKTIVYNVNHDELDGSEEIVSGASCTTNCLAPMAKVLNDEFGIVEGLMMTIHAYTGDQNTLDAPHAKGDFRRARAAAQNIVPNSTGAAKAIGLVIPELKGKLDGSAQRVPVATGSVTELTAVLDKEVSVEEINAAMKNATNDSFGYTEDEIVSSDIIGITYGSLFDATQTRVMTVGDRQLVKTAAWYDNEMS

SEQ ID NO: 30924 - protein, 56 aa, Glycine max
MKTFDPWPVFFRREWKRNWPFLTGFAITGFIITKMTANFTEEDLKNSKLVQEHKKR

SEQ ID NO: 30925 - protein, 310 aa, Staphylococcus delphini
GFGRIGRLAFRRIQDVENIDVVAVNDLTDDDMLAHLLKYDSTQGRFTEEVEVIDGGFRVNGKEVKSFSEPEPKNLPWGELDIDVVLECTGFFTDKEKAEAHIEAGAKKVLISAPAKGDLKTVVYNVNHEILDGTETVVSGASCTTNSLAPVAKTLQDNFGIVEGLMTTIHAYTGDQNTLDAPHRKGDKRRARAAAENIIPNSTGAAKAIGLVIPEIDGKLDGGAQRVPVATGSLTELTVVLEKEVSVEEVNKVMKEATNESFGYTEDEIVSSDVVGMTFGALFDATQTRVMTVGDRQLVKVAAWYDNEMS

SEQ ID NO: 30926 - protein, 307 aa, Cytophaga hutchinsonii ATCC 33406
MSQLSVKHLLGIKDLTTKDIELILETAGQFKEVINRPIKKVPSLRDVTIANVFFENSTRTRLSFELAQKRLSADTINFSAAASSVKKGETLLDTVNNILAMKVDMIVMRHASVGAPHFLAKHISANIVNAGDGTHEHPTQALLDSFSIKEKLGGVAGKKVCIFGDILHSRVALSNIFALQKQGAEVMVCGPSTLIPKFIGELGVKVEFDLRKALQWCDVANVLRIQLERQTIKYFPTLREYAQYYGINKQLLDSLNKEIVIMHPGPINRGVELSSDVADSGHSIILDQVENGVAVRMAVLYLLAGNK

SEQ ID NO: 30927 - protein, 318 aa, Burkholderia sp. 383
MAEIVVAGELLAEFVAAERGQGFDAPGLFEGPFPSGAPAIFADQAARLGARVAYAGCVGRDAFGDAIVARLERDGVDVARIRRVARPTGTAFVAYREDGSRSFVYTLSTSAAACVDAPDVDTAMFDGCRYFHVMGSSLTSESAIAAVQRGVIEAARAGAKVSFDPNVRPEMLSFRPMRAALDVMLDACHLFLPSEADLPFFCGPQPAERAIAGLLATHPLLERVVLKRGAQGSVAFDRANRAEAPAFQVDELDPTGAGDCFGGTLVASLVAGMPIEVALRRANAAGAIAVTRRGPMEGNSSAAEIDRFLTERGIACPA

SEQ ID NO: 30928 - protein, 697 aa, Robiginitalea biformata HTCC2501
MKSFRTELENPVVEKDIVELERKIRQFREGELNEEKFRSLRLARGVYGQRQPGVQMVRIKLPYGKVTARQLHRIADVSDTYSTGILHITTRQDIQIHYVDLDRTPELWAELERDAVTLREACGNTVRNVTASETAGIDPGEPFDVSPYAQALFEYFLRNPVGQEMGRKFKVSFSASDADTGLSYMHDLGFIARVEAGRRGFKVLVGGGLGAQPRHADVLYEFLPQEQIIPLMERVLRVFDRYGERKSRAKARMKFLIRDIGLDRFRELLAEETPGIPVREYPIDAEAYPQPRPASTPPDIPVPADMEAYQAWKRTNTIRQKQDGYVAVGLRVFLGNFTTRQARQLADLVARYAASEIRLSLRQNILIPFVREAWLPYFHNELEKIGLAQPGYNTAADITACPGTDTCNLGIASSTGIATELERVIAAEYPDFIHNPDVVIKISGCMNACGQHNMAHIGFQGMSVRTRDKRVAPALQVLLGGGNRGGGEGIFADKVIKIPSKRGPQALRIILDDYLENGGGQPYDRYYQEQGQHYFYDKLKPLSDVSDLTPEDFIDWGTDKKYEKAIGIGECAGVVIDLISTLLLEAEEKLEDAQKALEAGKWAASIYYAYSAQIHAAKALLTSEDVAVNSHAAILKDFDTHFIDQPRGFGNDSFRQAVLRMNRHAPDAGFAREYLEQARNFLSEASAFRQKELSHAS

SEQ ID NO: 30929 - protein, 431 aa, marine gamma proteobacterium HTCC2143
MTFASLGLSAPILDAVADQGYDTPSPIQAQAIPAVIGGKDVMAAAQTGTGKTAGFTLPILELLIPGKLAQANQARVLILTPTRELAAQVGESVATYGKNLPLRSAVVFGGVKINPQMMKLRQGVDVLVATPGRLLDLYNQRAVKFDHLEVLVLDEADRMLDMGFIHDIKKILAVLPKKRQNLLFSATFSNDIRGLAKGLVNNPVEISVSPANTTVESVQHWIYPVDKNQKSKLLIHLIQDNQWSQVLVFSRTKHGANKLAKQLDGAGINAAAIHGNKSQGARTKALADFKGGKVQVLVATDIAARGLDIEQLPHVVNFDLPNVPEDYVHRIGRTGRAGATGEAVSLVSADEFKQLSDIERLIGELLQRQSVDGFKPVNELPESRLNRRPQTPSRPKKAKVGHRDGQRSGENSQGHRTRGRNNSAQRPSGNR

SEQ ID NO: 30930 - protein, 379 aa, marine gamma proteobacterium HTCC2143
MGPGPSDVSPRVLEALSRPTIGHLDPEFIGLMDEIKTLLHYAFKTNNELTIPVSAPGSAGMEACFVNLVSPGDKVIVCQNGVFGGRMKENVERCGGVAIMVEDSWGSPVDADKVKAAFSNNTDVKILAFVHAETSTGVESDAATLCRLAAENNALSIVDTVTSVAGIDVDVDGWGADAVYSGTQKCLSCVPGISPVTFSARAVEVISNRQHKVQSWFLDMQLVMGYWGGNTKRAYHHTAPVNAMYALHESLIMLKEEGLENSWARHQLNHRALVSGLEAMGLSMVVDAAHRLPQLNLVSIPEGADDAAVRGALLSQYSLEIGAGLGALAGNSWRIGLMGHASNQKNVLLCLSALDNVLTAQGAKIVSGVAVAAALAEYG

SEQ ID NO: 30931 - protein, 594 aa, Ostreococcus tauri
MALTTRSVTSMARVRARAHVFARAGDRASRRGARAGLVDARRATRGAGDEPAVMAIGRESLERRLEAPMVGLGTWKAAPNAVRDAVASALRVGVRHIDCAAAYGNEHEVGVALAEAFERGDVAREDVFVTSKLWNDRRRPGDVREALETTLRDLRLEYVDLYLIHWPVCWRRGTVLQPDAEASIAECWGELERLVQEGKARRIGVSNFDEVQLAALLDDPRTKIKPACNQIESHPMWSNDDLVRFTQSRGVRVVAYSPLAQGGSLFTHPLMVRLAKKYGKTPAQIALRWNVQRDVIVIPKSTSAERIKSNCDIFDFELSEEDVLEMKILDVGKSTATAPWSHFAPVASRNRWLRPLGRVLSWLPSKFIAIDVQRIGRSGFISLRAPWSVVYTFGSYFGSNQASVLGACSTMSPVKGHTNPFPGRTCNGSAERIISARSNAWIQESSAANISNPPRLGGLGGRAFGSTGASFSSCFSLAASSSSNSASARGGVISSAVSGDSSHDTSQSGDLVSKISFLGDARFVGVGVVASAFVSSRSRARSAASKRSLARVSSASTALRRSRVDASLIIVLAVAATSFNAQARVARSFSLAFC

SEQ ID NO: 30932 - protein, 70 aa, Saccharomyces cerevisiae
MIVPVRCFSCGKVVGDKWESYLNLLQEDELDEGTALSRLGLKRYCCRRMILTHVDLIEKFLRYNPLEKRD

SEQ ID NO: 30933 - protein, 1385 aa, Staphylococcus aureus subsp. aureus Mu50
MLNRENKTAITRKGMVSNRLNKFSIRKYTVGTASILVGTTLIFGLGNQEAKAAESTNKELNEATTSASDNQSSDKVDMQQLNQEDNTKNDNQKEMVSSQGNETTSNGNKSIEKESVQSTTGNKVEVSTAKSDEQASPKSTNEDLNTKQTISNQEGLQPDLLENKSVVNVQPTNEENKKVDAKTESTTLNVKSDAIKSNAETLVDNNSNSNNENNADIILPKSTAPKSLNTRMRMAAIQPNSTDSKNVNDLITSNTTLTVVDADNSKTIVPAQDYLSLKSQITVDDKVKSGDYFTIKYSDTVQVYGLNPEDIKNIGDIKDPNNGETIATAKHDTANNLITYTFTDYVDRFNSVKMGINYSIYMDADTIPVDKKDVPFSVTIGNQITTTTADITYPAYKEADNNSIGSAFTETVSHVGNVEDPGYYNQVVYVNPMDKDLKGAKLKVEAYHPKYPTNIGQINQNVTNIKIYRVPEGYTLNKGYDVNTNDLVDVTDEFKNKMTYGSNQSVNLDFGDITSAYVVMVNTKFQYTNSESPTLVQMATLSSTGNKSVSTGNALGFTNNQSGGAGQEVYKIGNYVWEDTNKNGVQELGEKGVGNVTVTVFDNNTNTKVGEAVTKEDGSYLIPNLPNGDYRVEFSNLPKGYEVTPSKQGNNEELDSNGLSSVITVNGKDNLSADLGIYKPKYNLGDYVWEDTNKNGIQDQDEKGISGVTVTLKDENGNVLKTVTTDADGKYKFTDLDNGNYKVEFTTPEGYTPTTVTSGSDIEKDSNGLTTTGVINGADNMTLDSGFYKTPKYNLGNYVWEDTNKDGKQDSTEKGISGVTVTLKNENGEVLQTTKTDKDGKYQFTGLENGTYKVEFETPSGYTPTQVGSGTDEGIDSNGTSTTGVIKDKDNDTIDSGFYKPTYNLGDYVWEDTNKNGVQDKDEKGISGVTVTLKDENDKVLKTVTTDENGKYQFTDLNNGTYKVEFETPSGYTPTSVTSGNDTEKDSNGLTTTGVIKDADNMTLDSGFYKTPKYSLGDYVWYDSNKDGKQDSTEKGIKDVKVILLNEKGEVIGTTKTDENGKYRFDNLDSGKYKVIFEKPTGLTQTGTNTTEDDKDADGGEVDVTITDHDDFTLDNGYYEEETSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGNENSGSNNATLFGGLFAALGSLLLFGRRKKQNK

SEQ ID NO: 30934 - protein, 1141 aa, Staphylococcus aureus subsp. aureus Mu50
MINRDNKKAITKKGMISNRLNKFSIRKYTVGTASILVGTTLIFGLGNQEAKAAENTSTENAKQDDATTSDNKEVVSETENNSTTENDSTNPIKKETNTDSQPEAKEESTTSSTQQQQNNVTATTETKPQNIEKENVKPSTDKTATEDTSVILEEKKAPNYTNNDVTTKPSTSEIQTKPTTPQESTNIENSQPQPTPSKVDNQVTDATNPKEPVNVSKEELKNNPEKLKELVRNDNNTDRSTKPVATAPTSVAPKRLNAKMRFAVAQPAAVASNNVNDLITVTKQTIKVGDGKDNVAAAHDGKDIEYDTEFTIDNKVKKGDTMTINYDKNVIPSDLTDKNDPIDITDPSGEVIAKGTFDKATKQITYTFTDYVDKYEDIKARLTLYSYIDKQAVPNETSLNLTFATAGKETSQNVSVDYQDPMVHGDSNIQSIFTKLDENKQTIEQQIYVNPLKKTATNTKVDIAGSQVDDYGNIKLGNGSTIIDQNTEIKVYKVNPNQQLPQSNRIYDFSQYEDVTSQFDNKKSFSNNVATLDFGDINSAYIIKVVSKYTPTSDGELDIAQGTSMRTTDKYGYYNYAGYSNFIVTSNDTGGGDGTVKPEEKLYKIGDYVWEDVDKDGVQGTDSKEKPMANVLVTLTYPDGTTKSVRTDANGHYEFGGLKDGETYTVKFETPAGYLPTKVNGTTDGEKDSNGSSITVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNMTLDSGFYKTPKYSLGDYVWYDSNKDGKQDSTEKGIKDVKVTLLNEKGEVIGTTKTDENGKYRFDNLDSGKYKVIFEKPAGLTQTVTNTTEDDKDADGGEVDVTITDHDDFILDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSTTKDHHNKAKALPETGSENNGSNNATLFGGLFAALGSLLLFGRRKKQNK

SEQ ID NO: 30935 - protein, 777 aa, Oryza sativa
  misc_feature (755)..(755): Xaa can be any naturally occurring amino acid
MAGVLRLAGAARSPLARALAPAARRMGASAAAAMEDEAYWTEWEEEEEKARARESAPVAEMCPTGGGGGGPQWVVMGRPGPQKHAHAARLAEVLAVPYISMGTLVRQELSPASSLYKKIANSVNEGKLVPEDIIFGLLTKRLEEGYNKGETGFILDGIPRTHMQAEILDEIVDIDLVLNFKCADNCFMKRRFGGDICPHCGQLFDFSKTASSDRNPSLGSCTWPSQVQHAAVLGLEDSRMEKMRAYAEQVTWALRIVVKQRLWSDYLHSSLVAVHDEPLFLSQLKVDAKRKPQHKKTKPQPRRRERQAKPPHFPAAAAAVTAAAMETVETLVAHIQGLSGSGEELAHLHNLLRQADGEPLRAHSAALLPFLAQLHPSAHSLGFLYLLEAFASSASNLRAQGGGDFLVTTADFLVSCSAEQIRLAPDKFLSVCRVFKNEVMQLNAPIRGIAPLRAAIRKIQTSSEELTPIHADYLLLCLLAKQYKAGLSVLEDDILEVDQPKDLFLYCYYGGMIYIGLKKFTIALDFLHNCLQCYAFLQAVTVPMSSLNAIAVEAYKKYILVSLIQNGQIPLLDKGESIFMVPSFPKYTSSTAQRNLKNHAQVYVDLSTCYSKGNYSELEEYIQLNAEKFQSDNNLGLVKQVLSSMYKRNIQRLTQTYLTLSLEDIASSVQLKTPKEAEMHVLRMIEDGEIHATINQKDGMVSCHEDPEQYKSCEMVEHIDSSIQRLMALSKKLSSIDENISCDPAYLMKFMDLMXTGRERGGRFDYDDFDSVPHKYF

SEQ ID NO: 30936 - protein, 198 aa, Triticum aestivum
  misc_feature (196)..(196): Xaa can be any naturally occurring amino acid
MPAPLAASWRRHASAAASSSTPRTLLLLVPVLILLVFVLSRAPDLTFSPATAASPRLPARLRPFDCYASPQASPVLASLVEGVPRPFLYSLADLGSLPDRPHRNIARLLKGKRFRKPDISQTIQELLAGEVGRGSGGGVVVDVGANVGMAAFAAAVMGFRVVAFEPVFENLQRICDGVYLNRVQDQVVVYHAAASXRV

SEQ ID NO: 30937 - protein, 175 aa, Triticum aestivum
  misc_feature (150)..(150): Xaa can be any naturally occurring amino acid
MAPAVMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFXDNLRQVQCVSFIAFRPPGCEESGKA

SEQ ID NO: 30938 - protein, 397 aa, Magnetospirillum magnetotacticum MS-1
MDSRFRLRSAPLKPANTILSSFGTTIFETMSRLAQAHGAVNLGQGFPEGLEPADVVAKASEALVSGPNQYPSMMGTPDLRQAIARHEARFYGVELDPMAEVMVTSGATEALAACLFGLIEPGDEVVLIEPLYDSYLPIIRRAGGIAKLVRVEPPHWELPRQALAEAFSPKTKLMILNTPMNPSGKVWTADELAFLAGLLERFDAYCVCDEVYEHLVYDGRRHVPLMTLPGLRPRCLKVGSAGKIFSLTGWKVGWVIAAPEVLVPVAKAHQYLTFTTPPNLQAAVAWGLGKEDSYYDGLAAMLAERRDRLATGLRGVGFEVMEAGGSYFLTADFRPLGFDGDDAAFCRHITEKAGVTAIPVSAFYQGGDVGHFARFCFAKTESAIDEAITRLRRYFRG

SEQ ID NO: 30939 - protein, 477 aa, Vitis vinifera
MGSFLSLAGPKSRTSEHDEGSQHETCKRQRMSSSFNEENPRLIPSLPDEISILILARLPRICYFDLRLVSRNWKATITSPELFNLRKELGKTEEWLYILTKVEEDRLLWHALDPLSRRWQRLPSMPNVVYEEESRKVSSGLWMWNMVGPSIKIADVIRGWLGRKDTLDQMPFCGCAIGAVDGCLYVLGGFSSASTMRCVWRFDPILNAWSEVTPMSTGRAYCKTGILNDKLYVVGGVSRGRGGLTPLQSAEVFDPCTDTWSQIPSMPFSRAQVLPTAFLADMLKPIATGMTSYMGRLCVPQSLYSWPFFVDVGGEIYDPETNSWVEMPIGMGDGWPARQAGTKLSVVVDGELYAFDPSSSLDSGNIKVYDQKEDAWKVVIGKVPICDFTDSESPYLLAGFHGKLHIITKDANHDIAVLQADLRDNLGFPPSTSPSCSAASSHEHSDLLAETETVVWKVIATRDFGTAELVSCQVLDI

SEQ ID NO: 30940 - protein, 118 aa, Vitis vinifera
MAGEELIELKFRLADGTDIGPNKYNPTTSVGSLKEKILAQWPKDKENGPKTINDMKLINAGKILENNRTLAESRLLVGELPGGVITMHVVVRPPLSDKNTEKQQDDSPKKSRCSCSIL

SEQ ID NO: 30941 - protein, 315 aa, Magnetococcus sp. MC-1
MSLHQKMRIFSGTANPELAERISDYLGTTLGEVTVRRFSDGEIFVQIDENVRGRDVFIIQPTSAPTNANLMELLIMVDALRRASAGHITAVIPYYGYARQDRKEAGRTPITAKLVADLLHAAGVQRTLTLDLHAGQIQGFFNMPVDNLYASPVLLEAIRAKGLDNVVVVSPDVGGVVRARGYAKRLNVDLAIIDKRRPAPNQAEIHHIIGEIAGKNCLIVDDMVDTAGTMCAAANALLEQGANSVYAACTHGVLSGPAIERIEKSAISHFMITDTIRLSERGLACEKIEVYTVANLLGEAIRRISDAESVSSLFV

SEQ ID NO: 30942 - protein, 189 aa, Zea mays
  misc_feature (18)..(18): Xaa can be any naturally occurring amino acid
MSSPSKRREMDLMKLACXACRMMSDYKVDMVNDGMQEFFVEFRGPNESIYQGGIWRVRVELPDAYPYKSPSIGFINKIYHPNVDEMSGSVCLDVINQTWSPMFDLVNVFEVFLPQLLLYPNPSDPLNGDAAALMMRDRPAYEQKVKEYCEKYAKPEDAGVSPEDESSDEELSEEENDSGDEEIMGKPDT

SEQ ID NO: 30943 - protein, 401 aa, Porphyromonas gingivalis W83
MTALPSITLLPNKEESVRRFHPWIFSGAIASISGNPAEGDPVHIFSSKHEPLGVGHYEKGSIAVRMLSFDVDTVLDVSFWEERLSAAFRLRSALGLIRYDDPRSKNTVYRLVHGEGDGLPGLIIDVYGHTAVMQAHSVGMHHARTDIAKALIATTAGLVDAVYYKSDSTLPFKAGLESADGFLIGSAQAEAEYENGLLFLPDWIKGQKTGFFIDQRENRALLEEYASGRKVLNMFCYSGGFSLYAMRGGAYKVHSVDSSARAVHLLEKNMALNFAGDDRHESYAADAFHFLDEMAVGAYDLIVLDPPAFAKHRKVLRNALIGYRKLNAVAFRKIAPGGVLFTFSCSQAVSREEFRLAVFTAAASAGRKVRILHQLTQPADHPINIYHPEGEYLKGLVLYVE

SEQ ID NO: 30944 - protein, 203 aa, Brassica napus
MSQSIQFSTPSRTPHLLHLPNSRFHRPLTSLSFRQFPLKYTSIRASSSPDLGSSSSSQVLHSPNGTGAAKPEERSVVATAVSTDTAAIDVDTVTEAELKENGFRSTRRTKLICTIGPATCGFEQLEALAEGGMNVARLNMCHGTREWHRDVIRSVRKLNEEKGFAVAIMMDTEGSEIHMGDLGGESSAKSEVLSSLFSISIRA

SEQ ID NO: 30945 - protein, 310 aa, Staphylococcus simulans
GFGRIGRLAFRRIQDVEGIDVVAVNDLTDDEMLAHLLKYDTMQGRFTEEVEVVDGGFRVNGKEVKSFEEPDASKLPWKDLDIDVVLECTGFYTSDEKAQAHIDAGAKKVLISAPATGDVKTIVYNVNQDTLDSSDVIVSGASCTTNSLAPVAKVLNDSFGLVEGFMTTIHAYTGDQNTQDGPHRKGDKRRARAAAENIVPNSTGAAKAIGKVIPEIDGKLDGGAQRVPVATGSLTELTVVLDKDVTIEEVNEAMKAASNESFGYNEDEIVSSDVVGMTFGSLFDATQTRVMTVSGRQLVKVAAWYDNEMS

SEQ ID NO: 30946 - protein, 430 aa, Prochlorococcus marinus str. MIT 9312
MKETIDFLIDTIEARQVLDSRGNPTVEAEVFLECGASGRAIVPSGASTGAHEAHELRDGGSKYMGKGVLNAVNKIHETISPALCGLSALDQTTVDKLMIEIDGTFNKSNLGANSILAVSLATARASANALDVPLYRYLGDPLSNLLPVPLMNVINGGAHAPNSLDFQEFMLVPHGVQNFSESLRMGTEIFHSLKSLLDKKGLSTAVGDEGGFAPNLSSSEEAGDLLLEAIQKAGFIPGEQVSLALDAASTEFYSDGIYKYEGKSLNSSEMISYLSRLVSNYPIVSIEDGLAEDDWEGWSELNKELGNKVQLVGDDLFVTNTERLRKGIMEKSANSILIKVNQIGTLTETLEAIELAKTSGFTSVISHRSGETEDTTIADLSVATRSGQIKTGSLSRSERIAKYNRLLKIEEELGNQARFAGALGLGPKNI

SEQ ID NO: 30947 - protein, 116 aa, Triticum aestivum
  misc_feature (31)..(31): Xaa can be any naturally occurring amino acid
  misc_feature (58)..(58): Xaa can be any naturally occurring amino acid
  misc_feature (86)..(86): Xaa can be any naturally occurring amino acid
DTWRVVGRTPGIFALQRQFWKGRCGSLRKLXRDVLGTKHIALAVHGRTYPAHRLIDDXLEDHVDVTKFTSSARAKGGLQFLSRRTXKGGCSCMCLLLSVVAIVILAVIVWLLVKYL

SEQ ID NO: 30948 - protein, 513 aa, uncultured marine gamma proteobacterium EBAC31A08
  misc_feature (460)..(460): Xaa can be any naturally occurring amino acid
MRLKIKKTGSFKNSQKYLKLIPNASVYDVALKSPITFALNISSKLGNKVFLKREDLQPIFSFKNRGAYNKIVNLSDAEKKRGVIAASAGNHAQGVASACKKLKINCLIVMPITTPEIKIKDVKRFGAKILQHGDNVDAALKEALFIAKKKKLSFVHPFDDPLTIAGQGTIGQEILEDKNNFDVVFVPVGGGGILAGVSAWIAQNNKKIKIVGVEVEDSACLAEAVKANKRVILKEVGLFADGVAVSRVGKNNFDVIKECVDEVITVSVDEVCTAVKDIFEDTRVLSEPAGALALAGLKAYARKVKNKKLIAISSGANVNFQRLNFIVERSEIGENREKILSIKIPEIPGSFLKLSRMFGSSQVTEFNYRKSSLSDAYVLVGVRTKTEKSFEILKSKLKKAGFTFSDFTRNEISNDHLRHMVGGRNSDSGSHNNERIFRGEFPEKPGALLNFLEKFGNKWXISLFHYRNLGSAFGKILIGIESKDKDKLINHLNKSGTIFTEETSNKAYKDFLK

SEQ ID NO: 30949 - protein, 2633 aa, Gibberella moniliformis
  misc_feature (1840)..(1846): Xaa can be any naturally occurring amino acid
MARAVEKVVTKAVIRSVAISRLMRRAKIHEINHSRTILTTARVIHEVRPNRMKNKSIMSMLLSLIKTFALRAHFLKGEIAAFDAPFFSITPAEAGGMDPQQRGLLENTYRALENAGCPMNKVLGTNTGVFIGCFTREYEAIMFKETEIQQRYFATGTGTTMLANRLSYFYDLHGPSISLDTACSSSLNACHLACNSLRLGECDMALAAGYNLFYNPDTIIPLTALGFLSPDGRCYSFDERANRYSRGEGFGMVVLKRLSDAIRDGDCIRAIVRGSSSNQDGNSPGITQPTRQAQVDLINAAYRSAGLSKTQTRFFEAHGTGTPVGDPIEASAISGAFLEYCSEQEPMVVGAVKTNIGHLEGSAGIAGLIKAIMVLEKGIIPPNMGFQTPNPKIPVHDWHLKFLTKPEAWPTKGLRRASINAFGYGGSNAHIIIDDAYHYLLVNTSSINGTNGINGHSNGINGHINGHHSASSSSDDEYILVKRFKGHAPPSRLFFFSTFDEAGAARMAKAYKEFLAPTSKSIVAGSEEEQRFLSDLSYTLINHRTSFPWRFSIVADSIAALADKLEANLSPVRTTAEPKLGFVFTGQGAQWYAMGREFLSAYPTFSTSIFAADLYLRELGCPWSLVGELLSNQDKSRIDDPALSQPICTALQVALVDLLASWGNKPAAVVGHSSGEIGAAYATGAISQESAWRLAFYRGALSSRLAKSPDYTNGAMLSVAMSSPDAMAYLEEHVGSAAGRDIVVACINSPRNVTLSGSAAYIDKIKAAADHEGIFARKLKVDNGYHSPLMATIADEYRSAIGDLKAGTNISPVQGAPVFYSSLGGTVSSVSALQNPDHWVDNLVSPVQFSKAFSLMCSNTTSSAPVKKLGSSAKATVKPPKITYVLEIGPHAALRGPIRETMELTPEVSGIGYESVLCRGASAVDTALSAANWLWCRGYEVDMSDASIAKDSSLVVNAPGYPFNHSNIYWNESRISKGYRFCPAMRHELFGAPVPDWDPANAVWRNYMRLSENPWVKHHRITGATIYPVAGMLVMAIEASRQMADITRVVKGFRILDARFNVALRVPATQNGLETHFYMQPSRDYSDTVARTVRKFSLSSYEGGEWREHCHGLVVTEYEQPYTVNRLADVEKASKVETSFRQLYEHLSTVGLDFGATFQTLRDIRCSDIGEAVATVERQDLESLMPLGYLQDHLIHSTVLDGILQSIIVSLTKGGREIDQVMVPSEIGDLWVSADPSTSKFDAVRVSCSGKFLGIRQAEARIVGMDVDTGKAVCTVDNFVITTVARSEGASSSDAARRLCFNLDYKVDPVLLDQETADKTLQPDAKCGATPQQAQLIQEVEMMCFLYIKRFWDRIYDENRDAKSVPYHKKYIAWIKYQLEKYDAGLIPHAMPEWRERAADVLIISQMETKLLTEGSAEGKLVVNVGRELPDILAGKSDALELLFKDKLVENVYRSGVGAEIGYDRMVAYIDALAHKNPALRVLEVGAGTGGATRPILKCLTTQGNGEIGTPRFSHYAFTDISIGFFENAREMFKDSAARMSFRALNIEDDLEQQGFSGPAEQYDVICAANVIHATKNLEATLSNARKLLKPGGKLILYEMTNTGMIRTGFAFGLLPGWWLSVEDFRQFTPLAAPSDWSRSLKASGFSGIDLHIYDFPDHRHQMVSVLICTALGNGSEENAPATSYSSSPIKIITCGVGSTSATQKSLATVLEKQATSLSTSIDVVNLHDAVADLKDLQQTRGIFLGDIKSDFLEHVQDDDYEAFRKLISSTKTLLWVNQGGGPSPKNPGADMVTGFARCMRAENPGLNFVTLSVDDLDSLDKTSSIILQILSSGGGNENXXXXXXXLSSGGGNENTFFEKDGAVYIPRITEANTVNHLIAAKTKGESARSETWQDASKDRALTLQCAVPGLLDSLQFQDDELYEKPLGPYDVEVRVHATGLNLLDVMIALGKVIGEAFGQECAGVVTRVGTDVDRVSVGDRVCGLLRGTFKTFARGSQWQFAKIPSSIDYAVAAAVPVVYTTAYYGLHDLARLQAGESILIHWGAGGVGQAAIQLAKAVGAEVFVTVGSIEKRDFLHEHYGIPLHHVLSSRDLSFVHGIKRLTDGRGVDVILNSTAGQTLRASWDCIAPYGRFIEIGKVDIFANAGLPMGPFKKSVTFSFFDIGLISLERGRLFSRVLQDVVDLLAKGSITPPQPLHVYSYSDIQEAFRIMQSGSHMGKLVLKAQDDDLVMVEPSRKPTYHFDPEASYLLSGGLGGLGRSAARWMASRGARNLILLSRSGTTRPAAQELMEELTDAGVTAAAPQCDVSDRAVLERVLSDCAKAMPPIKGCIQGSMVLKDSIFSNMSQEDYYTAVRPKVVASRNLHELLPQNLDFFILLSSASGVVGNRGQSNYCVGNTYQDSLARHRVALGLPGVAVDLGMILSVGFAAENQESMANLRQEGFNAMREDEFLALLDMLCDPNGKYSTNVNQQTQASSFAQIAVGLEAPATLRIKGIPEPAWMTDPLFKHLYQIRGEGDHEGEGDGEGSATSCSTLLPAAASLADAANIVSAAIVQKLCKALSSSERDIDVSKPLHSYGVDSLVAVELRAWFMKEVGSDVAVFDIMSGQSLEELAELAAKRSSFANFDDEKETE

SEQ ID NO: 30950 - protein, 212 aa, uncultured marine gamma proteobacterium EBAC31A08
MSGSKINVAKQAIEYIKNNLHPEMILGIGTGSTVNFFIEELKEHRHKFAGAVSSSDASSKLLNENGIEVFSLNDVVDIAYYIDGADEVSPENCLIKGGGGAHTREKIVASASNEFICIVDQSKMVNLLGAFPLPIEVIPESRSLVARKIISIGGIPTYRTGFITDQGNHILDISNMDISNPTEMEALINNIPGVVDNGIFAANKPKTVLVSK

SEQ ID NO: 30951 - protein, 106 aa, Cytophaga hutchinsonii ATCC 33406
MGKAVEITDANFEEIINTDQPVLVDFWAEWCGPCKMIGPVVEELAGDYAGKAVIAKLNVDENPVVSAKFGIRSIPTLLVLKKGEIVDKQVGVVPKSVLAQKIDAQL

SEQ ID NO: 30952 - protein, 207 aa, Xanthobacter autotrophicus Py2
MSDRILVLVRHGQSEWNLKNLFTGWRDPDLTEQGVSEAKRAGALLKAEGLKFDVAFTSDLTRAQKTLGLILGEMGQEGVPTTRNVALNERDYGDLAGLNKDDARAKWGDDQVHIWRRSYDIAPPGGESLRDTVARTLPYYVQEILPCVLRGQTTLVAAHGNSLRALIMTLEKLSPEGIMKRELNTGAPIVYKLAADSTVAEKRDLVA

SEQ ID NO: 30953 - protein, 217 aa, Salmonella enterica subsp. enterica serovar Typhi str. CT18
MNQTLLSSFGTPFERVELALDALREGRGVMVLDDEDRENEGDMIFPAETMTVEQMALTIRHGSGIVCLCITEDRRKQLDLPMMVENNTSAYGTGFTVTIEAAEGVTTGVSAADRVTTVRAAIKDGAKPSDLNRPGHVFPLRAQAGGVLTRGGHTEATIDLMTLAGFKPAGVLCELTNDDGTMARAPECIAFAGQHNMAVVTIEDLVAYRQAHERKAS

SEQ ID NO: 30954 - protein, 798 aa, Robiginitalea biformata HTCC2501
MEQIVKFLPAFGVLGLLFVLVKNAWVSKQEEGDAKMARIAKNIADGAMSFLKAEYKILSIFVAAVAVLLFFKGQNEAGSNGMVAVSFIVGAICSALAGFIGMKVATKANVRTTHAARTSLGKALEVAFAGGSVMGMGVVGLGVLGLSGLFMIYSAQGWGIDEVLNVLSGFSLGASSIALFARVGGGIYTKAADVGADLVGKVEAGIPEDHPLNPATIADNVGDNVGDVAGMGADLFESYVGSIIGTMVLGASFVVLPEFQGAFNGLGAVYLPLALAGAGIVMSIIGTFFVRVKDGGSPHKALNIGEFGSAALMLVVSYFLIGAMLPETWTEGGREFTSMGVFLATIAGLVAGLLVGKVTEYYTGTGTKPVNAIVRQSETGSATNIIAGLGVGMMSTAIPILLIAAAILVSHYFAGLYGIAIAAVGMLANTGIQLAVDAYGPISDNAGGIAEMAELPGEVRERTDKLDAVGNTTAAIGKGFAIASAALTALALFAAFMKTAKVTAIDVSQPDIMAGLLVGAMLPFVFSALSMNAVGRAAMSMIEEVRRQFRDIPELKAALAVMRKYDADISKASAADRKIFDEADGKAEYEKCVEISTKASIKEMVLPGLLAIAVPVAIGFIGGAEMLGGLLAGVTSAGVLMAIFQSNAGGAWDNAKKMIEEQGRKGTDAHKAAVVGDTVGDPFKDTSGPSLNILLKLISVVALVIAPSIALSSDGLAAYSEGSEVQKQLQVQMDENEDGTVTAYVTTTTSVDGEKTVEEVTFTGTEEDVKVSLENYTEAEASVEVQKDVKKVKKVVEE

SEQ ID NO: 30955 - protein, 175 aa, Robiginitalea biformata HTCC2501
MTNNDEVTFDVLIEIPKGSRNKYEYDFTLNKIRFDRTLFSSMMYPGDYGFVPETLALDQDPLDVLVLTTEPAYPMVVMKVRPIGVFHMTDEKGPDEKLICVPLNDPIWSLKGDISDLNPHRLKEIEHFFQVYKDLEEKKVDTGGWGNAEEAREIYRSCVRRYEDSEYKTIRKFMI

SEQ ID NO: 30956 - protein, 246 aa, Sporobolus stapfianus
MSRMMATTLLGGARVAGVSTVRQAPPRPAYFLPPQQQPATRSRLCLQAAPSSSQAYRNTTDEAKEATGNAKENVKGWAGEAKDQAQEKGGRVADQASDMAEQAKDKTKDVADDTSRMTDKASHQTKDAAREAGDKAGDVKDRAMEMGQEAADRTQEAAKTVKDRTGEAAQRTMDRAGEAKDQAVDGAKSTGEKVMEKTKEGANKAAETVQEAGEKAKQAAQGTWDSVTGQAEDAKNRVSQEKDKTL

SEQ ID NO: 30957 - protein, 335 aa, Zea mays
MAGVTATGMAGVPATFSSATAQIGGFLSKKPYAPPLWATHLSPMPCHTFSLGHRDDLSGMQLSGNKVRKLEFLMADAVAQGADCVITVGVDHVQLLVDKDPGLVGNLLVERLVGAHVDLVSKEEYGKIGSVALADLLKKRLLEEGRKPGYIEAIREIEQQIQQSSDVQFDDIVVACGSGGTIAGLALGSRLSSLNTKVHAFSVCDDPEYFYDYVQGLIDGLNSGFDSHDIVSMENAKGLGYAMNTAEELKFVKDIAASTGIVLDPVYSGKAVYGLLKDMAGNPAKWKGRKVLFIHTGGLLGLYDKADQLSSLAGSWRRMDLEDSVPRKDGTGKMF

SEQ ID NO: 30958 - protein, 284 aa, Chlorobium tepidum TLS
MKYKTLTPEEKRVIIDKGTERPFSGKYYLTKEKGVYQCKQCGADLFRSDAKFDSGTGWPSFDDAIPGAVRQETDRDGMRIEILCANCGGHLGHVFYNEGFTSKNARYCVNSVSLSFEPSDKPATATEKAVFAGGCFWGVEYHFKKMKGVLSTTVGYTGGKTAHPTYEQVCSGRTGHAEAIEVEFDPSVVSYEELAKLFFEIHDPTQVDRQGPDVGEQYRSAVFYQNDQQKKIAEALIEQLKKRGYDVVTSVEKGGEFWPAELYHQDYYEKTGHKPYCHIYQKRF

SEQ ID NO: 30959 - protein, 323 aa, Brassica napus
  misc_feature (249)..(249): Xaa can be any naturally occurring amino acid
  misc_feature (264)..(264): Xaa can be any naturally occurring amino acid
  misc_feature (274)..(274): Xaa can be any naturally occurring amino acid
MASSLTAQISCGTQPSAPSFSGLRRTCPKLDAAVSFSHHSFCNRVNSSIRLLSSSNRSPRGVVAMAGSGKFFVGGNWKCNGTKDSIAKLVSDLNSASLEADVDVVVSPPFVYIDQVKSSLTDRIEISGQNSWVGKGGAFTGEISVEQLKDIGCKWVILGHSERRHVIGEKDEFIGKKAAYALSEGLGVIACIGEKLEEREAGKTFDVCFDQLKAFADAVPSWDKVVVAYEPVWAIGTGKVASPQQAQEXVHVAVRDWLKKNVSXEEVASKTRIXYTRGSVNGGNCAELAKEEDIDGFLVGGASLKGPEFATIVNSATSKKVTA

SEQ ID NO: 30960 - protein, 432 aa, Oryza sativa Indica Group
MDHIFSTNAWLTIALVFIITLAAKVVRSSVTLPAEKTSKPRPPPEAKGAPLVGIIPAVLRRGLQAVIREQHRALGSVFTLRSLGLAVTFLVGPECSDHFFHAPEWEIAIDGLYEVTVPIFGKEVGYDIDLDTRNEQHRFFAKMLRPAKLRGHVLPMEYFGKWGECGVVDLMQEVDHVLMLIASRCLLGKEVRENMFDEVASLFHELMGGMHLISMFFPYLPTPGHRRRDKARAKLGEIFSQIVKTRKLSGRVEDDMLQDLIDSTYGDGRATTDTEVTGLLVALLFAGHHTSSTVAVWTALRLLTHPEHLRAVRAEQERLVAAAEQQRSHHGGGGGGGIDYGVLLQMDVLHRCIKEALRLHPVTPMILRRARRGFTVRDKEGGEYSVPAGRLLASPLVVNTLLPNIYLQGPSRVRPGPVRRREGGGQGRCRRP

SEQ ID NO: 30961 - protein, 444 aa, Lactobacillus reuteri
MAYIFRLPEMGEGLTEGDVASWLVKEGEAIKADDPLIEIQTDKSTTQLVSPVDGTVKKLFVKEDDHVEKGDKLAEIDDGKPGISTNVESEYDDDETDTGSEEATESEKSTAPAADSPSEDNSPKGGVAPLAEPNKLVMAMPSVRQYARDKGVDISLVQPSGNHGQVLKEDIDNFNGSAAPAKEEKSAAMSAKTAPVAAKTAGNTIKPWNAALEEREPMSNMRKIIAKTTRESKDISPHVTSFDEVEVSALMVSRKKYKAVAAEQDIHLTFLPYIVKALVATCKKFPELNASIDDSTQEIVYKHYYNVGILTNTDHGLYNPNIKNADSKSMFEIAKEITENTQAAFDNKLSPESMAGRTISISNIGSIGGGWFTPVINQPDVAILGVGRIDKEPYVNEDGEIVVGRMMKLSLTYDHRLIDGGLAQHALNYMNKLLHDPELLMMEG

SEQ ID NO: 30962 - protein, 496 aa, Zea mays
MVLSHASSGRDDDAVASTFASRYVRERLPRYRMPERSIPREAAQQIISDELMLDGNPRLNLASFVTTWMEPECDKLIMDSINKNYVDMDEYPVTTELQNRCVNMIAHLFNAPIKEDETAIGVGTVGSSEAIMLAGLAFKRKWQNKRKEQGKPCDRPNIVTGANVQVCWEKFARYFEVELKEVKLSEGYYVMDPVKAVEMVDENTICVAAILGSTLTGEFEDVKQLNDLLTDKNKETGWDVPIHVDAASGGFIAPFLYPELEWDFRLPLVKSINVSGHKYGLVYPGVGWVIWRSKEDLPEELIFHINYLGTDQPTFTLNFSKGSSQIIAQYYQLIRLGFEGYRNIMQNCQDNAAILREGIAATGRFGVLSKDAGVPLVAFSLRDSSRFSVFDVSENLRRFGWIVPAYTMPADAEHVAVLRVVVREDFSRSLAERLVSDVRKILRELDARATHAVRVATATAEQSGDGVVAKKSVLEIEREVAARWMNAVNKKKTGVC

SEQ ID NO: 30963 - protein, 320 aa, Streptomyces coelicolor A3(2)
MAESVPRFDLITMGRIGVDLYPLQTGVPLAEVETFGKFLGGSASNVAVAAARLGRATAVITRTGDDPFGGYLHDALKEFGVDDRWVTPVAAYPTPVTFCEIFPPDDFPLYFYRRPKAPDLEIHPEELDLDAIRAASIFWMTGTGLSEEPSRTATLSALAHRAKSGTTVFDLDWRPMFWADPDQARPYYAEALAHATVAVGNLDECEIATGVREPRACAEALLAAGVELAVVKQGPKGVLAAHRDGRSAEVPPVPVEVVNGLGAGDAFGGSLCHGLLSGWELERIMRYANAAGALVASRLACSSAMPTEAEVDDLLARATP

SEQ ID NO: 30964 - protein, 397 aa, Vitis vinifera
MERLRNGYLFSEICRRELEHTQKYPHAKLIKLGIGDTTEPIPDIITSAMAEHAHALSTIRGYRGYGAEQGNMELRNAIAQTFYRDMGIKANEVFVSDGAQCDISRIQMLLGSNVTVAVQDPSFPAYMDSSVIIGQSGNFKEETGKYENILYMNCGPESNFFPDLSNTPRTDIIFLCSPNNPTGHAASRQQLEQLVEFAKANGSIIIHDSAYAAYITDESPRSIFEIPGGREVAIEISSFSKFAGFTGVRLGWTVVPEELLYSNGFPVIKDYNRIVCTCFNGASSIAQAGGLACLSSDGYLAMNAVLDYYKENAKIIMDTFTSLGLKVHGGKNAPYMWVHFPGLRSWDVFNEILEKTHIITVPGTGFGPGGEGYIRVSAFGQRESVIEASRRLKNLLK

SEQ ID NO: 30965 - protein, 536 aa, Bradyrhizobium japonicum USDA 110
MIAAKFQTFLILLAVLAGTALVARRFNIAPAILLMLSGVGLAFVPGMPPVELPPELVLLMVLPPLIYSASVAMSWREFRNNLRPIVLLAVGAVIFTAAMVAAATHYLIGLPWAIGFLLGAIVAPPDVVAPLAIARRLNIPRRLLVILEGEGLANDATALILYRFALAAIMVGHLSLPMAAGEFVLIIAGEIAFGIGVGWLSLRFRRWAKDQQVELTLSLITPYVSYWLPEHVGGSGVIATVACGLYVSWNGPLLISSATRLQGIFFWDLIIYLIEGLLFLLTGFQMRALYEKSKAFPLDDILIATAVVLTIIVTARFAWLYPATYLPRILSKSLRKRDPSPPWQWPFVLAFTGVRGAVSLAAALALPFTLPDGNAFPYRDLILFVAFGVIFVTLIGVGLTLPPVVRWLGVAEAGRNEHVAEHEAEIAARRQALDAALKSLDALTEAKEVSDEVMRLLRARHEIRVNQLPDSLDPTHHDVSAAGTALTRELIAAERKFIHDLLRDGQITDETRRRIERDLDLEEASLANREYRGVPL

SEQ ID NO: 30966 - protein, 411 aa, Asparagus officinalis
MNALAATSRNFKQAAKLLGLDPKLEKSLLIPFREIKVECTIPKDDGTLASFVGFRVQHDNARGPMKGGIRYHSEVDPDEVNALAQLMTWKTAVANIPYGGAKGGIGCSPGDLSLSELERLTRVFTQKIHDLIGVHTDVPAPDMGTNAQTMAWILDEYSKFHGYSPAIVTGKPVDLGGSLGRDAATGRGVLFATEALLAEYGKGISGQRFVIQGFGNVGSWAAQLITKAGGKVVAVSDVTGAIKHSNGLDIENLLKYSVKNRGIKGFSGGDAIDSNSLLTEDCDVLIPAALGGVINRENANDVRAKFIIEAANHPTDPEADEILSKKGVCILPDILANSGGVTVSYFEWVQNIQGFMWDEEKVNSELKTYMTKGFKHVKEMCKTHNCDLRMGAFTLGVNRVARATLLRGWEA

SEQ ID NO: 30967 - protein, 369 aa, Magnetococcus sp. MC-1
MALQCGIVGLPNVGKSTTFNALTAAGAESANYPFCTIEPNVGVVVVPDPRLDALSAIVNPQRVLPTTMEFLDIAGLVAGASKGEGLGNQFLGHIRQVDAIVHLVRCFEDDDITHVANSIDPLRDIEIIDTELILADMASAEKRYNSVVKKAKSGDKESKIQADALEKVIAGFNAGKPMRNLDLSKEEQATLAELFFLTNKPVLYLCNVSESLVAAAQTPGSHALVDQVREHAKGEGAEVVAVCGSIEAEIAELEGDEKAAFLEDLGLHESGLDRLIQAAYRLLGLQTYFTAGVKEVRAWTVKQGATAPEAAGVIHTDFQKGFIRAEVTSYDDFIACKGEAGAKEKGKLRLEGKEYRVADGDVMHFRFNV

SEQ ID NO: 30968 - protein, 239 aa, Vibrio cholerae O1 biovar eltor str. N16961
MKKTTWVLAMVASMSFGVQASEWGYEGEHAPEHWGKVAPLCAEGKNQSPIDVAQSVEADLQPFTLNYQGQVVGLLNNGHTLQAIVRGNNPLQIDGKTFQLKQFHFHTPSENLLKGKQFPLEAHFVHADEQGNLAVVAVMYQVGSENPLLKVLTADMPTKGNSTQLTQGIPLADWIPESKHYYRFNGSLTTPPCSEGVRWIVLKEPAHLSNQQEQQLSAVMGHNNRPVQPHNARLVLQAD

SEQ ID NO: 30969 - protein, 415 aa, Kineococcus radiotolerans SRS30216
MSPVTAQTSPPASTDVRPRVSARIAGIAESATLAVDAKAKALKAAGRPVIGFGAGEPDFPTPQAVVEAAVAACTDPANHRYTPAGGLPALREAIAAKTLRDSGYEVSPGQVLVTNGGKQAVYEAFAAILDPGDELLLPAPYWTTYPEAARLAGGVAVEVFAGLDQGYKVTVDQLEAARTPRTKALLFNSPSNPTGAVYTPEEVRAIGHWALEHGVWVVTDEIYEHLVYDGVRAASMPVEVPELADTCVVLNGVAKTYAMTGWRVGWLIGPADVVKGAGNLQSHLTSNVANVSQRAAVQALTGDLTAVARMREAFDRRRRTMVRMLDAVDGVDCPLPQGAFYAYPSVQGLIGKSLRGREITSSAVLAELILTEAEVAVVPGEAFGPSGFLRLSYALADEDLVTGVERIQALLSEVR

SEQ ID NO: 30970 - protein, 806 aa, Bacillus subtilis subsp. subtilis str. 168
MKKGIIRFLLVSFVLFFALSTGITGVQAAPASSKTSADLEKAEVFGDIDMTTSKKTTVIVELKEKSLAEAKEAGESQSKSKLKTARTKAKNKAIKAVKNGKVNREYEQVFSGFSMKLPANEIPKLLAVKDVKAVYPNVTYKTDNMKDKDVTISEDAVSPQMDDSAPYIGANDAWDLGYTGKGIKVAIIDTGVEYNHPDLKKNFGQYKGYDFVDNDYDPKETPTGDPRGEATDHGTHVAGTVAANGTIKGVAPDATLLAYRVLGPGGSGTTENVIAGVERAVQDGADVMNLSLGNSLNNPDWATSTALDWAMSEGVVAVTSNGNSGPNGWTVGSPGTSREAISVGATQLPLNEYAVTFGSYSSAKVMGYNKEDDVKALNNKEVELVEAGIGEAKDFEGKDLTGKVAVVKRGSIAFVDKADNAKKAGAIGMVVYNNLSGEIEANVPGMSVPTIKLSLEDGEKLVSALKAGETKTTFKLTVSKALGEQVADFSSRGPVMDTWMIKPDISAPGVNIVSTIPTHDPDHPYGYGSKQGTSMASPHIAGAVAVIKQAKPKWSVEQIKAAIMNTAVTLKDSDGEVYPHNAQGAGSARIMNAIKADSLVSPGSYSYGTFLKENGNETKNETFTIENQSSIRKSYTLEYSFNGSGISTSGTSRVVIPAHQTGKATAKVKVNTKKTKAGTYEGTVIVREGGKTVAKVPTLLIVKEPDYPRVTSVSVSEGSVQGTYQIETYLPAGAEELAFLVYDSNLDFAGQAGIYKNQDKGYQYFDWDGTINGGTKLPAGEYYLLAYAANKGKSSQVLTEEPFTVE

SEQ ID NO: 30971 - protein, 307 aa, Bradyrhizobium japonicum USDA 110
MTGTSPSDFAKRLDKTADDTEALLGRLLADDILPDEIARPKRLMDAMRYSSLNGGKRLRPFLVVESAAVFGVPREAALLAGAALECIHCYSLIHDDLPAMDNSDLRRGRPTLHKKTDDATAILAGDGLLTLAFDIVTRDEIHRDANVRLLLTRALARCAGIGGMVGGQILDLAGEGRFGGNEPIDVARIQQMKTGALLRYGCIAGAILGQATAKEYQALDDYGRALGEAFQIADDLLDVEGDAAALGKPSGQDAALGKTTFVTQLGIEGAKQRVRDLLARADSAVSIFGDRAAVLQAAARFVAERKN

SEQ ID NO: 30972 - protein, 300 aa, Triticum aestivum
  misc_feature (242)..(242): Xaa can be any naturally occurring amino acid
MVKRAVQYAMVDAFTGEPFKGNPAAVCLLEDDDADDRWLQSIAAEFNVSQTAFLSRCDASSNSSTPRFRLRWFSPAVEVALCGHGTLASAHFLFTAVLAEQHDVVEFVTQSGILTARKVPPASSLPRVTKAEEGKPFIELDFPTGDVFVDCSSTHEHELPSIFQKAAPVVSVHRAAFTDDFIVELSSGEEVVEVVPNMEQLKKCAGRGVIVTGQAPPRSGYDFFSRFFSPKWGIDEDPVCGXSAHCAVAPYWARKLGKQKLTAFQVSKRTGTLYLEFNAANQRIKIQGQAVTVMVGTLLA

SEQ ID NO: 30973 - protein, 437 aa, Cicer arietinum
NSARVMTLKLGQVTTVVISSADMAKEVLLTHDLITSNRTVPDALSVLNHDQYSLSFMRVSPRWRDLRKICNYQLFSNKTLDSSQALRRRKLQDLLNDIERCSKVGEAVDVGKAAFKTTVNLLSNTFFSVDFVHSAKEAGEYKEIIVSILKEVGVPNVSDFFPMLKFLDLQGIRKRSIVSVKKVLSIFKRFVGERVKMREGTGSIGNDDVLDALLNMSSDGGKIEMDKDEIEHLLLNIFVAGTDTTTYTLEWAMAELIHNPEMMSKLKEELEKTVGKGIPVEETDIAKLPYMQAVIKETFRLHPPVPLLLPRRAEIDVKIGDYVIPKDAQILINAWVVGRDPTKWENPNVFIPERFLDSEIDIKGHHFELIPFGSGRRTCPGLPLAIRMLPLMLGSLVNCFDWKLEDGLNVEDFNKEDEFGITLEKSQPVRIVPTKLY

SEQ ID NO: 30974 - protein, 117 aa, Triticum aestivum
LHLGTIEQFAQKSRLVPVRNSRDIVDPRVRRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 30975 - protein, 128 aa, Kineococcus radiotolerans SRS30216
MAKLSTDELLDAFKELTLIELSEFVKKFEETFDVTAAAPVAVAAAGGAAGAPAEAAEEQSEFDVILESAGDKKIGVIKEVRALTSLGLKEAKDLVDGAPKPVLEKVAKDAAEKAKAQLEGAGATVTLK

SEQ ID NO: 30976 - protein, 336 aa, Streptococcus thermophilus LMG 18311
MAILVLGGAGYIGSHMVDRLVEKGQEKVVVVDSLVTGHRAAVHPDAIFYQGDLSDQDFMRKVFKENPDVDAVIHFAAYSLVGESMEKPLKYFDNNTAGMIKLLEVMNECGVKYIVFSSTAATYGIPEEIPILETTPQNPINPYGESKLMMETIMKWSDQAYGIKYVPLRYFNVAGAKPDGSIGEDHDPETHLLPIILQVAQGVREKIMIFGDDYNTPDGTNVRDYVHPFDLADAHLLTVEYLRKGNESTALDLGSSTGFSNLQILEAACKVTGKEIPAEKADRLRGDPDILIASSEKARTVFGWKPQFDNIDNIIASAWAWHSNHPKGYDDRGLLK

SEQ ID NO: 30977 - protein, 506 aa, Xanthobacter autotrophicus Py2
MNIPAFLASQHASPFKPRYGNFIGGAFVEPVNGRYFENISPITGKVVCEVPRSDEADIERALDAAHAAKKAWGRTPAADRALVLLKIADRLEANLDLLARAETWDNGKPIRETTAADIPLAIDHFRYFAACVRAQEGALSEIDHDTVAYHYHEPLGVVGQIIPWNFPILMAAWKLAPALAAGNCVVLKPAEQTPASILVLAELIADILPPGTLNIVNGFGLEAGKPLASSTRISKIAFTGETGTGRLIMGYASQNLIPVTLELGGKSPNIFFDDVAAKDDDFLDKAVEGFVMFALNQGEVCTCPSRALVQESIFEKFMEKALARVAAIKQGSPLDPATMIGAQASSEQMHKILSYIDIGRAEGAQVLAGGERSLLDGDLSEGFYVKPTVFFGTNNMRVFQEEIFGPVVSVATFKDEEEALSIANDTLFGLGAGVWTRDGSRAYRMGREIQAGRVWTNCYHAYPAHAAFGGYKQSGIGRETHKMMLDHYQQTKNLLVSYSPKKLGFF

SEQ ID NO: 30978 - protein, 436 aa, Psychrobacter arcticus 273-4
MTTVSTNDFDQQHLWHPYASLPPRYPNIMIDHADGIHIVTQDGTRLIDGMSSWWASVHGYNHPKLNAAIIEQLGKMAHVMFGGLTHQPAIDLGKKLLSIVPAGIDAIFYADSGSIAVEVALKMALQYQIAAKRPNKQQFASTHSGYYGDTWHAMSVCDPINGMHSLYGKQLPMQHFVAAPPMGFERDITQNERDELTAFFAKNSHQLAGFIIEPIIQGAGGMRFYSPEYLQLLRQLCCEHDVLLIADEIATGFGRSGKLFACEHANISPDIMTIGKALTGGYMTFAATLCTRSIADTISQSDYSALMHGPTFMGNPLACAVACASIDLILSYDIEARTENMHALMVEQLASAAKLEGVKEVRCLGAVAVIELDDAVDMPTFQSLLIEHGIWVRPFGKLVYIMPPYIITDSELITLCQALLKVVSIYLTQTSLSAKG

SEQ ID NO: 30979 - protein, 304 aa, Brassica napus
MYRTAASRARALKGSLSRSLRPARYASSSAVATSSSSSSPGFFSWLTGGSSSSLTSLDMPLQGVSLPPPLADLVEPSKLKITTLPNGLKIASEMSPNPAASIGLYVDCGSIYEAPYFHGATHLLERMAFKSTRNRSHLRLVREIEAIGGNTSASASREQMSYTIDALKTYVPEMVEVLIDSVRNPAFWDWEVNEELRKMKVEIAELAKNPMGLLMEAVHSAGYSGALANPLYAPESALDRLNGELLEEFMTENFTAARMVLAASGVEHEELLQVVEPLTSDLPNVPLQGEPISQYTGGDFPQHT

SEQ ID NO: 30980 - protein, 475 aa, Porphyra yezoensis
MVSTTKSTGSVTQIIGPVLDIAFPNGQLPKVFNALKVQSSEGTITCEVQQLLGDNKVRAVSMSSTEGLQRGVEVIDTGSPISVPVGTDTLGRIFNVLGEPVDNLGPVDSESTLPIHRPAPAFTKLETKPNIFETGIKVVDLLAPYRRGGKIGLFGGAGVGKTVLIMELINNIAKAHGGVSVFGGVGERTREGNDLYMEMKESKVIDADNLKESKVALVYGQMNEPPGARMRVGLTALTMAEYFRDINKQDVLLFIDNIFRFVQAGSEVSALLGRMPSAVGYQPTLATEMGALQERITSTTEGSITSIQAVYVPADDLTDPVPATTFAHLDATTVLSRNLAAKGIYPAVDPLDSTSTMLQPGIVGTEHYSTAQEVKSTLQRYKELQDIIAILGLDELSEEDRQTVSRARKIERFLSQPFFVAEVFTGSPGKYVSLEDAIKGFQMILKGNLDDLPEQAFYLVGDIDEAIQKADSMKD

SEQ ID NO: 30981 - protein, 482 aa, Burkholderia pseudomallei K96243
MSDSVAKPVDATFDQFGLAAEILKAIAEQGYTTPTPIQAKAIPVVLSGRDVMGAAQTGTGKTASFSLPIIQRLLPQANTSASPARHPVRALILTPTRELADQVAANVHAYAKHTPLRSAVVFGGVDMNPQMAELRRGVEILIATPGRLLDHVQQKTANLGQVQILVLDEADRMLDMGFLPDLQRILNLLPKERQTLLFSATFSPEIKKLASTYLRNPQTIEVARSNAAASTVTQIVYDVAEGDKQAAVVKLIRDRSLKQVIVFCNSKIGASRLARQIERDGIIAAAIHGDRSQSERMQALDAFKRGEIEALVATDVAARGLDIAELPAVINFDLPFNAEDYVHRIGRTGRAGASGDALSLCSPNERKQLADIEKLIKRTLSLETLALDLPRHRHDDRGGRRERDRDERRGAPAGRRSAGGERTHHPRREAPIDDFFLKPYVPSPSANQPDEAKPVQPEKKAPKQPLAALLGGFGMPRKTSSS

SEQ ID NO: 30982 - protein, 759 aa, Pseudomonas fluorescens Pf-5
MLNTLRKIVQEVNSAKDLKAALGIIVLRVKEAMGSQVCSVYLLDPETNRFVLMATEGLNKRSIGKVSMAPNEGLVGLVGTREEPLNLENAADHPRYRYFAETGEERYASFLGAPIIHHRRVVGVLVIQQKERRQFDEGEEAFLVTMSAQLAGVIAHAEATGSIRGLGRQGKGIQEAKFVGVPGSPGAAVGSAVVMLPPADLDVVPDKHVTDIDAELALFKSALEGVRADMRALSEKLATQLRPEERALFDVYLMMLDDASLGSEVKAVIKTGQWAQGALRQVVTDHVNRFELMDDAYLRERASDVKDLGRRLLAYLQEERQQTLVYPDNTILVSEELTPAMLGEVPEGKLVGLVSVLGSGNSHVAILARAMGIPTVMGLVDLPYSKVDGIQMIVDGYHGEVYTNPSDVLRKQFADVVEEERQLAQGLDALRDLPCITPDGHRMPLWVNTGLLADVARAQKRGAEGVGLYRTEVPFMINQRFPSEKEQLAIYREQLAAFHPQPVTMRSLDIGGDKSLSYFPIKEDNPFLGWRGIRVTLDHPEIFLVQARAMLKASEGLNNLRILLPMISGIHELEEALHLIHRAWGEVRDEGTDVPMPPVGVMIEIPAAVYQTKELARQVDFLSVGSNDLTQYLLAVDRNNPRVADLYDYLHPAVLQALQNVVRDAHAEGKPVSICGEMAGDPAAAVLLMAMGFDSLSMNATNLPKVKWMLRQVSMTKAKELLAEMMTIDNPQVIHSSLQLALKKLGLARMINPASSKTL

SEQ ID NO: 30983 - protein, 176 aa, Oryza sativa
  misc_feature (44)..(44): Xaa can be any naturally occurring amino acid
SCLVQILLVKLLPWKHYMHILVVCNEGKMNIERLKQLVDLVGKXHRLVLDLSCRKKDGRYAIVTDRWQKFSDVFVDEPTLKHLAAYADEFLVHGVDVEGKRLGIDEELVELLGRYSPIPVTYAGGVSTMDDLERIKRAGNSRVDVTVGSALDIFGGDLPYKDVVLWHKEQNMVSQP

SEQ ID NO: 30984 - protein, 494 aa, Staphylococcus aureus subsp. aureus Mu50
MEKKNKQIDRGDLKQNLSEKFVWAIAYGSCIGWGAFILPGDWIKQSGPIAASIGIVIGALLMILIAVSYGALVERFPVSGGAFAFSFLSFGRYVSFFSSWFLTFGYVCVVALNATAFSLLVKFLLPDVLNNGKLYTIAGWDVYITEIIIATVLLLVFMLVTIRGASVSGSLQYYFCVAMVIVVLLMFFGSFFGNNFALENLQPLAEPSKGWLVSIVVIVSVAPWAYVGFDNIPQTAEEFNFAPNKTFKLIVYSLLAASLTYVVMILYTGWLSTSHQSLNGQLWLTGAVTQTAFGYIGLGVLAIAIMMGIFTGLNGFLMSSSRLLFSMGRSGIMPTMFSKLHSKYKTPYVAIIFLVGVSLIAPWLGRTALTWIVDMSSTGVSIAYFITCLSAAKLFSYNKQSNTYAPVYKTFAIIGSFVSFIFLALLLVPGSPAALTAPSYIALLGWLIIGLIFFVIRYPKLKNMDNDELSRLILNRSENEVDDMIEEPEKEKTK

SEQ ID NO: 30985 - protein, 828 aa, Oryza sativa Indica Group
MAAAWAAGDLWVLAAAVVAGVVLVDAVVRRAHDWVRVAALGAERRSRLPPGEMGWPMVGSMWAFLRAFKSGNPDAFIASFIRRNKKKNGNLMVSMEEWHRFGRTGVYRTFMFSSPTILAVTPEACKQVLMDDEGFVTGWPKATVTLIGPKSFVNMSYDDHRRIRKLTAAPINGFDALTTYLSFIDQTVVASLRRWSSPESGQVEFLTELRRMTFKIIVQIFMSGADDATMEALERSYTDLNYGMRAMAINLPGFAYYRALRARRKLVSVLQGVLDGRRAAAAKGFKRSGAMDMMDRLIEAEDERGRRLADDEIVDVLIMYLNAGHESSGHITMWATVFLQENPDIFARAKAEQEEIMRSIPATQNGLTLRDFKKMHFLSQVVDETLRCVNISFVSFRQATRDIFVNGYLIPKGWKVQLWYRSVHMDDQVYPDPKMFNPSRWEGPPPKAGTFLPFGLGARLCPGNDLAKLEISVFLHHFLLGYKLKRANPKCRSRSEMDGVVAASADATRDEIKIMNVYIWDMDETLILLKSLLDGSYAGAFDGLKDHDKSVDIGKRWENLILELCDEHFFYEEIENYNEPFLSAVKEYDDGKDLTTYDFEADCFSSPYDDLNKRKLAYRHRAIGEKYTKGLEKILDHHMIKVWNDLYSATDKYTDGWLSSALMWHNQMLMWYNRVLMRLKLYKVGASVPCMRPSHKLLEEAMGKSTAESTAKHSSINCIVTSGSLIPSLAKCLLYRLDDVVAFENVYSSWEVGKLQCFKWIKERYDGPNVRFCAIGDGHEECTAAQIMKWPFVKIEFHPDAPHRFPGLNLPTIHRIMDTVYDSSSNDG

SEQ ID NO: 30986 - protein, 209 aa, Triticum aestivum
MAEVEAALPVAATETPEVAAESDAGAAEAKGPHKLQRQWTFWYDIQTKPKPGAAWGTSLKKGYTFDTVEEFWCLYDQIFRPSKLVGSADFHLFKAGVEPKWEDPECANGGKWTVISSRKANLDTMWLETCMALIGEQFDESQEICGVVASVRQRQDKLSLWTKTASNEAVQVDIGKKWKEVIDYNDKMVYSFHDDSRSQKPSRGGRYTV

SEQ ID NO: 30987 - protein, 503 aa, Picea sitchensis
MASKVPIRQLFIDGEWRAPLKGKRLPVINPTTEETIGEIPAATAEDVEIAIKAARVAFTRNRGKDWARTPGAFRAKYLRAIAAKVIERKSELAELEALDSGKPLDETAWDMDDVAGCFEFYADLAEALDSEQRAPVSLPMEAFKSHVLKEPIGVVGLITPWNYPLLMAAWKVAPALAAGCTAILKPSELTSVTCLELASICKEIGLPPGVLNIVTGVGPEAGAPLPAHPDVDKVAFTGSTATGRAIMTAAAQVIKPVSLELGGKSPILVFEDVDIEKAAEWAMFGCFWTNGQICSATSRLLVQESIADEFIKKLVNWTKSIKISDPFEKGCRLGPVVSEGQYKKILNFISVAKEEGATVLCGGRHPEHLKKGYFIEPTIIGNVNPSMQIWREEVFGPVLTVMTFRTEEEAIDIANDSHYALGGAVLSNNADLCNRVSEHLQAGIIWVNCSQPCFCQAPWGGNKRSGFGRELGKWGLENYLSVKQVTEYVSNDPWGWYPSPSKL

SEQ ID NO: 30988 - protein, 325 aa, Streptomyces coelicolor A3(2)
MRTESTANNEHDEHLGADPTGDRSARRAVTVFPVLVLLAGALGLLLPGSFTGWSEAVPYLLGVVMFCMGITMTPEDFRGVVKRPWAVALGLVAHYVIMPGLGWAIAHLLDLPPQLAAGVILVGCAPSGTASNVVTYLARGDVALSVSVATVSTLVAPLVTPPLTLLLAGEYLPVDAGSMVTDILKTVLLPVLAGVVVRLLAGRYVQRALPALPWLSALTISVIVAVVVAGSADAIKSAAGLVFVAVVLHNGLGLALGYGAGRLGRLGEPGSRAMAFEVGMQNSGLAASLATAHFSPLAALPAAVFSVWHNVSGAVVAAWLSRRGR

SEQ ID NO: 30989 - protein, 240 aa, Cicer arietinum
NSARGGNQNDGDTMIDHLLKLRVTQPEYYSDHMIKGLIQAMLLAGTDTSAVAIEWVMSELLNHPDVLNKAKEEIETQIGRDKLKEEHDLSKLPYLQNIINETLRLHPPAPLLLPHYSSEDFTLGGFNVPKDTIILSNVWAIHRDPNLWSDPLSFKPERFEIEGELNKLIAFGLGRRACPGLNLAQRSVGLTVGMLIQCFEWKRESDEKLDMMEDKGITMPKKVPLEAMCKPLPIVNDIMK

SEQ ID NO: 30990 - protein, 328 aa, Staphylococcus aureus subsp. aureus Mu50
MADLLNVLKDKLSGKNVKIVLPEGEDERVLTAATQLQATDYVTPIVLGDETKVQSLAQKLDLDISNIELINPATSELKAELVQSFVERRKGKATEEQAQELLNNVNYFGTMLVYAGKADGLVSGAAHSTGDTVRPALQIIKTKPGVSRTSGIFFMIKGDEQYIFGDCAINPELDSQGLAEIAVESAKSALSFGMDPKVAMLSFSTKGSAKSDDVTKVQEAVKLAQQKAEEEKLEAIIDGEFQFDAAIVPGVAEKKAPGAKLQGDANVFVFPSLEAGNIGYKIAQRLGGYDAVGPVLQGLNSPVNDLSRGCSIEDVYNLSIITAAQALQ

SEQ ID NO: 30991 - protein, 191 aa, Zea mays
  misc_feature (57)..(57): Xaa can be any naturally occurring amino acid
  misc_feature (95)..(95): Xaa can be any naturally occurring amino acid
  misc_feature (136)..(136): Xaa can be any naturally occurring amino acid
MSSDGEKVPKRAESPVADSENDGGNTDGLHRRLNNRQVQLLSIGGTVGTGLFIGIGXAGLAKSGPGSLLVCTALYAMVLGLTNNSIAEMNTYMPXVSGGFIRLAGHWVDDALGFMVGWNFFLYEALLIPFEIVALXNLVVSFWSDNVTQAGPTAGFIIAGIIAYGVLNLLAVGVFGEAEFWLALGKALLIF

SEQ ID NO: 30992 - protein, 227 aa, Thiomicrospira crunogena XCL-2
MTTTLIQRYQNVQKRIDDAMQSANRTDHIQLLAVSKTKPIEDIIALADIGQRAFGENYVQEALDKIAQRPDLEWHFIGPIQSNKTKPIAENVQWVHSVDRFKIARRLSEQRPDNLPPLNILLEVNISNEASKAGFSPNEILDVTKQILELPHLALRGLMAIPAKAYSHDEQKQPFHQMKLLLESMQTHFPDQPIDTLSMGMSADLEAAIEEGATIVRIGTDIFGARA

SEQ ID NO: 30993 - protein, 162 aa, Triticum aestivum
MAPIAVGNVIPDGILAYLDEENKPQTVSIHSLATGKKVIIFGVPGAFTPTCSLKHVPGFIERAEELKGKGVDEIICISVNDPFVMNSWAKTFPENKHVKFLADGAAKYTNALGLELDLTDKGLGVRSKRFALLVEDLKVKVANVESGGEFTISSAEEIIKAL

SEQ ID NO: 30994 - protein, 424 aa, Thiomicrospira crunogena XCL-2
MFEIAKQRLSDVFKHIDVEEEVITRLSVPKRSIKASIPVRMDDGSLRIFTGYRVQYDDTRGPTKGGIRYHPRVNEDEVTSLSFWMTVKCAVAGLPFGGAKGGITVNPKELSQLEIERLSRGYIRAFADVIGETRDIPAPDMYTNATIMGWMADEYSIISRQQVPGIITGKPVHLNGSEGRTQATGQGALFCLNEYARRQGWDIKNTTVAVQGFGNAGYHFARLAQQEGYRVIAVSDSSGGILTPSGLNIDDVKQYKDQTSELQAVYCDGSVCKVIEHEKLTNEELLELEIDVLVLAAMENQVTQENVDNIQAHTILEIANGPVSPQADEVLYAKNIQIIPDVLANAGGVTVSYFEWVQNRAGFYWEADEIRVKLSKIMKRESNTIYDLAIRYETSLRTAAYIHGIERLAGAINQRGNRKFFKKN

SEQ ID NO: 30995 - protein, 373 aa, Gibberella zeae PH-1
MKVTQLWYYPIKGIQGIQVQSARLGPQGLQHDRRFMLCKIEKSGELRKLQLSEHPECSLFQPEVIGDKMRVKYLTPKEPLVPWKPEQDTVLEIPIEPKLKDLAKADINLHQSLVVAYRMGSEYDAWFTACFGFDTALVYIGDGRRPVLGTFSPKSQNAPPSWTSSLVSYLSGKKLSSAEEDWITFSDCAPYLVVTEESLKNVRDRLSTSDVDMTAMRPNIVLDGETAWDEDFWAQLVVNGAHVIALTKNCNRCTSLNVDYETGRTAEGERGTVLKKLMSDRRVDTGMKYSPVFGRYGFLTSKPDNATVSIGDKVEATARQTERAVCDWPSRDPKFARYYQKSSDANTNLSIVLSFWLMAAAVLGLLPCWLFFS

SEQ ID NO: 30996 - protein, 285 aa, Thiomicrospira crunogena XCL-2
MNLTICFIGAGNMSISLIGGLIASGYPKDKIRATDPSDARRREITQSMGIHCDEDNIEAATNSDIIVLAVKPQMLESVCQQLSATLQAKRPLVISIAAGVRSTDIDYWLGGNMAIVRTMPNTPALIRSGATGLFANSAVSNAQKEQAEHILRAAGITVWVPKETDLDIVTAISGSGPAYYFLFMEAMQQAGQKLGLDEATARLLTIQTAFGAAKMALESPDDCATLRQKVTSPNGTTEKAIQSFESHQLRETIEEAMKAAKDRAISLANELGSTQTDFQNKTGEK

SEQ ID NO: 30997 - protein, 414 aa, Schizosaccharomyces pombe
MGQTLSEPVTEKHSVNGSNEFVLYGLSSMQGWRISMEDAHSAILSMECSAVKDPVDFFAVYDGHGGDKVAKWCGSNLPQILEKNPDFQKGDFVNALKSSFLNADKAILDDDQFHTDPSGCTATVVLRVGNKLYCANAGDSRTVLGSKGIAKPLSADHKPSNEAEKARICAAGGFVDFGRVNGNLALSRAIGDFEFTNSNLEPEKQIVTALPDVVVHEITDDDEFVVLACDGIWDCKTSQQVIEFVRRGIVAGTSLEKIAENLMDNCIASDTETTGLGCDNMTVCIVALLQENDKSAWYKKIADRVAANDGPCAPPEYAENHGPGWRSGDNNKKVIVPPNFHQVKLNGSDGYDKDANENSKEDDSTNGSLAAGFRWKEHFFPHKAEEENSSSETDIVNSNKDVADDHKEAVSAAD

SEQ ID NO: 30998 - protein, 390 aa, Bacillus subtilis subsp. subtilis str. 168
MREELKGIFASVFGEKEGLRFFFAPGRVNLIGEHTDYNGGHVFPCALTMGTYAAVAERNDGLVRMYSDNFRNAGIKECSLDDIRYQKEDDWANYPKGVIYEFQQRGYAVPHGFDIVFSGNIPNGAGLSSSASIELLMGVVLQSYFHPEVDALELVKMAQHAENHFIGVNCGIMDQFAIGMGKKHHAMLLNCDTLDYEYSKLNVSGLALVIANTNKKRTLADSSYNTRRQECNDALLDLKKGLDIAALGDIKPSDFDAHSSLIQNETNRRRAKHAVYENHRAIKTAHMFKENNIDEIGQLMKESHLSLKDDYEVTCPELDELVFAAWDHEGVIGSRMTGAGFGGCTISIVKDEFVDDFIQKVGDRYQEKTGLRADFYVADIGEGARELKGE

SEQ ID NO: 30999 - protein, 668 aa, delta proteobacterium MLMS-1
MSTPADQPRLAEETPTTANPWPPCRNACPVHADVRTYVDHIAREEFTKALAVIRRRLPLAAICGRICDHPCEANCRRRDVDQAVAIRELKRFVAEYPENDDVPVTAGPGDRQQVAIIGAGPAGLSAALELARRGFRPTIFEKEKVAGGIPGVAIPTYRLPRQALKRDIDWILAHGIKLQSGVEVGVDTTINKLKKQGFAAVIIAVGMSQSRILPLPGTDAPGIHGALDFLRAAAAGRELELGREVLVIGGGNVACDTARTAVRLGCDKVRMICLESEEEMPALPEEITESRDEGIEIITRRGPLEVVLEDGKISGLRHRLVTRVFDEEGRFAPEFDDHDLALTPCQSIIFAIGQAVEPGFIKGSKLTMDERGRLVHDPETRQTSVPWVFAAGEAVSPPGTVVRACADGRRVAQGVEQFLQGETIQLARETPAVIDRLQPERAAKVSKVERAEPEIRPAARRQRDFQPFIGTLPHQQTVTEARRCLECGNGATVQNDYCVKCLNCVRLCPYDAPRIDRTARVPAEHCLACGLCYGACPTGAIRLQNNSPEQLAASSQRLLAELDGKQPRTIAYICDRPATKIGPWREQTGASEAAAIHLPNAGLLEAGQLLQTLEAGAERILVILPATEDEYHKGTGHRLRRRIQRLQADLAALGLDPNRIQLWPEASE

SEQ ID NO: 31000 - protein, 463 aa, Oryza sativa
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAAATSRAPPTAPTRSATRPSSRSSSTCPRSSPSSPSSATTGCSTSTTPTPTRSSASPPSTTSGSCAGSRTWTRRCTASWWRGPRRRGTT

SEQ ID NO: 31001 - protein, 486 aa, Arabidopsis thaliana
  misc_feature (163)..(163): Xaa can be any naturally occurring amino acid
ADGNNIKAPIETAVKPPHRTEDNIRDEARRNRSNAVNPFSAKYVPFNAAPGSTESYSLDEIVYRSRSGGLLDVEHDMEALKRFDGAYWRDLFDSRVGKSTWPYGSGVWSKKEWVLPEIDDDDIVSAFEGNSNLFWAERFGKQFLGMNDLWVKHCGISHTGSFXDLGMTVLVSQVNRLRKMKRPVVGVGCASTGDTSAALSAYCASAGIPSIVFLPANKISMAQLVQPIANGAFVLSIDTDFDGCMKLIREITAELPIYLANSLNSLRLEGQKTAAIEILQQFDWQVPDWVIVPGGNLGNIYAFYKGFKMCQELGLVDRIPRMVCAQAANANPLYLHYKSGWKDFKPMTASTTFASAIQIGDPVSIDRAVYALKKCNGIVEEATEEELMDAMAQADSTGMFICPHTGVALTALFKLRNQGVIAPTDRTVVVSTAHGLKFTQSKIDYHSNAIPDMACRFSNPPVDVKADFGAVMDVLKSYLGSNTLTS

SEQ ID NO: 31002 - protein, 425 aa, uncultured marine gamma proteobacterium EBAC31A08
MSCLVLKILEIFGHLIFELKPRYNIFMKEIIKEYTNYMVPFYAPADFVVKKASGSHVWDLNNKKYIDFTAGIAVTNLGHSNKDLIKILKKQSEELWHLSNLYINEPSVTLARKLCKNSFADKVFFCNSGAESIEAAVKIARKFCSSTVNKNKNEVISFSTSFHGRTMLGIALAKAKHLTDGFAPLPRGIKNHPYNDITNLEKVFSDKTAAVILELVQWQSGITKADKKFIAKIKKLAKKHKALVIIDEVQSGIGRTGTLFAYEQFNITPDILCFAKGISNGFPLGGILTSDKVSKHMSAGSHGTTFGGGPIACAIGNEVIDTISKKSFLNKVLKKEVRFINLLNKINEKHKCFEKITSAGLWVGVEVSKDSKIQIDDLIKKSHHNGLMILKANASTVRFSPSLIIENELVDEGLKIFEKSIISLL

SEQ ID NO: 31003 - protein, 448 aa, Zea mays
MATAAAAAAPLDDAKAKNVIRQVEFYFSDSNLPRDGFLRRTVEESEDGLVSLALICSFSRMRSHLGLEGDAKPETVPEETVLAVADILRRSTALRVSEDGKKVGRSKELSKPDEVIEQVDSRTVAASPLPYNVKLEEVESFFAQCGKVNSVRLPRHVSDKRHFCGTALVEFSEEDEAKGVFEKNLIFAGADLEIRPKKEFDTEREAKKEAYEKSHPNKSSHGEGYPKGLILAFKLKKTADDGETGKSGGGKVDDTDLTKNNGASDATEKSSVENDEKITENKGNVSEEQADAVEELKGLSAGETLQSVPKVDKSPSNKDQDIISREDLKEEFTKFGTVRYVDFSIGEDSGFIRFEDPAAADKARAFAAIADEGGLTMKGHIVILEPVSGQAEKDYWSAIRGVQEKYKDSRNNRGRDWKNNRGGKQFGGGKRGRHFDSRDRASNKAQKV

SEQ ID NO: 31004 - protein, 242 aa, Triticum aestivum
  misc_feature (133)..(133): Xaa can be any naturally occurring amino acid
NKFVQKSRLVPVRNSRDIVDPRVRVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQXMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 31005 - protein, 623 aa, Triticum aestivum
  misc_feature (43)..(43): Xaa can be any naturally occurring amino acid
  misc_feature (83)..(83): Xaa can be any naturally occurring amino acid
  misc_feature (142)..(142): Xaa can be any naturally occurring amino acid
  misc_feature (275)..(275): Xaa can be any naturally occurring amino acid
MESLALLSAKPGLSLRAGPRLPLPRLRAARASLSTASSSRPAXLQSPLLSSRPPSSQDAVLGYGLLKRRTSAGAGVSCSAAAXAAAAPLPPAQPEVKKFLGVGLPTLKKIVPLGLMFFCILFNYTILRDTKDVLVVTAKGSXAEIIPFLKTWVNLPMAIGFMLAYSKLSDVLSREALFYTVIFPFIAFFGLFGFVLYPLRDAIHPTALADKLLAALGPSFLGPVAILRIWSFCLFYVMAELWGSVVVSVLFWGFANQITTVDEAKEFYPLFGLGXNIALIFSGGNCEIIPNLRKTMGPGVDGWEVSLKGMMGIVVLLGLVITSIYWGVNKLVLNDPSLPKSDHKKKKNKPKLSMKESMKVLISSKYVRDLATLVVAYGISINLVEVTWKSKLKAQFPSPNEYSSFMGDFSTATGIATFTMMLLGRIIFQRFGWGVAAMITPTVLLVTGVGFFSLILFGQPLTPLLATWGMTPLLAAVYVGALQNIFSKSAKYSLFDPCKEMAYIPLDGDMKLKGKAAIDVVCNPLGKSGGALIQQFLILIFGSLANSTPYLGGILLVIVLAWLGAARSLDKQFSSLAKEDLRKEMSKEKVETAAPKEPEAATDVLVEQSNGTENSPSDSSPAQ

SEQ ID NO: 31006 - protein, 711 aa, Zea mays
MAYRGIGVSRIRIRILFFPDNGEAGGSPSKKAGSPLVPASAWASVLHLFSEVTSEAEVAYIFFPFLKMDHSSDEDTEISDSEIDDYEGKIYARLMSGDLKLNKNGENYICPFCSSKKKNYSKSSLVQHASGVSAAPNREAKEKAVHRALFKYLKNGLAKSPEPGSHATPVEPQPLQNRDEKFVWPWMGVLVNVPTEWKDGRQIGESGNRLKEQLSHFCPLRVIPLWTFRGHTGNAIVEFGKDWNGFRNARTFESHFAAGGFGKKDWIGKKNQGSELYGWLARAEDYNSPGIIADHLRKNGDLKSVNDLAKEGARKNDRLVANLANQIEVKNRYLQELECKYSETTASLEKMMGQREQLLQSYNEEISKMQQLARRHSQKIIDENQKLRSDLEAKMNDLDVRSKQLDEIAAKSDYDRRSLEQEKQKNAIKSSHLKLATLEQQKADENVLKLVEEQKVSNNVSYGSLTVWKLQREKHAALKKILMLEQQLDAKQKLELEIQQLKGKLKVMEHMPGDEDSASKNKINELSEALQEKIDELDGMESLNQTLVIKESKSNIELQEARKELENGLLDLSGGQTHIGIKRMGELDLKAFSKACQKERTENAEVTAAFLCSKWEAEIKNPDWHPFRVVTIDGKEMAIIEDDAKLRALKEEHGEEIYAMVTKALLETNEYKSKGSYPVGELWNFKENRKVTLKEAVQFVLRQWRTNRRKR

SEQ ID NO: 31007 - protein, 126 aa, Brassica napus
  misc_feature (3)..(3): Xaa can be any naturally occurring amino acid
  misc_feature (9)..(9): Xaa can be any naturally occurring amino acid
  misc_feature (20)..(20): Xaa can be any naturally occurring amino acid
  misc_feature (22)..(22): Xaa can be any naturally occurring amino acid
  misc_feature (32)..(35): Xaa can be any naturally occurring amino acid
  misc_feature (37)..(39): Xaa can be any naturally occurring amino acid
  misc_feature (43)..(43): Xaa can be any naturally occurring amino acid
  misc_feature (50)..(52): Xaa can be any naturally occurring amino acid
  misc_feature (57)..(57): Xaa can be any naturally occurring amino acid
  misc_feature (61)..(63): Xaa can be any naturally occurring amino acid
  misc_feature (65)..(65): Xaa can be any naturally occurring amino acid
  misc_feature (67)..(67): Xaa can be any naturally occurring amino acid
  misc_feature (72)..(75): Xaa can be any naturally occurring amino acid
  misc_feature (79)..(80): Xaa can be any naturally occurring amino acid
  misc_feature (83)..(85): Xaa can be any naturally occurring amino acid
  misc_feature (91)..(92): Xaa can be any naturally occurring amino acid
  misc_feature (96)..(97): Xaa can be any naturally occurring amino acid
  misc_feature (100)..(100): Xaa can be any naturally occurring amino acid
  misc_feature (106)..(107): Xaa can be any naturally occurring amino acid
  misc_feature (116)..(116): Xaa can be any naturally occurring amino acid
  misc_feature (119)..(119): Xaa can be any naturally occurring amino acid
MGXVLVSYXPPSSLVLVSRXHXFSAGIKNSEXXXXRXXXPTRXTLIAKPXXXNLPQXPILXXXLXEXIAFVXXXXAGLXXLDXXXEPLKEXXTRTXXASXITEDGXXVEVFMASSXEEXPQQIEIE

SEQ ID NO: 31008 - protein, 258 aa, Secale cereale
MACAFSASTVSTAAALVASPKPAGAPSACRFPALRRGRAGLRCARLEDARARSFVARAAAEYDLPLVGNKAPDFAAEAVFDQEFINVKLSDYIGKKYVILFFYPLDFTFVCPTEITAFSDRHEEFEKINTEILGVSVDSVFSHLAWVQTERKSGGLGDLKYPLVSDVTKSISKSFGVLIPDQGIALRGLFMIDKEGVIQHSTINNLGIGRSVDETLRTLQALQYVQENPDEVCPAGWKPGEKSMKPDPKGSKEYFAAI

SEQ ID NO: 31009 - protein, 203 aa, Cytophaga hutchinsonii ATCC 33406
MKPPLVIGICGGSASGKTYLKDVLIENSPAGKVQEFTLDSYYLPREWQKADANGYLNFDLPEAFNTQKMIYDFMDLSSGFSIEQPIYKYKNVPLSIDFKIVEPAPVIIAEGIFLFYYKEMRERIDKKIFIDAPFEVKRQRRIERDVRERGYEVPEIHYRFDNHAQESYNTYVLPYVQEVDYVIENQQMLDSAIPALLKQIKDY

SEQ ID NO: 31010 - protein, 504 aa, Pseudomonas fluorescens Pf-5
MLEQYVKKILTSRVYDVAVETPLQTARQLSERLGNQIWLKREDLQPVFSFKIRGAYNKLTQLSDAERARGVVTASAGNHAQGLALAAKVLGVKATIVMPKTTPEIKVEGVRSRGGKVVLHGDTFPEALAYSLKLVDEKGYVYIHPYDDPHTIAGQGTVAMEILRQHPGPLDAIFVPVGGGGLIAGIAAYVKYLRPEIKVIGVEPDDSNCLQAAMAAGERVVLPTVGIFADGVAVAQIGQHTFDICKDYVDEVITVSTDEICAAIKDIYDDTRSITEPAGALGVAGIKKYVEQRGISGQTLVAIDSGANVNFDRLRHVAERAELGEGREAIIAVTIPEKPGSFKAFCEAVGKRQITEFNYRYNTGSEAHIFVGVQTHPENDPRSALIASLTEQGFPVIDLTDNELAKLHIRYMVGGHAEKVSDEVVLRFEFPERPGALFNFLNKLGGRWNISMFHYRNHGAADGRVVAGLQVPADERHLVPAALEQIGYPYWDESDNPAYQLFLG

SEQ ID NO: 31011 - protein, 223 aa, Pseudomonas fluorescens Pf-5
MTQDQLKQAVAQAAVDLILPKLDDKSIVGVGTGSTANCFIDALALHKGTFDGAVASSEATAARLKGHGIPVYELNTVSDLEFYIDGADESDEHLNLIKGGGAALTREKIVAAVAKTFICIADASKLVPVLGNFPLPVEVIPMARSHVARELVKLGGDPVYREGVITDNGNIILDVHNMQITNPVELESQINAIVGVVTNGLFAARPADVLLLGTAEGVKTLKA

SEQ ID NO: 31012 - protein, 495 aa, Oryza sativa
  misc_feature (336)..(336): Xaa can be any naturally occurring amino acid
MATAGALALVAICSYLAVTSNKQKRRRRPPVVGTVFHQLYNVRRIHDYHTALSREHTTFRMLVPAGGDQIYTCDPAVVEHILKTNFANYGKGPFNHGNAKDLFGDGIFAIDGEKWKQQRKIASYDFSTRALRDFSCAVFKRNAAKLAGIVSNHAASNQSMDFQGLMLRATMDSIFTIAFGTDLNTLDGSGEGSRFAAAFDDASEFTMLRYISPLWKLARLLNVGVEAMLKERIKVVDEFVYRLIRARSDELSNSHDSGSRQDILSRFLQATTSDSVVDYKYLRDIILNIVIAGKDTTAGALAWFLYMVCKHPEVQEKICHEAMVATSAGDTASVDXFLQSLTDQALNNMHYLHAALTETLRLYPSVPMENKQCFSDDVLPNGFNVSKGDIVFFIPYAMGRMESLWGKDAEYFRPERWLDENGVFQQESPFKFTAFQAGPRICLGKEFAYRQMKIFAAVLLRFFVLKLRDEKEIVSYRTTLTLAIDQGLHLTATAR

SEQ ID NO: 31013 - protein, 469 aa, Chlorobium tepidum TLS
MQQADTLAAQFDVAVIGSGPGGYEAAIHAARYGLKTCIVEKAVLGGVCVNWGCIPTKALLRSAEVFDLAKNPETFGVNVGNVSFDLAQAVKRSRNVALKSSKGVAYLLKKAAVEVLAGEAVLTGGAGVMVTMPDGSVRMLGAKNIIVATGSTPRVIPGLEPDGKKIITSREALILKEVPKSMIVVGGGAIGVEMAWFYAKAGSKVTIVELMPRMLPAEEAEVSEALKRSFEKAGITVHCGAKLDNVAVSESGVSAELVVEGSAPQTLNASCLLVAVGVTGAIDGLGLDAVGVETERGFIRTDGQCRTSAPGIYAIGDVRGGMLLAHKASAEAAIAVEAIAGKSPEPLSEPLIPRCVYAQPSVASVGLTEEAAVNAGYQVAVGRSQFAASGKANAYGQLEGFVKLVFDAATGKMLGGHLIGHDAVELIGELGLACRYGVTAGGLVNTVHAHPTLSETVREAAFDALQSMG

SEQ ID NO: 31014 - protein, 199 aa, Porphyra yezoensis
MISGPNCLRVGQLAPDFSATAVYDQEFKTLKLSDLKNKYIVLFFYPLDFTFVCPTEITAFSDKYNAFSELNTEVLGVSVDSEYSHLAWLQTDRESGGLGDLSYPLVSDLKKEISAAYNVLNSDGVALRGLFIIDPKGIIQYSTINNLEFGRSVEETLRVLQAIQYVQSHPDEVCPANWKPGDKTMNPDPIKSKNYFAAA

SEQ ID NO: 31015 - protein, 327 aa, Staphylococcus aureus subsp. aureus Mu50
MIKSGKARAHTNIALIKYWGKKDEALIIPMNNSISVTLEKFYTETKVTFNDQLTQDQFWLNGEKVSGKELEKISKYMDIVRNRAGIDWYAEIESDNFVPTAAGLASSASAYAALAAACNQALDLQLSDKDLSRLARIGSGSASRSIYGGFAEWEKGYNDETSYAVPLESNHFEDDLAMIFVVINQHSKKVPSRYGMSLTRNTSRFYQYWLDHIDEDLAEAKAAIQDKDFKRLGEVIEENGLRMHATNLGSTPPFTYLVQESYDVMALVHECREAGYPCYFTMDAGPNVKILVEKKNKQQIIDKLLTQFDNNQIIDSDIIATGIEIIE

SEQ ID NO: 31016 - protein, 331 aa, Ostreococcus tauri
MSRTASAGTARGVRVRARARGHRVVARAKADARTASATRAVCVITGGARGLGYHLARALVARSCAVVLASRDGARAETASRTLGAACAFARCDVGETADVEALGRRARETAERLDVDVVYWINAAGAVTKNAPLCDVDAREISAVVRANLLGPLLGARTCERLARETSKRVVVFNFGFSDWGANLSKSAATHKSTKTGLSALTKALNAEVRAMSPPIRCEFHQLSPGLALTRVLLGNGNANPISKRVFNALAEEPSVIADALVDRMLALPEGSTSPVEYLTPLEAARRMFDELPRIVTGSGGRHFDANGDRVRTSSDVRYDDDGVELLPFE

SEQ ID NO: 31017 - protein, 497 aa, Picea sitchensis
MEKSVMVSALALFFVCFVSTSVGEIFDELSAGQQVLDVEAALKLRISRSKVSAQEWSETVQGEEKNSIVLQVVHRDSLSSSSNTSLVKEILQERLKRDAARVDSINARVQLAAMGVSKAEMKPLNGSSIDARFDAKDFSSSIISGLAQGSGEYFTRLGVGTPPRYTYMVLDTGSDIMWIQCLPCAKCYGQTDPLFNPAASSTYRKVPCATPLCKKLDISGCRNKRYCEYQVSYGDGSFTVGDFSTETLTFRGQVIRRVALGCGHDNEGLFIGAAGLLGLGRGSLSFPSQTGAQFSKRFSYCLVDRSASGTASSLIFGKAAIPKSAIFTPLLSNPKLDTFYYVELVGISVGGRRLTSIPASVFRMDATGNGGVIIDSGTSVTRLVDSAYSTMRDAFRVGTGNLKSAGGFSLFDTCYDLSGLKTVKVPTLVFHFQGGAHISLPATNYLIPVDSSATFCFAFAGNTGGLSIIGNIQQQGYRVVFDSLANRVGFKAGSCLA

SEQ ID NO: 31018 - protein, 482 aa, Staphylococcus aureus subsp. aureus Mu50
MLVILQLPCHIISKTNRISLLIFIMKKQSKMSLKTFKRRIYVMKTYDLIVIGFGKAGKTLAKYAASTGQHVAVIEQSSKMYGGTCINIGCIPSKTLVHDGLEGKSFEASYNRKNDVVNALNNKNYHLLADDNNIDVLDFKAQFKSNTEVNLLDQHGDIVDSITAPHIIINTGATSIIPNIKGLDQAKHVFDSTGLLNISYQPKHLVIVGGGYIALEFASMFANLGSKVTVLERGESFMPREDQDVVAHAITDLENKGIALHTNVETTELSSDDHHTTVRTNVGNFEADAVLLAIGRKPNTALALENTDIELGDRGEIKVNAQLQTSVPHIYAAGDVKGGLQFTYISLDDYRIIKSALYGNQSRTTDNRGSVPYTVFIDPPLSRVGLTSKEAAAQHYDYTEHQLLVSAIPRHKINNDPRGLFKVVINNENNMILGATLYGKQSEELINIIKLAIDQNIPYTVLRDNIYTHPTMAESFNDLFNF

SEQ ID NO: 31019 - protein, 425 aa, Arabidopsis thaliana
MVNSEEIADGFEPKPVSRSYSGDSSHDRSLSDLNHAAEDLSDKLKNVGLNEVTKEQSEKMMSVSESNGGLDSNAVVTINQEEEEEEEDRDGYGYGDGWSENESENVYPVRPGAEDCSFYMRTGSCKFGSSCKFNHPLARKFQYYFRTGGCKYGETCRFNHTIPKSGLASAPELNFLGLPLRPGEVECPYYMRNGSCKYGAECKFNHPDPTTIGGTDSPSFRGNNGVSIGTFSPKATFQASSTSWSSPRHVNGTSPFIPVMLSQTHGVTSQNPEWNGYQASVYSSERGVFSPSTTYLMNNSSAETSMLLSQYRHQMPAEEFPERPDQPECSYYMKTGDCKFKFNCKYHHPKNRLPKLPPYALNDKGLPLRPDQNICTYYSRYGICKFGPACRFDHSVQPPYSTESSQAIVEPPQVSANGNESDGWN

SEQ ID NO: 31020 - protein, 322 aa, Ostreococcus tauri
MLRAASLRAIVGVRATASSARRARDDRPSRRTLRAASSTSASVSSTTIAPFCELLSRDESSSNATRPLAVVIGWFGCELRHVKKYAMMYVDAEWDAVAVAPPSVSTLVPSVADAYGDYVLRALSKRQATERRGPIVVHVASNGGFIFAGNLMLKARNGDARARALFDRTKGFVFDCAPGNLRPDIIARAAAAVIGGASATTEPAPIFEAFAKALMMRPSIDARLRSIDEVWGKAPASSVEDASWTPPHCPAMFAYSEADVLISPREIEAFARLREEKTGARSDLHKYHDAAHCEIGREASRFDDYRKKVHTFLSEIRGATVQ

SEQ ID NO: 31021 - protein, 634 aa, Chlorobium tepidum TLS
MVLLTVEGITKRYGLKTLFEEVSFGIDDRDKVGIIGANGSGKSTLMKILAGSETPDTGRVMVSKEKKISYLPQVSPYDADDTVLEAVLKSGDKVMALICEYELALEALDHAEGDQTALIEKVTHLSHELDVSGAWELESNAKAVLGKLGLNDLTAKMGTLSGGQRKRVALAHALVVPSDALILDEPTNHLDADSVEWLESYIRRYAGAVILITHDRYFLDRVATRMIELDGKTAKTYTGGYASYLVQKEAEEAQEIRDERKRNALAKQELEWMRTGAKARTTKQKARLQRAETLVYAPKKAEKQEMEIGFGAERLGNKIVEFHDVSKSWGQKKLLRSFDYLLEKGDRIGIIGPNGSGKTTLLEMIAGRTKPDTGRIEIGPTVKIGYYDQESRHLDDSKRVIEYIKEEAEQIKTKDGTLVSAAKMLERFLFSGAAQYNPIGNLSGGERRRLYLLRQLIGAPNVLLLDEPTNDLDIPTLRVLEDYLDTFPGCLVVVSHDRYFLDRTVEHIFAFEGDGIVRRYPGNYSVYLEMKAAIAAEEQAAKQKPAPAAKPASEAPKPTLSPKQRKLNSKEKRELEQLEQAIAEAEERQEAINAELAAAGSDFDAVQKLGDELHKIQTKLDKDMERWAELAELA

SEQ ID NO: 31022 - protein, 212 aa, Triticum aestivum
MEGLSWTRACVLVLCIMPFLHPAAAIRFVIDREECFSHNVEYEGDTVHVSFVVIKADTPWHYSEDGVDLVVKDSNGAQVRDSRDKISDKFEFIVQKRGVHRFCFTNKSPYHETIDFDVHVGHYSYFDQHAKDEHFSPLFEQIAKLDEALYNIQFEQHWLEAQTDRQAILNENMSRRAIHKALFESAALIAASVIQVYLLRRLFERKLGTSRV

SEQ ID NO: 31023 - protein, 293 aa, Glycine max
MHIQFFNICKKFVCCSHHNIWRQAEIPVKTFHYYHPDTKGLDFAALLNDVKNAPDCSFFLLHPCAHNPTGVDPTEEQWREISYHFQVKNHFPFFDMAYQGFSSGDLDKDAIALRIFLEDGHLIGCAQSFAKNMGLSEHKAGCLSVLCQSIKQVAALKSQLQLMSHAMYSSIPFQGISLVTMILSEPDTEALWRKEIKVMAKRIQTMRTTLRHCLENLHSSFNWEHITDQVGMFCFSGLTPDQVQQMEKLFHIYMTPDGRMSMSGVTSSNVDYLANAIHQVTRIDEEALRSCYV

SEQ ID NO: 31024 - protein, 470 aa, Salmonella enterica subsp. arizonae serovar 62:z4,z23:--
MKKTKIVCTIGPKTESEEMLTKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVVCKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYHNDSRKLRITEAVCRGAVETAEKLEAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 31025 - protein, 239 aa, Oryza sativa Indica Group
MAGSGDELMLLGKWPSPFVTRVELALGLKGLSYEYVKQDLVNKSELLLASNPVHKKIPVLIHNGKPVCESSIIVQYIDEAFPDAGASAALLPADPYERAVARFWVAYVDDKFVPAWVATFRGKTEEEKAEGMKQLLAAVETLEGALKDCSKGKPFFGGDTVGIVDVALGGLISWVKATEVLAGSKIFDEEKAPLLAAWAQRFGELDVAEKVLPDVDGVVEFAKMRLAEAAAAAAAASKN

SEQ ID NO: 31026 - protein, 233 aa, Oryza sativa Indica Group
MAGGGDELKLLGMWASPFALRAKLALSFKGLSYEYVEEDLKNKSELLLSSNPVHKKVPVLIHNGKPVCESQVIVQYIDEAFPDAGVPLLPSDPYDRAVARFWAAYIDDKLLKSWLQASMCKTEQEKAAAMKETFAAVANLEAAFKECSKGKPFFGGDAVGYVDVTLGAVIGFVRVGEALHGMRLFDASRSPLLDAWLDRFAALDAAKAVLPDTGRLAEYAKMKQAEWAAAATN

SEQ ID NO: 31027 - protein, 426 aa, Gibberella zeae PH-1
MADEQPRAVDRTDSMDSNDGPKQPDKKKSRRPANTAFRQQRLKAWQPILTPKTVLPLFFAIGIIFAPIGGLLLYASSQVQEIRLDYTNCIVDASIRTKSGGNFTGMPSSAVSTAFKSSNSSVNAQWAREVNVSSTLDNGVKTFNPRCHLKFTIPEEMGPPVLFYYHLTNFYQNHRRYVLSFDREQLKGSKRSISDIRNSDCTPLYGEGNKPYYPCGLIANSMFNDTFTSPELTNPPGGGNDTWTYLMSNNSGISWDSDKDLYKKTEYSNDDIVPPPNWQKRYPNGYTDENPPPNLKNWEAFQVWMRTAGLPTFSKLYQRNNTQAMWPGTYDLVIDDHFPTREYKGSKSIIISTRTVVGGRNPFLGIAYVVVGGVCILLGTVFTVTHLIRPRKLGDHTYLSWNNAPGGKSGPSTAAASGRELRPGEA

SEQ ID NO: 31028 - protein, 223 aa, Arabidopsis thaliana
MDSSMSTKKKTKLSVRNQTCFKKSSLSSSSTAKKTTNLSMREETMFKKALELSTLCDIEVCVIYYGRDGELIKTWPEDQSKVRDMAERFSKLHERERRKKRTNLSLFLRKKILDDNKLSEKVLEMKDSLESGLRVLQDKLLLLQPENQTELGQSRAVSSTTNPLSSPEDHHHQQWTEPLVTGVSNTEQDLSTSPLSNHQSKYSVFVYNHDSGSFYQVPDSICF

SEQ ID NO: 31029 - protein, 341 aa, Triticum aestivum
  misc_feature (290)..(290): Xaa can be any naturally occurring amino acid
GIDPKECVDLCDENTIGICAILGTTYTGEYEDIKGINDLLIERNIEVDIHVDAASGGFVAPFVNPGPLWDFRLPKVTSINVSGHKYGLVYPGVGWVVWRDPKYLPQELVFNINYLGADQASFTLNFSRGASQIIGQYYQLIRLGKRGYRRIMLNLTRTADYLSANLENMGFIIMSQRGGEGLPLVAARIDEDLGKQYDEFAVAHQLRERGWVVPAYTMAPHSEQMKTLRVVVREDFTKSRCDALIADFKLALQTLDSLDAKKLQEHKEHQFAMRRRSTLTTPIFSKGKKXNNPFVDEDHSLQGKTGRPCCVLDGAFAADDGGMMITDMLHIIIMMHAAARC

SEQ ID NO: 31030 - protein, 318 aa, Psychrobacter arcticus 273-4
MSATAPLNVNFITQITDLADCVGQTPLVKLQRLPEQEQIDNGAIMLAKLEGNNPAGSVKDRPAFNMIYQAERRGDIKPGDMLIEATSGNTGIALAMVAAMRGYPITLFMPSNSTQERKDAMTAYGATLIQVEEGIEAARDMALQMQADGKGIVLDQFNNPDNKQAHYLTTGPELWAQTEGKITHFISSMGTTGTITGVAQYLKEQNPAIQIIGLQPDEEAAIAGIRRWPAAYMPGIFDADLVDEIMDIDQRVAEVYMRKLAKTEGIFAGVSSGAAAWAATQVAKANPDAVIAFIVCDRGDRYLSTGLYNVDDSIDNAN

SEQ ID NO: 31031 - protein, 613 aa, Oryza sativa Japonica Group
MLSARAAATAAAAAASPLWKRGEGGSSGSGSGCTSCREVRRRAAAVRVRAAAPRRVEAVAMESAAETEKKEEVAAAGGGVEDMATEEVPVTPWAFSVASGYTLLRDPHHNKGLAFSEKERDAHYLRGLLPPAVVSQDLQVKKIMHNLRQYSVPLQRYMAMMDLQERNERLFYKLLIDNVEELLPVVYTPTVGEACQKYGSIFRQPQGLYVSLKDKGKVLDVLRNWPERNIQVIVVTDGERILGLGDLGCQGMGIPVGKLSLYTALGGVRPSACLPITIDVGTNNEQLLNDEFYIGLRQRRATGKEYHELMEEFMSAVKQIYGEKVLIQFEDFANHNAFDLLAKYSKSHLVFNDDIQGTASVVLAGLLSSLKVVGGTLAEHTYLFLGAGEAGTGIAELIALEISKQTKAPIEECRKKVWLLDSKGLIVNSRKESLQAFKKPWAHEHEPVTTLLDAVQSIKPTVLIGTSGVGKTFTKEVIEAMASFNEGRAVFASGSPFDPVEYNGKIHVPGQSNNAYIFPGFGLGVVISGAVRVHEDMLLAASETLADQATQENFEKGSIFPPFTNIRKISARIAASVAAKAYELGLATRLPQPRDLEKYAESCMYTPVYRSYR

SEQ ID NO: 31032 - protein, 185 aa, Triticum aestivum
MPGISRHSTAMAPPVMASWATSVAPFQGVKSNGGLPVSRRSNGGSLGSVSNGGRIRCMQVWPIEGIKKFETLSYLPPLSTEALLKQVDYLIRSKWVPCLEFSKVGFIFREHNTSPGYYDGRYWTMWKLPMFGCTDATQVINEVEEVKKEYPDAYVRIIGFDNMRQVQCVSFIAFKPPRSEESGKA

SEQ ID NO: 31033 - protein, 299 aa, Xanthobacter autotrophicus Py2
MRQPIRKAILPVAGLGTRFLPATKAVPKEMLTVVDRPVVQHVVDEARAAGIEHIVFVTGRNKAVIEDHFDRQFELERTLEERGKTKELAQLDRDTPKPGTTSFTRQQLPLGLGHAVWCAREIIGDEPFALLLPDMLHMPKAGNGNGQGCLASMVEAYNETGGNLVAVYEVPDDQTHQYGIVGVGEEKAKGAKAITQMVEKPKAGTAPSNLAISGRYILQPAIFDLLAKQERGAGNEIQLTDSMLKLKETDPFFAVRFDGSIYDCGSKIGFLMANVAYALSRPDIEGEFRAELNAMLAGN

SEQ ID NO: 31034 - protein, 143 aa, Arabidopsis thaliana
MIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 31035 - protein, 344 aa, Colwellia psychrerythraea 34H
MTQFKKIKQELLNSPKTWLITGCAGFIGSNLLETLLLLNQKVVGLDNFATGHQHNFDEVQTQVSAEQWQNFYFVKGDIRQLEDCQTALSHYKSGVDYILHQAALGSVPRSIADPLLTNSANITGFLTMLTAAKETQVKSFVYAASSSTYGDHPALPKVEDAIGKPLSPYAVTKYVNELYADVFHKTYGLNCTGLRYFNVFGKRQDPDGAYAAVIPKWTVAMIANEELLINGDGETSRDFCFVENAVQANILAATANDAGKNQVYNVALGDRTSLNTLFNSLKVALQANGVDYQKSPTYQDFRAGDVRHSQADISKAKSLIGFEPEFKIQQGIDKAMPWYIKFLN

SEQ ID NO: 31036 - protein, 401 aa, Zea mays
MAVEKTLPGASAGRTVLVTGGAGYIGSHAVLQLLLAGFRAVVIDNLSFHKIDLRDKGALEMVFASTRFEAVIHFAGLKAVGESVQKPLLYYDNNVIGTINLLEVMSVHGCKKLVFSSSAAVYGSPKNSPCTENFPLTPNNPYGKTKLVVEDICRDIYRSDPEWKIILLRYFNPVGAHPSGYLGEDPRGIPNNLMPYVQQVAVGRRPALTVLGNDYATRDGTGVRDYIHVVDLADGHIAALQKLFENSSIGCEAYNLGTGRGTSVLEIVKAFEKASGKKIPLIFGERRPGDAEILFSETTKAERELNWKAKYGIEEMCRDQWNWASKNPYGYGSPDSIKQNGHQTNGSADSSKQNGHRTNGSTDSPKRNGHHAYGSADSPKRNGHCVFGSSDLKPNGNGHLR

SEQ ID NO: 31037 - protein, 84 aa, Porphyra yezoensis
MQDNEIFEKVQDIVAEQLGIEKKIVTREANFSSDLGADSLDTVELVMAIEEKFSIEIPDEDAEKISNLSQVVDFIKSKLNTISV

SEQ ID NO: 31038 - protein, 233 aa, Edwardsiella ictaluri
MTEVVAREQLEDNVVLGTLMLEQNEVDGLVSGAVHTTANTIRPPLQLIKTAPGSSLVSSVFFMLLPEQVLVYGDCAINPDPTAEQLAEIAIQSADSAAAFGIDPRVAMISYSTGNSGAGSDVEKVREATRLAQEKRPDLVIDGPLQYDAAIMADVAKSKAPNSPVAGKATVFIFPDLNTGNTTYKAVQRSADLVSIGPMLQGMRKPVNDLSRGALVDDIVYTVALTAIQSSQQ

SEQ ID NO: 31039 - protein, 1297 aa, Oryza sativa Japonica Group
MGSASASSLPASAGFGENLVLILDFGSQYTHLITRRVRQLGVLSLCVSGTAPLASLAGLRPRAVVLSGGPHSVHASGAPTFPEGFLEFAAGAGAHVLGVCYGMQLLVQSLGGAVEAGEKQEYGKMEVEVTARSSALYGEGEVGKRQTVWMSHGDEVVRLPEGFEVVARSVQGAVAAVENREKRFYGLQYHPEVTHSPQGMETLRRFLFDVCGIKADWKMQDVLDEEIRTIQSMVGPDEHVICALSGGVDSTVAATLVHKAIGDRLHCVFVDNGLLRYNERERVMLTFESDLHLPVTCVDASEQFLSKLKGVKDPEMKRKIIGREFIAVFDDFAHKLEQKIGKRPGYLVQGTLYPDVIESCPPPGSGRTHSHTIKSHHNVGGLPKDMKLKLIEPLKLLFKDEVRKLGSILNVPESFLKRHPFPGPGLAVRVLGDVTEGNALEVLRQVDEIFVQAIKDAGLYDIIWQAFAVFLPVQTVGVQGDQRTHSNAVALRAITSEDGMTADWYYFEREFLVDVVNKICNNPYIVYLGSHPYGPDASAEEHARATQSHHDLLGSVLGSKQLAKDAILYSYTKNINGFAAHLEEEVATQIARHPDVVTVMASTMLKLHTTRSWDFMDMERDGQILPDSIWKHGRFGQDVIIANLDSGVWPESNSFTDEEVVGEVPKRWKGSCSDTAKYGVSCNKKLIGARYFNKDMLLSNPGAVDGNWSRDTEGHGTHTLSTAGGRFVPRASLFGYANGTAKGGAPRARVAAYKVCWSGECAAADVLAGFEAAIHDGADVISVSFGQDAPVATVASFLQEPVTLGSLHAAMNGVSVVCSAGNSGPLEDTVVNAAPWVTTVAASTVDRDFPNVVTLGNNAHMTGMSLETTTLHSTQLYSMIKASDAALASSDPAVASTCPPGTLDPEKVKNKIVVCVRGGDIPRVTKGMTVLNAGGTGMILANGEMDGDDIVADPHVLPATMITYSEAMSLYKYMDSSKNPVANISPSKTEVGVKNSPSVAAFSSRGPSGTLPCVLKPDIAAPGVDILAAFTEYVSPTEVPNDERRSEYAILSGTSMACPHISGVIGLLKAARPEWSPAAMRSAIMTTARTQDNTGAPMRDHDGREATAFAFGAGNIHPNRAVDPGLVYDLSKEDYFVFLCSMGFNSSDLAKLSAGNFTCPEKVPPMEDLNYPSIVVPALRHTSTVARRLKCVGRPATYRATWRAPYGVNMTVEPAALEFGKDGEVKEFKVTFKSEKDKLGKGYVFGRLVWSDGTHHVRSPVVVNALDIGLRRRDSCARYRSKTGADQGLGVLLLFIF

SEQ ID NO: 31040 - protein, 271 aa, Oryza sativa
  misc_feature (37)..(37): Xaa can be any naturally occurring amino acid
  misc_feature (167)..(167): Xaa can be any naturally occurring amino acid
  misc_feature (211)..(211): Xaa can be any naturally occurring amino acid
  misc_feature (261)..(261): Xaa can be any naturally occurring amino acid
MAAAWAAAVAVMLLLAQVSAAAPVMGPAFLWAPNNYXCSREDHAKSVDVAVLFLGSKLQSSDISKEKQAASARPGRLKNSFASSEFSMAFPYVAMSDDDKLEKSLLSGFAENCNNGLGDNHITYTDTCSVSEDLNKHHDMDSIHGLVASRGQTDLIVFCDGGFKDNXEGELLSELVTLLKKSGAKYTILYASQPFGVLENPSNLPLGRYLXRDHANPTKPGRGKCDGECLVKSTLLEGSFVGIVLLIILISGLKCMMGIDXPSKFDAPPES

SEQ ID NO: 31041 - protein, 496 aa, Vitis vinifera
  misc_feature (252)..(252): Xaa can be any naturally occurring amino acid
  misc_feature (254)..(254): Xaa can be any naturally occurring amino acid
  misc_feature (266)..(266): Xaa can be any naturally occurring amino acid
  misc_feature (273)..(273): Xaa can be any naturally occurring amino acid
  misc_feature (309)..(309): Xaa can be any naturally occurring amino acid
  misc_feature (457)..(457): Xaa can be any naturally occurring amino acid
  misc_feature (459)..(459): Xaa can be any naturally occurring amino acid
  misc_feature (474)..(474): Xaa can be any naturally occurring amino acid
  misc_feature (476)..(476): Xaa can be any naturally occurring amino acid
MDVDFDCVERRSSSTQQEEVAGIAEEKHFKEQQETEVDENFLELEESGKLKKISGNGNGSKENHSAGVQVQDCTEGLPTSSSSVVVVDENQELGNASKIEEKCLLGSVDEAEETRLVKSADSESFLVGSVNEAEQNHLVKSDDLESWNETVVKSFKTNSRHKSVEAGEKMVQNGDGGKVKPLRGKLKIEVIDDTAVIDSTSIPRSGNGCSRQKSKQETDERRDKRTRRKAKGGKQGLEANGKGKIVAQIVEXQXNESGTKRVYSRXEMEVLRXINSEEQRKMWMEIRCSLGPVVLKEYDGLENCTNHKXIRVNFDPRQQSAKKEKAPAILREVSSSNVDDEMQNLHPLDPAYGHSVGGKDSYADPEECSEDSDSDEDYSSIQRPAFLVEGEPDFDSGPPEDGLEYLRRVRFSPQTLHATQGEFPSLNQREPKPHQKGRKEDSTRPASLHNEVKGDPXFXLQKGIENTNLPKSTXCXGVAPKLRFYPKKPPKQRMLP

SEQ ID NO: 31042 - protein, 305 aa, Pichia jadinii
MATEKKQSTFLIDFLMGGVSAAISKTAAAPIERVKLLIQNQDEMIKQGRLAKRYDGIADCFRRTAGEEGVVSFWRGNTANVIRYFPTQALNFAFKDKFKAMFGFKKEEGYWKWFAGNLASGGLAGGSLFGSVYSLDYARTRLANDAKSAKGTGERDSTGLLDVYKKTLASDGIAGLYRGFLPSVVGIVVYRGLYFGLYDSLKPVLLTGSLENNSWAAFLLGWVVTTGASTASYPLDTVRRRMMMTSGQAVKYDGAFDAFRKIVAAEGVKSLFKGCGANILRGVAGAGVISLYDQLQVILFGKKFK

SEQ ID NO: 31043 - protein, 509 aa, Colwellia psychrerythraea 34H
MFELHASKVSNLKNDVLSGLTVALALVPEAVAFAFVAGVEPLVGLYAAFIVGLITAIFGGRPGMISGATGAMAVVMVSLVAIHGVEYLFATVVLTGVIQILAGIFKLGKFIRLVPHPVMLGFVNGLAIVIFLAQLGQFKVTNAAGELEWMQGTPLFTMAGLILLTMAIIHFFPKLTKAVPSTLVAIVGVSLLVFGIGLDTKLVGDVASIAGGLPTFSIPQVPFSFETFKIILPFALVLAAIGLIESLLTLTLIDELTGTRGRSNKECIAQGAANTVTGFFGGMGGCAMIGQSMINVNSGGRGRASGITAALALLGFILFASGLIEAIPLAALVGVMFIVVIGTFEWSSLRILGKVPKADAFVIILVSGVTVYSDLAVAVIVGVIVSALVFAWEHAKHILVHRSVNEDGSTVYEVNGPIFFGSIANFLEQFTPEDDSDDVIVEFKNARVVDHSAIEAIDTLAERYLSRNKNMHLKHLNKECKELLHKADKLVELNIIEDPEYHIVSDKLA

SEQ ID NO: 31044 - protein, 406 aa, Salmonella enterica subsp. arizonae serovar 62:z4,z23:--
MTFPVEKVRADFPILQREVNGLPLAYLDSAASAQKPNQVIDAESAFYRHGYAAVHRGIHTLSAQATESMENVRKQASRFINARSAEELIFVRGTTEGINLVANSWGAENIRAGDNIIISEMEHHANIVPWQMLCERKGAELRVIPLNPDGTLRLEVLATLFDDRTRLLAITHVSNVLGTENPLPEMIAQARQHGAKVLVDGAQAVMHHAVDVQALDCDFYVFSGHKLYGPTGIGILYVKEALLQEMPPWEGGGSMIATVSLAQGTTWAKAPWRFEAGTPNTGGIIGLGAAIDYVASLGLDKIGDYEQMLMHYALEQLAQVPDIRLYGPAQRLGVIAFNLGKHHAYDVGSFLDNYGIAVRTGHHCAMPLMAWYGVPAMCRASLAMYNTYEEVDRLVAGLTRIYRLLG

SEQ ID NO: 31045 - protein, 305 aa, Pichia jadinii
MATEKKQSTFLIDFLMGGVSAAISKTAAAPIERVKLLIQNQDEMIKQGRLAKRYDGIADCFRRTAGDEGVVSFWRGNTANVIRYFPTQALNFAFKDKFKAMFGFKKEEGYWKWFAGNLASGGLAGGSLFGSVYSLDYARTRLANDAKSAKGTGERDSTGLLDVYKKTLASDGIAGLYRGFLPSVVGIVVYRGLYFGLYDSLKPVLLTGSLENNSWAAFLLGWVVTTGASTASYPLDTVRRRMMMTSGQAVKYDGAFDAFRKIVAAEGVKSLFKGCGANILRGVAGAGVISLYDQLQVILFGKKFK

SEQ ID NO: 31046 - protein, 398 aa, Thiomicrospira crunogena XCL-2
MTMSAIRLKKNEDKRLKQGHMWIFSNEIDNQVSPLKNFEAGQVVTVEAANGKAIGVAYVNPNTLICGRLLSRNPKVQFNQAFLKKRIQAAQALREANFDAPFYRLVFGESDGLPGLVIDRFGDVFVAQITTAGMETLKEELVQTIENLYHPQALVLRNDSPSRELEGLSLYTEVAIGPLPEEIVIEENGAKFAIPTENGQKTGWFYDHRMARGRLQDFVKDKTVLDVFSYLGGWGIEAAVAGAKEVTCVDASTFALDGVDRNAELNGVAEKVITIEGNAFDVLKALATEAHKYDVVIVDPPAFVKRKKDFKAGADGYRRINELAMRLLNPDGILVSASCSHHMSRDALLQQIQLASRHIDRNIQMFDQGHQGPDHPIHPAIPETEYIKTFFFKVSKSW

SEQ ID NO: 31047 - protein, 336 aa, Staphylococcus aureus subsp. aureus Mu50
MRAAVVTKDHKVSIEDKKLRALKPGEALVQTEYCGVCHTDLHVKNADFGDVTGVTLGHEGIGKVIEVAEDVESLKIGDRVSIAWMFESCGRCEYCTTGRETLCRSVKNAGYTVDGAMAEQVIVTADYAVKVPEKLDPAAASSITCAGVTTYKAVKVSNVKPGQWLGVFGIGGLGNLALQYAKNVMGAKIVAFDINDDKLAFAKELGADAIINSKDVDPVAEVMKLTDNKGLDATVVTSVAKTPFNQAVDVVKAGARVVAVGLPVDKMNLDIPRLVLDGIEVVGSLVGTRQDLREAFEFAAENKVTPKVQLRKLEEINDIFEEMEKGTITGRMVIKF

SEQ ID NO: 31048 - protein, 123 aa, Brassica napus
  misc_feature (11)..(11): Xaa can be any naturally occurring amino acid
  misc_feature (16)..(16): Xaa can be any naturally occurring amino acid
  misc_feature (21)..(21): Xaa can be any naturally occurring amino acid
  misc_feature (30)..(30): Xaa can be any naturally occurring amino acid
  misc_feature (33)..(34): Xaa can be any naturally occurring amino acid
  misc_feature (37)..(37): Xaa can be any naturally occurring amino acid
  misc_feature (60)..(60): Xaa can be any naturally occurring amino acid
  misc_feature (64)..(64): Xaa can be any naturally occurring amino acid
  misc_feature (66)..(67): Xaa can be any naturally occurring amino acid
  misc_feature (71)..(71): Xaa can be any naturally occurring amino acid
  misc_feature (73)..(74): Xaa can be any naturally occurring amino acid
  misc_feature (86)..(86): Xaa can be any naturally occurring amino acid
  misc_feature (89)..(89): Xaa can be any naturally occurring amino acid
  misc_feature (92)..(93): Xaa can be any naturally occurring amino acid
  misc_feature (97)..(98): Xaa can be any naturally occurring amino acid
  misc_feature (102)..(103): Xaa can be any naturally occurring amino acid
  misc_feature (110)..(111): Xaa can be any naturally occurring amino acid
  misc_feature (114)..(114): Xaa can be any naturally occurring amino acid
  misc_feature (117)..(117): Xaa can be any naturally occurring amino acid
  misc_feature (120)..(120): Xaa can be any naturally occurring amino acid
EKEEEYSMLSXAAVVXTSPAXATMVAPFTXLKXXSAXPVTRKANNDITSIGSNGGRVSCXKVWXPXXKKKXEXXSYLPDLTEVELXKEXDYXXRNKXXPCVXXQLEHGFXXREXGSXPGXYPE

SEQ ID NO: 31049 - protein, 518 aa, Oryza sativa Indica Group
MEEGVVGGGGAAVLVALLVTVVLAVMRSAGSRSSKRGRLPPSPMALPIIGHLHLIRPPPHRAFDRILARHGPLVYLRLGPSTHCVVIGSADVARDFLKFEASIPERPPTAVTRQLAYGKAGFAFAPYGAYWRFVKRLCMSELLGPRTVELLRPVRAAELAGVLRAAQSAAERGEGVDMSHELVRMANNSIMRMVASALPGEMAEAARDCAKQVAELVGAFNAEDFVAVCRGWDLQGIGRRTNEVHARFDALLETIIAAKEEARRRSLGLGRRESSSKDLLDMLMDAAEDDTAEVKLTRDNIKAFVLDIFTAGSDTTATTVEWMLAELVNHPECMAKLRGELDAVVGRSRLVGEQDVARLPYLQAVLKETLRLRPPAVFAQRVTVEPVQVRGYTIPTDTQVFFNIFSIGRDATYWDQPLHFRPDRFLPGGAGATVDPKGQHPQLMPFGSGRRACPGMGLAMQAVPAFLAALVQCFDWAPPPSQPLPLDMEEAAGLVSARKHPLLLLPTPRIQPLPSFYS

SEQ ID NO: 31050 - protein, 367 aa, Prochlorococcus marinus str. MIT 9515
MKFINKIKNKFKGNYRKKRWPGLINAYRQYLPVSSKTPIISLNEGNTPLIFSESISNLLGNNTKVYLKYDGLNPTGSFKDRGMTMAISKAKEEGREAVICASTGNTSAAAAAYASRGGLRSYVIIPDGYVAQGKLAQALMYGAEIISIQGNFDKALEIVRDLSSEYPINLVNSVNPYRIQGQKTAAFEIVDDLGIAPDWLCIPMGNAGNITAYWLGFKEYRKIKKNLKLPIMMGFQSEGSAPLVKNIIVKDPETIATAIRIGNPVNRDKAKIVKKESKGDFQSVTDKEIIEAYKMLAKEGVFCEPASAASVAGLIKNKNRIKKGSTIVCVLTGNGLKDPDCAINNNDAVFRKNIEPSLKNITKVLGY

SEQ ID NO: 31051 - protein, 1155 aa, Staphylococcus aureus
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDATNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKHTIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTNTILSTTDSGGGDGTVKPDEKLYKIGDYVWEDVDKDGVQGTDSKEKPMANVLVTLTYPDGTTKSVRTDANGHYEFGGLKDGETYTVKFETPAGYLPTKENGTTDGEKDSNGSSVTVKNNGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYRFDNLDSGKYKVIFEKPAGLTQTGTNTTEDDKDADGGEVDVTITDHDDFTLDNGYFEEDTSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 31052 - protein, 146 aa, Nicotiana tabacum
MLPLSLLKTAQGHPMLVELKNGETYNGHLVNCDTWMNIHLREVICTSKDGDRFWRMPECYVRGNTIKYLRVPDEVIDKVQEEAKSRTDRKPPGVGRARARGGRDDSAVGRQPKGIGRGMDDGGAKGRGKGGPSAKSGGRGGGRGRG

SEQ ID NO: 31053 - protein, 326 aa, Xanthobacter autotrophicus Py2
MLLRSPRQAGEEAEALVSKVVCVGEVMVELARGSDGRFGLAYGGDTFNTAVYLARAGIEVAYATALGDDAFSDDILALGTAEGVDMSLVPRLKGRAPGLYLISTDASGERSFNYWRDTSPARTLFEAEGWQEVAAALVEARAVYFSGITLSLYSNQGLGRFLAALEMAGTSGQERTLTVFDGNFRPRNWGGDLNRARTVFAEALKRASMALPTFEDEVALWGDASPAATIERMTTFGLTEVVVKNGAAGALVHANGRTVEVPVERAVSPLDTTGAGDSFNAGYLAARLQGAGPEDAARAGHRLAAEVIMHRGAIIPRTAQEGVRTH

SEQ ID NO: 31054 - protein, 395 aa, Xanthobacter autotrophicus Py2
MLITTAPFDRIGEENAFAVLARATALAGQGRSILNLGIGQPDFRTPDHIVEAAVKALRDGQHGYTPSVGILPLREAVAADLNRRYGVEVDPDLVMIMPGGKVTMYAAIRLFGEPGAEILYPDPGFPIYRSMIEHTGATPVPVPIREENGFAFSAEETLALITPKTRLLIINSPANPTGGVTPAAEIDKLVKGLAAHPHVALMSDEIYDRFLFDGEEHRTLLAYPQIRDRLILLNGWSKTYAMTGWRLGYSIWPKDLYDKVRKLAVNCWSCVNAATQYAGIAALEGPQDAVDAMTAEFDARRRIVVDGLNALPGVRCATPKGAFYAFPNVSGTGWSEAKKLASALLEEAGVAVIGGPDFGVYGEGYLRLSYATSRENIAAALARMGDFLAANRKVA

SEQ ID NO: 31055 - protein, 299 aa, Colwellia psychrerythraea 34H
MNNKITKAVIPVAGLGTRMLPATKAIPKEMLPIVDKPMIQYIVDECVAAGIKEIVLVTHSSKNAIENHFDKSFELETTLEKRVKRQILDEIQAICPKGVTIMHVRQGEAKGLGHAVLKARPIIGESPFVVVLPDVILDDASSDLKTENLAAMLTRYYEVGHSQIMVEPVPINMVSNYGVADCKGHELVAGESKAMTAVVEKPPVDEAPSNLAVVGRYVLSEKIWDMLEFTPPGAGDEIQLTDAIASLMKIETVEAFHMTGKSHDCGSKLGYMKANVEYGLRHPELADDFKAYLQEIVNS

SEQ ID NO: 31056 - protein, 334 aa, Vibrio sp. Ex25
MAFNLRNRNFLKLLDFSTKEIQFLLELSAELKKAKYAGTEQKTLQGKNIALIFEKSSTRTRCAFEVAAFDQGAQVSYIGPSGSQIGHKESMKDTARVLGRMYDGIEYRGFGQSIVEELGTYAGVPVWNGLTDEFHPTQILADFLTMQEHGRGKQLHEMTFAYLGDARNNMGNSLMVGAAKMGMDIRLVAPKAFWPEEDLVATCQTIAQQTGAKITLTESVEEGVKGCDFLYTDVWVSMGESAEAWDERVALMTPYQINMDVIKQTGNPHVKFMHCLPAFHNDETTVGKEVAEKYGMKGLEVTEEVFESEYSIVFDEAENRMHTIKAVMVATLGS

SEQ ID NO: 31057 - protein, 292 aa, Picea sitchensis
MEGKEEDVKLGANKYSERQPLGTAAQTQEKDYREPGPAPLFEPGEFRSWSFWRAGIAEFMATFLFLYITILTVMGVKRSDNGSDGVCTGSVGIQGIAWAFGGMIFCLVYCTAGISGGHINPAVTFGLFLARKLSLPRAVFYMVCQCLGAICGAGVVKGFMESEYELDGGGANVVAPGYTKGDGLGAEIVGTFVLVYTVFSATDAKRSARDSHVPLLAPLPIGFAVFLVHLATIPITGTGINPARSLGAAIIYNKDHAWDDHWIFWVGPFIGAALAAFYHVIIIRAIPFKSRS

SEQ ID NO: 31058 - protein, 477 aa, Ralstonia metallidurans CH34
MERLFQAQRSAFAAAPYPALADRKQGLRRLRDAVRKHADSLAQAADRDFGGRAHAETMMVDVLPSVLHINHLLGGLRRWMRPSRRSVELLFLGNSAKVVYQPKGVVGIVVPWNFPVYLALGPLATALAAGNRCLIKTSEFAPRTSAALRALLAEAFTEDEVAIVEGDADVARQFTGLPFDHLVFTGSPEVGRHVMRAAAEHLTPVTLELGGKSPAIVSSSANLATAARRIAHGKTVNAGQICVAPDYALVPEALAARFATEVLNASAALFPADRDDYASIIHDRAHQRMNDLLDDARAHGAQVMRSAMPEDGRRVPLHVVLGVTPRMRIAREEIFGPILPVFTYRAFEDVVTHIRGGTRPLAMYYFGDDKAESTTLLQRTHAGGVTLNDWGWHVLNHDLPFGGTGTSGMGNYHGAEGFRELSHAKAVFSERKWFPIELFHPPYGTFIQRLTLRMFLGRPTAAPPVQTEASPVTASQD

SEQ ID NO: 31059 - protein, 426 aa, Halobacillus halophilus
MVADKPTDAANENNDKLDVLKSTQTVVKKALDKLGYPNEVYELLKEPVRMMTVRIPVRMDNDHIKIFTGYRSQHNDAVGPTKGGVRFHPNVSEKEVKALSIWMSLKAGIVDLPYGGGKGGIVCDPREMSFRELEGVSRGYVRAISQIVGPTKDIPAPDVFTNSQIMAWMMDEYSRIDEFNNPGFITGKPLVLGGSHGRETATAKGVTICIEEAAKKKGISVEGARVVVQGFGNAGSFLAKFMHDRGAKVIGISDAYGGLHDPDGLDIDYLLDRRDSFGTVTNLFKNTISNEELLELDCDILVPAAIENQIREENAHNIKASIVVEAANGPTTLDATRILSERGILLVPDVLASSGGVTVSYFEWVQNNQGYYWTEEEVEEKLHKVIVKGFDNVYKTAETRRVDMRLAAYMVGVRKMAEASRFRGWI

SEQ ID NO: 31060 - protein, 174 aa, Porphyra yezoensis
MANRKKQSKGKDKDSGWEERVVQVKRVTKVVKGGKKLSFRVILVIGNEQGQVGVGVGKASDVIGAVKKGVTDAKKHLVTVPLTKSNSIPHPINGISGAAKVILRPSAPGSGVIAGGSVRTVLELSGVQNILAKQLGSNNTLNNARAVLNGLTQLRTFSEAAKDRGVPIESLYST

SEQ ID NO: 31061 - protein, 792 aa, Salmonella enterica subsp. arizonae serovar 62:z4,z23:--
MSNNGSSPLVLWYNQLGMNDVDRVGGKNASLGEMITNLSGMGVSVPNGFATTADAFNQFLDQSGVNQRIYELLDKTDIDDVSQLAKAGTQIRQWIIDTPFQPALENAIRDAYAQLSSDDENASFAVRSSATAEDMPDASFAGQQETFLNVQGFDAVLVAVKHVFASLFNDRAISYRVHQGYDHRGVALSAGVQRMVRSDLASSGVMFSIDTESGFDQVVFITSAWGLGEMVVQGAVNPDEFYVHKSTLAAGRPAIVRRTMGSKKIRMVYAATQEHGKQVKIEDVPQEQRDIFSLTNEEVQELAKQAVQIEQHYGRPMDIEWAKDGHTGKLFIVQARPETVRSRGQVMERYTLHAQGKIIAEGRAIGHRIGAGMVKVIHDIGEMNRIEPGDVLVTDMTDPDWEPIMKKAAAIVTNRGGRTCHAAIIARELGIPAVVGCGDATERMKDGEKVTVSCAEGDTGYVYADMLDFSVKSSSIDTMPDLPLKIMMNVGNPDRAFDFACLPNEGVGLARLEFIINRMIGVHPRALLEFDDQDAALQNDIRELMKGFDSPREFYVGRLTEGIATLGAAFYPKRVIVRLSDFKSNEYANLIGGERYEPHEENPMLGFRGAGRYVAESFRDCFALECEAVKRVRNDMGLTNIEIMIPFVRTVDQAKAVVEELARQGLKRGENGLKIIMMCEIPSNALLAEQFLDYFDGFSIGSNDMTQLALGLDRDSGVVSELFDERNDAVKALLSMAIRAAKKQGKYVGICGQGPSDHEDFAAWLMEEGIDSLSLNPDTVVQTWLSLAELKK

SEQ ID NO: 31062 - protein, 246 aa, Oryza sativa Japonica Group
MPSAGAAAQPAPSPAVQGLFEACREVFGASAGAVPSPAGVERIKSVLDSISAADVSLTRNMSYFRRVNSNGIPKITYLHLYECEAFSIGIFCLPPRGVIPLHNHPNMTVFSKLLFGELRVKSYDWADASQDSTDAQLQGARLAKVKVDGTLNAPCATSVLYPEDGGNLHCFTAHTACAVLDVLGPPYDDGSGRHCQHYNVSSSAPSAGDSKPLPGDDGYAWLEECEPPDNFHLVGSTYMGPRIVDN

SEQ ID NO: 31063 - protein, 458 aa, Oryza sativa Japonica Group
MYGCVIGVQRGRTVEVVDTSDILLDTDPGTLDRDLLKKKLETYKKAFPGLAILGWYSIDTHVTNTDMETNQALMDASGTTFYLLFNPAMNLSLKDLPVTIYEKVHSTNRSPTPLIFVQGKYKTETVEAERISLDHTCPVVSDVSVPPLVGKGQHANIMQTSGFKLMLFEIPSGFAMFEVSQELIARPKDIWARFAYQDDITNVIVTLGSIQIHNKSVARDIIVGPGDELKEFILSFCTHNYLIVQDVELKDVIEKKLNIYCYCNPTVVGELTWGLNYVLHKLLPQEQSLTHEPYLPLSKAMSKQIKEYGFKISPREIDREFLRAMSFLNYLGYMSERYSLLLDHLFGQYRKNNMSDIEFAKSIASHLHSSEGIVPRDERYTRAEIMEFIDFIIAAPENRSRTLSFLRRIEAASIDDSPPPPSLPGGMGVSLLKRLRLDWITVCCLGCAVALYPFYRRV

SEQ ID NO: 31064 - protein, 177 aa, Magnetococcus sp. MC-1
MSQREKKNQEAVYESESEFIEKLVAIKRTAKVVKGGSRFNFSAIVVVGDGKGSVGYGLGKAKEVPEAIRKATDQAQKQMIKVEIKDGRTIFHETIGRFGAGNVVLRPASAGTGIIAGGSMRPIFEAIGISDVLAKSTGTSNPHNLIKATFAALQNISPPKRVAAKRGLAAKNVRIRD

SEQ ID NO: 31065 - protein, 353 aa, Paracoccidioides brasiliensis
MGCGMSTEDKEGKARNEEIENQLKRDKMLQRNEIKMLLLGAGESGKSTILKQMKLIHEGSYSRDERESFKEIIFSNTVQSMRVILEAMEGLDIPLDDQRAEYHVQTIFMQPAQIEGDCLPPDVGSAIDALWNDAGVQECFRRSREYQLNDSARYYFDSIKRIAASDYLPSDQDVLRSRVKTTGITETTFIIGDLTYRMFDVGGQRSERKKWIHCFENVTTILFLVAISEYDQLLFEDETVNRMQEALTLFDSICNSRWFTKTSIILFLNKIDRFKEKLPVSPMKNYFPDYEGGAEYTAACDYILNRFVSLNQAEQKQIYTHFTCATDTSQIRFVMMAVNDIIIQDNLRLCGLI

SEQ ID NO: 31066 - protein, 455 aa, Oryza sativa Japonica Group
MYGCVIGVQRGRTVEVVDTSDILLDTDPGTLDRDLLKKKLETYKKAFPGLAILGWYSIDTHVTNTDMETNQALMDASGTTFYLLFNPAMNLSLKDLPVTIYEKVHSTNRSPTPLIFVQGKYKTETVEAERISLDHTCPVVSDVSVPPLVGKGQHANIMQTSGFKLMLFEIPSGFAMFEVSQELIARPKDIWARFAYQDDITNVIVTLGSIQIHNKSVARDIIVGPGDELKEFILSFCTHNYLIVQDVELKDVIEKKLNIYCYCNPTVVGELTWGLNYVLHKLLPQEQSLTHEPYLPLSKAMSKQIKEYGFKISPREIDREFLRAMSFLNYLGYMSERYSLLLDHLFGQYRKNNMSDIEFAKSIASHLHSSEGIVPRDERYTRAEIMEFIDFIIAAPENRSRTLSFLRRIEAASIDDSPPPPSLPGGMGVSLLKRLRLDWITDVQLLFTLSTAEYE

SEQ ID NO: 31067 - protein, 2260 aa, Physcomitrella patens subsp. patens
MAACQQTLSQFGSQYSLTYASLPRAPVSTCTHKAHWLKALRFTGLRRASLNLSPRDRLHQRQQSCLHFSDVSPVKGLGLKPVLAGLSGVPEGNLGLYDPSFDKDSCGVGFVAELSAKPNRKIVTDAIEMLVRMKHRGACGCEVNTGDGAGILVSLPHDYFAKVLREDLDLDLPPIGKYAVGMVFLPTIEHRREESKKVFNKVAESLGHKILGWRPVKTNNSGLGKGAIDTEPVVAQVFLTPSSRSTNDFEQQMYILRKTSMIAIRAALNLAYGASKDFYICSLSSRTIVYKGQLKPDQLKNYYYNDLGDERFTSYMGLVHSRFSTNTFPSWDRAQPMRVLGHNGEINTLRGNVNWMHAREGLLQCNALNLTKDELQKLLPIVDAGSSDSGAYDGVLELLMRSGRDLPEAVMMMIPEAWQNDKLMDPERRAMYEYFSCLLEPWDGPALISFTDGRYLGAKLDRNGLRPSRYYITHDQRVIMASEVGVVDVDSKNVFKKGRLFPGMMLLVDFEKHKVVDDEELKKKYQSRYPYAEWLQRQKLTLEEIVESVPEEKRVTPPIIGALEVSYTLLYLSSTAVKTSDETMDHMGTRGIIAPLRAFGYTSESLELLLLPMADDGTEALGSMGNDTPLAVMSDRPRLSFEYFKQMFAQVTNPPIDPIREAVVTSTECMVGPEGDLTEVAESQCHRLSLKSPLLTLKEMEALKKTNYRGWRSKVIDITFPKSDGIDGLEMALDRICAEARLAVSDGYTVLALSDRATSAQRVPVSSLIAVGAVHHHLVASLERTRVALVIETGEPREVHHFCTLVGFGADAICPYLAIESIYSRLQVDGKVAPKKDGTLWSREEIVAKYFKASNSGMLKVLAKMGISTLASYKGAQIFEALGLSTEVVQRCFKGTPCRIEGATFEMLAQDMLRMHELAFPSRHLPDGCADAVALPNPGDYHWRLRAGEIHMNDPDAIAKLQEAARTGSTAAYREYSQIIQKLNRKCNLRGLLKFKDLPESEQIPLDEVEPASEIVKRFVTGAMSYGSISLETHTTLAVAMNRLGGKSNTGEGGEQPERMEPLEDGSMNPMRSAIKQVASGRFGVTSYYLTNSDEIQIKMAQGAKPGEGGELPGHKVIGDIAITRNSTEGVGLISPPPHHDIYSIEDLAQLIYDLKNSNPGARISVKLVSESGVGVVASGVVKGHADHVLIAGHDGGTGASRWTGIKNAGLPWELGLAETHQTLVANGLRGRTTVQTDGQLKNGRDIMVAALLGAEEFGFSTAPLITLGCIMMRKCHKNTCPVGIATQDPVLREKFAGQPEHVINFFFMVAEEAREIMASLGIRKMDDLIGRADLLEMDREAMGENEKVGNIDLSLLLRPAAEIRPGAAQRCVEAQDHNLEEALDQKLIALAQPALTKKVPVYVETPVVNVNRAVGTMLSHEVTKRFNRTGLPTDTIHVKLNGSAGQSLGAFLCSGITLELEGDSNDYVGKGLCGGKIIVYPPADSTFDPKENIVIGNVALYGATSGEAYFNGMAAERFAVRNSGANAVVEGVGDHGCEYMTGGKVVVLGETGKNFAAGMSGGIAYVLDKEGLFPKKCNTELVDLDPVEEEDDIMTLRSLIQQHQRATNSRLARYVLNHFEALLPNFIKVFPRDYKRVVNEKKAKEAAEIAAKEEEIELSKKDAFAELQKLAAQSAPAIAGINAASNERPTKISDPQKHGGFVKYERESLPLRPTEERLQDWDEVVEHGINESLLKTQSARCMDCGTPFCHQDHSGCPLGNKIPEWNELVYQGRWREALDRLLETNNFPEFTGRVCPAPCEGACVLGIIENPVTIKTMECTIIDKGWEMGWMVPRPPEERTGKKVAVVGSGPAGLAAADQLNKAGHTVTVYERSDRVGGLMMYGVPNMKTDKIDVVQRRVDLMAAEGIKFVTNAHVGMDPLYSIDTLRADNDALLLACGATKPRDLPIPGRDLSGVHFAMEFLHANTKSLLDSGLQDGNYISAKGKKVVVIGGGDTGTDCIGTSVRHGCSAMTNLELLPQPPPTRAPGNPWPQWPRIFRVDYGHEESAAKFGTDPRTYEVLTKRFIGNDEGKLTGLEIIQVKWEKDSTGKFQMQEIPGSEKIIEADLVFLALGFLGPEQNIAEKLGLECDPRSNFKADYGQFTTNLEGVFAAGDCRRGQSLVVWAIAEGRQAADKVDNYLMKDVPVEENAKSHVEGNGYGVGKPKERRYPEGLDKAKEEAVEACIAVHGSEDSDALKKCVELSVETAALGDNSVVSEQSY

SEQ ID NO: 31068 - protein, 442 aa, Oryza sativa Japonica Group
MYGCVIGVQRGRTVEVVDTSDILLDTDPGTLDRDLLKKKLETYKKAFPGLAILGWYSIDTHVTNTDMETNQALMDASGTTFYLLFNPAMNLSLKDLPVTIYEKVHSTNRSPTPLIFVQGKYKTETVEAERISLDHTCPVVSDVSVPPLVGKGQHANIMQTSGFKLMLFEIPSGFAMFEVSQELIARPKDIWARFAYQDDITNVIVTLGSIQIHNKSVARDIIVGPGDELKEFILSFCTHNYLIVQDVELKDVIEKKLNIYCYCNPTVVGELTWGLNYVLHKLLPQEQSLTHEPYLPLSKAMSKQIKEYGFKISPREIDREFLRAMSFLNYLGYMSERYSLLLDHLFGQYRKNNMSDIEFAKSIASHLHSSEGIVPRDERYTRAEIMEFIDFIIAAPENRSRTLSFLRRIEAASIDDSPPPPSLPGGMGVSLLKRLRLDWITV

SEQ ID NO: 31069 - protein, 356 aa, Paracoccidioides brasiliensis
MGGCCSSASGENAEQRKRSQMIDKGLEDDSKRLRRECKILLLGSGESGKSTIVKQMKIIHQNGYSVEELTLCRSTVYKNLLDCAKDLIGALHHFDLQPSSPKVQDYIEYLSSYQIDADPNTPIDPKVGDAVTYLWNDPIMPSVLEHQNEFYLMDSAPYFFEEAKRITAPDYIPNEADVLRARTKTTGIYETRFTMGQLSIHMFDVGGQRSERKKWIHCFENVTSIIFCVALSEYDQMLLEESNQNRMMESLVLFDSVVNSRWFMRTSIILFLNKVDLFRQKLDRSPLNKYFPDYSGGNDVNRAAKYLLWRFNQVNRAHLNLYPHLTQATDTSNIRLVFAAVKETILQNALKDSGIL

SEQ ID NO: 31070 - protein, 97 aa, Vitis vinifera
MAGGKVSFKVTLTSDPKLPFKVFSVPEAAPFTAVLKFAAEEFKVPPQTSAIITNDGVGINPQQSAGNVFLKHGSELRLIPRDRVGAFATLGAALVSG

SEQ ID NO: 31071 - protein, 480 aa, Salmonella enterica subsp. arizonae serovar 62:z4,z23:--
MTLSFTAHWRDELPATYTALLPTPLKNARLIWYNDKLAQQLAIPASLFDVTNGAGVWGGETLLPGMSPVAQVYSGHQFGVWAGQLGDGRGILLGEQLLADGSTLDWHLKGAGLTPYSRMGDGRAVLRSTIRESLASEAMHYLGIPTTRALSIVTSDTPVQRETQEAGAMLMRLAQSHMRFGHFEHFYYRREPEKVQQLADFAIRHYWPQWQDAPEKYDLWFEEVAARTGRLIADWQTIGFAHGVMNTDNMSILGLTIDYGPFGFLDDYDPGFIGNHSDHQGRYRFDNQPSVALWNLQRLAQTLTPFIEIDALNRALDRYQDALLTRYGQRMRQKLGFFTEQKDDNVLLNELFSLMAREGSDYTRTFRMLSHTEQQSASSPLRDTFIDRAAFDGWFDRYRARLRTEAVDDALRQQQMQSVNPAVVLRNWLAQRAIDAAEQGDMAELHRLHEILRQPFIDRDDDYASRPPEWGKRLEVSCSS

SEQ ID NO: 31072 - protein, 359 aa, Paracoccidioides brasiliensis
MGCASSQPVDPTDKIAARHTAAIDKMIRMDKKVQDRTVKILLLGAGESGKSTIIKQMRIIHAGGFPEDERYQNRAVIYSNMVVAFKILLDIMQTENIEFEFEKTKPLAKLLDQTEPDVDTNEAFSDLAVKDAMSGMWLDRGVQKAVLRGHEFALHDNLQYYFKSLNRVFTPGWLPNNQDMLHSRLRTTGITETLFELGQINFRMMDVGGQRSERKKWIHCFEGVQCLLFMVALSGYDQCLVEDQNANQMHEAMMLFESLVNGEWFKRKPVILFLNKIDLFKDKVSISPVSKFFPDYHGADGDYDAAAKYFSDRFRGITRVPEREIYIHYTNATDTTLLKATMDSVQDMIIQKNLNNLIL

SEQ ID NO: 31073 - protein, 211 aa, Oryza sativa Japonica Group
MLDKMKPEDVGLRADQEFFTARDDDEGIPLIKNTTLYECDNFTMIIFFLPRNAIIPLHDHPGMTVFSKLLIGSLHIRSYDWVDPEPALSCSSSSGDQLRLAKRVVNGVFTAPCDTSVLYPTTGGNMHRFRAIAPCAILDILGPPYSTEDGRDCTYYRAIPYSRHSVKNGAADQLTGVDEEGHRLSWLTETIPRMLRMRQIRYGGPPISDDE

SEQ ID NO: 31074 - protein, 538 aa, Bradyrhizobium japonicum USDA 110
MSILENTISPGSAAYHANRDGMLGLIDRMRALEERTRAASAAAKDRFHKRGQLLPRERVALVLDPGAPFIELSTLAGYMFDVPDPNKSVPGGGVIAGIGFVSGIRCMVSASDSGIDAGALQPFGLDKTLRVQELALENKLPYVQLVESAGANLLRYRVEDFVRGGNIFRNLARLSAAGLPVVTVTHGSSTAGGAYQTGLSDYIVMVRGRTRAFLAGPPLLKAATGEIATEEELGGAEMHTQVSGLGDYLAEDDRDALRIAREIMAALEWERPDRAAAQFKPPRYDQDELLGIMPMDHKRPVDMKQVIARIIDDSDFTEMAPNYGPATVCGHARIEGQAIGIITNNGPLDPAGANKATHFIQACCQTRTPILYLNNTTGYMVGKAYEEAGMIKHGSKMIQAVTSATVPQITIYCGASFGAGNYGMCGRGFHPRFCFSWPNAKTAVMGGEQAAETMAIVTEAAAARRGKPIEKDKLDAMKAQIVGVFDGQMDVFSTSARVLDDGVIDPRDTRAVLSEVLAICREGDARRPQRMQFSVARP

SEQ ID NO: 31075 - protein, 365 aa, Buchnera aphidicola
MKIKKYKIAVLPGDGIGPEIIKEAYKIISVIKKENDINLQTKEYDVGGIAIDKYNIALPEHTLIGCQNSDAILFGSVGGPKWNHLKLEKKPEISSLLSLRKIFNLFINLRPVKLHKKLLHFSPLKTNIIKKGFDILFIRELTGGIYFGVPKGRNELDPNNICAFDTAIYNTYEITRIAQFAFQQAQKRKKKLVSIDKSNVLESSKLWREVVTKISYTFPEVQIEHLYVDNAAMQLIQNPSQFDVILCPNLFGDILTDESASLIGSLGMLPSASLNQKNFGLYEPAGGSAPDLKGKNLANPIAQILSLAMLFKYSLGFLDISEAIEHAVITVLKQGHHTYDISDKINFISTDMMGTKISENLMKIL

SEQ ID NO: 31076 - protein, 446 aa, Mycobacterium sp. MCS
MSTLEQSRHLATAIPGPKSQQLIDRKAAAVSRGVGTTMPVYAARAQGGIVEDVDGNRLIDLGSGIAVTTIGNAAPRVVEAVAAQAGRFTHTCFMVTPYEGYVAVAEALNRLTPGSGEKRSALFNSGSEAVENAVKIARSYTHKSAVVSFDHAYHGRTNLTMALTAKVMPYKHGFGPFAPEIYRAPLSYPFRDAEFGKELATDGELAARRAIDVMDKQVGADNLAAVIIEPIQGEGGFIVPAEGFLPTLLDWCRRNDVVFIADEVQTGFARTGRMFACEHEGIEPDLIVTAKGIADGMPLSAVTGRAEIMDSPHVSGLGGTYGGNPVACAAALATIETIESENLVERAAAIGALMKDRLGRLQAEDDRIGDVRGRGAMIAVELVKPGTTEPDAALAKALAAGAHTAGVIVLTCGTYGNVLRFLPPLAISDELLDEGLDVVAGLLRDL

SEQ ID NO: 31077 - protein, 1005 aa, Cryptococcus neoformans var. neoformans JEC21
MTSFNPAPAQIQAAQDHTYGSMPTPTYMGMVDTGAQWDYVGRRGSSRSREPSASPQRAATESGIPRTSTHAASASASSSYAPVAGASGQASSAPHEPTIREEATAVVDRSMRAHQQTTGPSNGNGNSQPKKSKVRMVGDWQLNKTLGAGSMGKVKLATNIVTKEKCAVKIIPRYTDANRKEETTRTPEEVEKQRLKDESKEIRTIREAHISLLLHHPYICGMREFISHQNHHYMVFEFIDGGQMLDYIISHGRLRERAARKFARQIGSALNYCHQNSIVHRDLKIENILISKNGNIKLIDFGLSNLYSPSRHLSTFCGSLYFAAPELLNARPYTGPEVDVWSFGIVIYVLVCGKVPFDDQSMPALHAKIKRGVVEYPSWLSAEVKSLLSRMLVTNPAERATLAEVLSHPFMTKGYDGPPDSFLIRRELLRAEEIDMNVVEAMEGFTFGDANTIYRNLHSILTSEDYLHCVATFEAHREKLRTSSPGVSTNDPSDSPKKKRFSGFDLKKRLFKEDKKVEEAPFKEKVRDPTKGYDPLISIYFLAREKIERERVFGPGFFASSQLSLDTFNTSQGYGMAVPNLPPPASTHVMGHDSSRGPDFASEPRPRSDDVPNPVMAHPSADREQSKLADIPSAVHRRQPSLSQPPLPSSMPAAVERSADEGLTKKFSMLGRGPRPPSAGPAGPSRSASTKRESMTASPSMPIQEHRRATTVVHSDKSKQERRVSVGSFTNSVSKASGLARRASQRDRPPATPPDSRWLNAPAEAEEYHQVETSVRPSSTPREPEPDTANEPQSYDDVKPSYLKGIFSVSTTSTKPANVLIRDIAMVLDRIGIKHRPIKGGFECVHMPSIDLASVVNGDEASTSLSNVPSHASGARRKQSLRRKGSKVNMNGISSNGAGSRATSPGPHRVLTGNSSGTVSGGDVAHLSVPSGKNRHHVGTVEEDEVDAWALAQSGGAGSSLIVRFEIFVVKVPVLPLHGIQFRRVGGDGWQYQMLAKAILREMRL

SEQ ID NO: 31078 - protein, 174 aa, Mycobacterium sp. MCS
MTDISKVIASLMREVPDFPEPGIQFKDLTPLLADAEGLMAVTDALAATAEGADLVAGIDARGFLLGAAVALRLGTGVLAVRKGGKLPPPVHSQTYNLEYGSATLEIPADGLDIAGRSVVIIDDVLATGGTVAATHRLLTSGGATVLHAAVVLELTALGGREVVQPLSVSSLYTV

SEQ ID NO: 31079 - protein, 126 aa, uncultured marine gamma proteobacterium EBAC31A08
MATSKEDILKAIEEMSVMDLVDLISDIEEKFGVTAAAAVAAAPAAAAGGDAEAAEEKDAFDVVLNAAGDQKVQVIKAVRAITGLGLKEAKDMVDGAPSTVKEGASKDDAEAMLKQLTEAGATAELK

SEQ ID NO: 31080 - protein, 487 aa, Ustilago maydis 521
MAITILTGIEDTLALILECAADLARIESSLLPALRKLCSNPPSDGESSVRTASSSSRSQPPPASETVLCDLIQTNLDPLSALDPAVHSVGMLYILAARASQAATTVEGAVVLLPHITAFVQRFNLAQVQLAADKVTQLAASFTALGDRGTNPESALQLLQALASRFLTSSESITTLHPMLAYQYLKTARYAEAATMLIDLPLIDADTSITPLTHSDVLQYFYYAALIYIKLDRLHDAIDALETCISSPAVAVSAIHMDAYKKLVLVQLLADGKTSRVPRYTPQLITRMFNMSAQPYTLFVAAYEKWGDTQEVYRLAEEYHNAFEKDRNVGLIRRCLAVYRQRKIQKLAQVYSALSLGAIAQKIGLEGDDAVPSVYADVQEVVRKGWVRATLSSSPNATSSASASDANANWMVCFNIFAGDSYTSTSSISLLEDKIRIAKQWQTLLQQRDRQIGKSPTYLIRALKLRDARSAGADAFSVADELDDAEY

SEQ ID NO: 31081 - protein, 458 aa, Halobacillus halophilus
MQKQQTIIEESLKALMEDESFLPDLQAQTREQAFKSLVALLSTPNHIHKSFLRVTLDDNTIVRIPAFRVQHSDTVGPYKGGVRFHESVNEGEVSNLAKLMTLKNALHELPFGGGKGGVVIKPKEYNIKELNLICKKYVQYFDDILGPDKDIPAPDVGTGEREMDWMMGEFKNIHPGEPYRNSFTGKSVVNGGSLGRREATGKGVYFTFRYMMHNFLNENRKWLSDTDNIFANTALNHHDQKLSMAIQGFGNLGSVAALEAYQCDYLQNKIVAVSDHNVMLYNNDGLDVPALIKFTEESDGDLPTTEEELEEHEIKAEIRERDELLEMDCDVLLLAALEDQIHEDNMERIQASMIIEGANGPITEDADRYLADKGVLIVPDILANAGGVIVSYYEWIQGREAQFMTEDQVFERLFDKMKYTMDTILPQFFGDPFPLRQNCYIHSVMKLSTIMYRQGKLY

SEQ ID NO: 31082 - protein, 498 aa, Colwellia psychrerythraea 34H
MNEVNVIGHLINGEMVNDDVRTQAVFNPATGAAEKKVALASKQTVEQAISAAQTAFPAWRNTPAIKRARVMFRFKELLEQHADTICRLIGEEHGKISHDAAGELQRGIENVEYACGAPELLKGEHSKNVGPNIDCWSEFQPLGVVAGITPFNFPAMVPMWMFPLAIVCGNCFILKPSERDPSSTLYIAQLLKEAGLPDGVMNVVNGDKEAVDVLLSDERIKAVSFVGSTPIAEYIYATANANGKRCQALGGAKNHAIIMPDADMDNAVNQLLGAAFGSSGERCMALSVAVAVGDEAADALVEKMTEAMKNLSVGAHDKASNDFGPVITQAHKDKVEGYITSAQNQGATIVVDGRQPHVEGYENGFFVGATLIDGVTADMDSYVAEIFGPVLQVMRVKTMQEAMQLINDHEYGNGTCIFTRDGEAARYFSDNIQVGMVGINVPLPVPVAYHSFGGWKRSLFGDLHAYGPDGVRFYTKRKTITQRWPSSGVREGASFAFA

SEQ ID NO: 31083 - protein, 483 aa, Acinetobacter sp. ADP1
MDLQQQPLFRQKALVAGQWCDADNAEKTPIFNPATQELIGYVPNMGRAETERAIEAAYASWEMWKTKTAKERSALLKKWYDLILLNLDVLAEILTTEQGKPFNEAKGEIIYAASFIEWFAEEAKRIYGDIIPSPYPDARIVVNKQPIGVVAAITPWNFPAAMITRKVAPALAAGCPCIVKPAPETPFTALALADLAIQAGIPAEIMSVVTGDAAQIGDAIFASDHVRKFTFTGSTPIGKLLLEKSAKTLKKVSLELGGNAPFIVFDDADIEAAVEGALIAKFRNAGQTCVCVNRFLVQSGVYEKFIQVFKAKIESLKIGNGLEAGSEIGPLINAQAVAKVQSHIEDALSKNGRLITGGQVHATGELFFEPTLIADANTEMMVATQETFGPLAAIFKFDTEQQAIQMANDTEFGLAAYCYTRDLGRAWRMSEQLEYGMVGINKGLISNEVAPFGGIKHSGLGREGSKYGIEDYLEIKYTLFGGL

SEQ ID NO: 31084 - protein, 426 aa, Picea sitchensis
MGNKLSRRRSQQQPSSSQSQTTYRQLVPERLNTRRRQSQQQLAHTQQVPEVSLKEKYAFIPDQYETIDQVTAALRDSGLESSNLILGIDFTKSNEWTGRHSFNGRSLHEIGSIMNSYEQAISIIGRTMSPFDEDNLIPCYGFGDATTHDVNVFSFYENNRPCHGFEQVLERYKEIVPHLILAGPTSFAPVVEASMDIVEASGGQYHVLVIIADGQVTRSSDTRPEQLSPQEQKTIEAIANASRYPLSIILVGVGDGPWDMMRQFDDKLPRREFDNFQFVNFTSIMSKNLPQSAKEAAFALAALMEIPTQYKATIELKILGHQIGRVPNIVPRNPPLPTIQHDAAPSSLPDSTNFQSTASHNISSTENSPAGLSSESQSQACPVCLTNSREMAFGCGHMTCRNCSQNLSNCPLCRMPISTRLRVYSS

SEQ ID NO: 31085 - protein, 488 aa, Acinetobacter sp. ADP1
MQQFQLYINGKFEDGAAQFDSINPATGEIWAKMPEARTDQVNRAVDAAEQAFYDSSWSGLTASQRGKLLYKLADLVEKSAPRLAALETTDTGKIIRETSSQIAYVAEYYRYYAGLADKIEGSFIPVDKPDMQAWLVREPVGVVAAIVPWNSQLFLSAVKVGPALAAGCTVVLKASEEAPAPLLEFAKLIDEAGFPAGVVNVITGFGPECGAVLSAHPKVAHIAFTGGPETAKHIVRNSAENLAKVSLELGGKSPFIVFADTDINSALNAQIAAIFAATGQSCVAGSRLLIEESIKDEFLQRLAERVQSIKMGLPDDMQTEYGPLCTLKQREKIQQVVQRSVEQGAKLITGGQVCDGAGYYYPPTILDCSGVSDAQSIHTELFGPVLSVDTFSTEAEAIQKANSTPYGLASGVFTSNLTRAHRMTRAIRSGIVWLNTYRVVSPLAPFGGYGLSGHGREGGLSAALEYTTTKTVWLRMSDQPIDDPFVMR

SEQ ID NO: 31086 - protein, 412 aa, Oryza sativa
  misc_feature (373)..(373): Xaa can be any naturally occurring amino acid
MAQQLSAPFRAAAAAGSRASAAAADPAKVLRLRSAGSAQFTSIAASSSFARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAXGIGLSSSFMKLVSWYDNEWGYSNRVLDLIAHMALVNAKH

SEQ ID NO: 31087 - protein, 625 aa, Ashbya gossypii ATCC 10895
MSFQLFARTPAGPQIFEAYPSFQQVESPEVSGFITSKTSPCGRFLAVSSENGVRVFKNERFQELLLELALKDVYDLEFSPGGSYLSTWERPHVDNEQHDNVKIWFLNEDEPSAEQPKFQYQAKTQNAWSLQFSKLDNYALKRFGKELRIAKLDHSSPEFNFNQPYARLVPEGHLSTYLISPAEHPTICTFCDEKEGKPGQLTIYPITEGNIQKKTASKMVFKADSCQLKGNDLGNAVLCLAITDFDASNKSYYGENTLYLLSFQGVNGSLGGDSVRVPLGKEGPIHDFTWSPTSRQFGVIYGYMPATITFFDLKGNAVHSLAEQRKNTMIFSPSGRYILIAGFGNLQGAVEILDRHDKFKCFSKFDAANTSTCKWSPGGEFILTATTSPRLRVDNGLKVWHVTGKLCFVNEYTELLEASWRNACKYRPKRPDSHVILNWDSSKVEAAKDPAIVPSQLEVHPSVSAYSLKNPNKKNGGSSVSKPVGAYKPPHARRAAASNTSSPKSSVPGMTFKPTKSVVPGMAPKETKSAAKNRKKRENTGIRKGPDSDGGSSNGTTPEPKEPPKVNKETSPEEKKIRSLLKKLRAIESLKMRQADGDKLEDTQILKIQTEQAVLQELDYLGWKP

SEQ ID NO: 31088 - protein, 325 aa, Photobacterium sp. SKA34
MKHIAIIGECMIELNGKPFGSMHQTFGGDTLNAAVYLSRGCEANSKSDEVKVSYVTALGNDPISTGMLTRWEEEGVSTDLVLRDETRTPGLYLIQLDDQGERTFLYWRNQSAARYLLQHPNFELVKQALTQVDTVFLSGISLAILPEEDQISLLNLLVELKAQGVEIAFDSNFRPALWPEDNNQAVKNVYQAMYQLTDVALVTFDDEHLLWGDETPEQTIEHLTTLGVGKCIVKLGADGCLIQDSKNQGSSAALAPQAVPTQPVAQVVDTTSAGDSFNGGFLSAYLTGADLVTSCQRGNALASTVIQHRGAIIPKALTQPALDVV

SEQ ID NO: 31089 - protein, 763 aa, Solibacter usitatus Ellin6076
MKIRPEDALEYHSSAPAGKLAVNPTKPCRTQRDLSLAYTPGVAVPCLEIERDPSLAYKYTAKGNLVGVVSNGTAVLGLGNIGPLAGKPVMEGKAVLFKRFADIDVFDIELDTANADEVIRTCQILEPTFGGINLEDIKAPECFYIEETLRNTMKIPVFHDDQHGTAIISGAGLLNALEIGGKKIEDIKVVFNGAGAAAISCAAHYVRLGVRLENIVMCDTKGVIYEGRTEHMNSYKARYASKTKARTLEEALVGADVFFGLSSGGAVTQDMVRGMAPSPVIFAMANPDPEISYDDAIAARPDAIVATGRSDYPNQVNNVLGFPFIFRGALDVRATTINDEMKLAATRALAALAKEDVPDSVLRAYSIDRIEFGREYIIPKPFDPRVLIWEASAVAQAAMETGVAQQPVDLKQYREELEKRLGRANEVMRAMINKARRQPKRIVFTEGEEGKILRACQILLDEQIAEPILLGSAEKINAKIEELHLHLNGAQIVEPAKFARLHEYTEEFYSLRQRKGITRTEAEQTLLNPTTFGSMMLRLNDADALIGGLTTHYPDTIRPALQVIDIRPELRRVAGVYVLITAKGDIYFLADATVNIEPTAEDLAEIAIMAAEKARRFSVEPRVAMLSFSNFGSTRHPLADKVRRAVDLVRQRAPGLMIDGEMQADTAVVPHIIEETYPFSTLKGGANVLVFPNLESGNIAYKLLQRIGDCELIGPLLTGLSRPVHVLQRGSEVNDIVHVAAVAVVDAQEVGKPYRTLSQEPVA

SEQ ID NO: 31090 - protein, 410 aa, Triticum aestivum
  misc_feature (211)..(211): Xaa can be any naturally occurring amino acid
MAGDLRHRRAGGADAGEEEGDGGAEAAAKAKAGPPSGGEGADAAGPGRKEALGWLEWSRGWMGVVGEFFFQRIAASHLANPLELPPLDGVSIIVTGATSGIGLEIARQLAQAGAHLVMAVRRPKVARELIQKWQNEQTEVSMPLNIEVMELDLISLDSVARFADTWNARMAPLHVLINNAGIFTIGEPQRFTKDGYEEHMQVNHLAPALLXAMLLLPSLIRGSPSRIINVNSVMHTIGFVDAEDMNLTSGKHKYRSWLGYSNSKLAQVKFSSIFHKRIPAEAGVHIVCASPGIVHTNVARDLPKILVAGYRFIPYFIFDPQEGSRSTLFAASDPQVPEYCETLKSEDWPVCACINYDCNPMNASEEAHNLETSQLVWEKTLEMIGLPSDALEKLIEGEPVQCRYGQQKAE

SEQ ID NO: 31091 - protein, 559 aa, Gibberella zeae PH-1
MKKNHGSKQQEAVQQLNFHHHNKSPSSRIDTMAAQVGPLPQLKLPSGPTPMTAEQRYWKTFKNQILIPSPTNYPIVHISSNSESFAITTGTRIQIFSNRTRKLLKTVTRFADVARSGELRRDGRVLAAGDDTGKIQVFDISSRAILKTWAHHKQPVWTTKFSPTELTTLLSASDDKTVRLWDLPSNDPTATFVGHSDYVRCANFMPGTMSNMIVSGSYDSTVKLWDPRTGRNSAVMTFKHAAPIEDVLSMPTGTTVLAAAGESISVLDLVGARPLHMITNHQKTVTALSLASNGRRLISGGLEGHVKVFETTGWNVVSSTKYQSPVLSVKVISSGDDSDSSDRHLAVGMQSGVLSVRTRLTAPEANREAEREKEMAALIAGTIDAHDAKKKKRKRRVTAAKKLDMIGEGADVVIANEPRTHKKKERSWQSDLRHARYACALDLVLDKHSPDHSPLNVLTLLLALRHRSALRDALESRDEHTVQPILKWVCGHICDPRYVSVCVEVGLHLIELYAEFAGGSAELQEGFRTLYRRVKAEVERAQSACQTGGMLESLMAGIL

SEQ ID NO: 31092 - protein, 539 aa, Oryza sativa Japonica Group
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKHQFVAVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 31093 - protein, 543 aa, Picea sitchensis
MIGPPRPPAQYSDDHDNEETIGPPKPPYLEGGEESDQMVGPSKRRSDDETSDDSDNEDDAVDFRVPLSNEVVLKGHTKVVSALAIDHTGSRVLTGSYDYSVRMYDFQGMTSQLKSFRQLEPSEGHQVRSLSWSPTSDRFLCVTGSAQAKIYDRDGLTLGEFVKGDMYLRDLKNTKGHITGLTCGEWHPKEKQTILTSSEDGSLRIWDVNNFNSQKEVIKPKLAKPGRVPVTACAWGRDGKCIAGGVGDGSIQVWNLKSGWGSRPDLYVAKGHDDDITGLQFSADGNILLTRSTDETLKVWDLRKTITPLQVFKDLPNNYAQTNVAFSPDERLIYTGTSVERDGNSGGLLCFYDRQTLELVLRIGVSPVHSVVRCTWHPRLNQVFATVGDKKEGGTHILYDPALSERGALVCVARAPRKKSLDDFEAKPVIHNPHALPLFRDEPSRKRQREKARIDPIKSQRPDLPVTGPGFGGRVGSTKGSLLTQYLLKEGGMIKETWMEEDPREAILKYADVAAKDPKFIAPAYAQTQPETFFAESDSEEEK

SEQ ID NO: 31094 - protein, 528 aa, Candida albicans
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEEAYKHLTTPVFGTGVIHDCPNSRLMEQKKLAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 31095 - protein, 528 aa, Candida albicans
MAIVETVIDGINYFLSLSVTQQISILLGVPFVYNLVWQYLYSLRKDRAPLVFYWIPWFGSAASYGQQPYEFFESCRQKYGDVFSFMLLGKIMTVYLGPKGHEFVFNAKLSDVSAEEAYKHLTTPVFGTGVIFDCPNSRLMEQRKFAKFALTTDSFKRYVPKIREEILNYFVTDESFKLKEKTHGVANVMKTQPEITIFTASRSLFGDEMRRIFDRSFAQLYSDLDKGFTPINFVFPNLPLPHYWRRDAAQKKISATYMKEIKSRRERGDIDPNRDLIDSLLIHSTYKDGVKMTDQEIANLLIGILMGGQHTSASTSAWFLLHLGEKPHLQDVIYQEVVELLKEKGGDLNDLTYEDLQKLPSVNNTIKETLRMHMPLHSIFRKVTNPLRIPETNYIVPKGHYVLVSPGYAHTSERYFDNPEDFDPTRWDTAAAKANSVSFNSSDEVDYGFGKVSKGVSSPYLPFGGGRHRCIGEQFAYVQLGTILTTFVYNLRWTIDGYKVPDPDYSSMVVLPTEPAEIIWEKRETCMF

SEQ ID NO: 31096 - protein, 118 aa, Panax ginseng
LCAGGELFDRIIAQGHYSERAAATICRQIVNVVHVCHFMGVMHRDLKPENFLLSCKDEGAMLKATDFGLSVFIEEGKVYRDIVGSAYYVAPEVLRRSYGKEIDIWSAGVILYILLSGV

SEQ ID NO: 31097 - protein, 417 aa, Mycobacterium smegmatis str. MC2 155
MTELSQALKQATGVIAARGEGVLLYDEQDRRYLDFTAGIGVTSTGHCHPRVVEAAQRQVGTLIHGQYTTVMHRPLLTLVERLGEVLPAGLDRMFFANSGSEAIEAALRLSRQATGRPNVIVFHGGFHGRTVAAASMTTSGTKFRSGFSPLMAGVHVSPFPDPTHFGWPVEQTTDFALSQLDYVLQTVSAPADTAAFFVEPVLGEGGYVPANERFLAGLRERADAHGILLVLDEVQTGYGRTGKFWGGEHFDAKPDILVTAKGLASGFPLSGIAASSELMAKAWPGSQGGTYGANAVACAAAIATLDVIADENLVANAAERGAQLKQALQTVADKHEQITDVRGLGLMIGNEFRDADGKPDGTTAAAVQQEAARRGLLLLTCGAWGQVVRFIPALVVSADEVEEAAGIWADAVSAVVS

SEQ ID NO: 31098 - protein, 494 aa, Mycobacterium smegmatis str. MC2 155
MPTTISTPRYLLDQARRRFTPTPNTIPGMGAIEKRLKRKQWDQFVFSTPPAGSGLKPIMGDSGLPVLGHMIEIFRGGPDFILEQYRRNGPIHYAYSPALSSVMALGPDATQTVFSNRNKDYSQRAWDPVIGPFFEGGLMLLDFDEHMYHRRIMQDAFTRSRLTGYIPHIDSVASQVLANDWVSDDPRFLFYPAIKELTLDIASEVFMGVPAGTDKKLVTTVNHAFTTTTRAGNAIVRTPVPPLKWWRGIQARKTLEDYFLSRIDEKRRAESTDMFSVLCHSADEDGQTFTDDQIVSHMIFLMMAAHDTSTSTMTTMAYHLAANPEWQDRLRDESERIGDGPLDIEALEKLETYDLVINEALRMMTPLPFNFRQAVRDTELLGYFIPAGTNVVTWPSINHRLPELWTDPEKFDPERFAEPRSEHKKHRYAFAPFGGGAHKCIGMVFGQLEIKTVMHRLLRQYRLELPRPGYTPRYDYGGMPVPIDGMPIVLRPLR

SEQ ID NO: 31099 - protein, 333 aa, Triticum aestivum
FFFVPVSAVAIIVLVATCSIIALKIHRSGRSPFPSLTGKDYNDRRDNIKKILGNYGSLAPRRYQFSHLKKVTKSFGEKLGQGSYGMVYKGTLANGRHVAVKFLHDTTGNGEEFVNEVISIRRTSHVNVVTLLGFCLEGSKRALIYDYMPNGSLDKFIYTENSKQALGWETLYGIATGIARGLEYLHRGCNTRIIHFDIKPQNILLDQDFVPKIADFGLAKLCNPKESYLLSMDGMRGTVGFIAPEVFSRRFGVVSTKSDVYSFGMVLLEMVGGRRNLRASVERESEVYFPDWAHSHLAQFGSLQPFDLGFDGPEEIAKKMATIGLWCIQISPA

SEQ ID NO: 31100 - protein, 187 aa, Brassica napus
  misc_feature (46)..(46): Xaa can be any naturally occurring amino acid
YKQDHKCFAFEHFVSNVMFEAFHLPHFSPRARPRVRQSKTEREAWXAELRSMKAKDYLRARPKSRFARFCRIKFLQLIHPKMEEAFFGHTHLRNQVSAGVFPETSLCSGFLEMAKRVWLLHCLALSFEHEAEIFRVHRGCRFSEVYMKSVAEEALEETEQPRVAFTVVPGFRVGNSLIQCEVYLSGS

SEQ ID NO: 31101 - protein, 336 aa, Zea mays
  misc_feature (195)..(195): Xaa can be any naturally occurring amino acid
MAEEPAIVVAASSSCEVDLGNLMAYDPCHHVAAAASASRMRGLAGAKKLREELRQECLRKGTELAQAVADALFALPPTEDRDGPIVHLPPHTVRLPREKHLPKPKPPTKWELFAKAKGITKRKKNKREWDEQTQSWKRTYGYDRVNDDKDVPILEAKLTDEPGVDPFAQRRDEKKKRVEKQEKSRLENLKKAAKXHIQLAAKALPITGTKADLPKKSRKEDLESVVGMASSATASGGKFDEKLPGEKPPKHPGKHRKFLPVAEGKGMGSLEKQQNDKILNSLLARNSDEPLDVGKAITMYKVKKEKQRRKEKGMSSKSDKLKPQKKPHKKSSKKKA

SEQ ID NO: 31102 - protein, 165 aa, Cryptococcus gattii
RIQDPQMTGYVSTRYYRAPEIMLTWQKYDVAVDIWSTGCIFAEMLEGKPLFPGKDHVNQFSIITELLGTPPDDVIQTIASENTLRFVQSLPKREKVPFSTKFPNADPVSLDLLEKMLVFDPRTRISAAEGLAHEYLAPYHDPTDEPVAAEVFDWSFNDADLPVDT

SEQ ID NO: 31103 - protein, 188 aa, Legionella pneumophila str. Lens
MNKIICLLSNLLLAVGIMSAHAETAIIKTSEGNITCELFTKEAPNTVANFVGLATGTKEFKDVKTGKMVKRPFYNGLNFHRVIAGFMIQGGDPLGNGTGGPGYTFDNENTNASFNKPGVLAMANAGPNTNGSQFFITVAPTPELQGNYNVFGQVISGQEVVDKISKMPTDPQDKPITPVVIENITIQR

SEQ ID NO: 31104 - protein, 297 aa, Arabidopsis thaliana
MRFSSSRPVSSPGRTENPPLLMRFLRTKSRSRSRSRSRRPIFFRRKNASAAAETQEPTSPKVTCMGQVRINRSKKPKPETARVSGGATERRRQSRRCGWVKNAFPCHSFTGIIKPTCFSPVWRKWKSFSHASFSKKSEKRSSSSRSEPIFGRSTVEPEEPEETRKEENQEEEASSCKSFTATPPRNAFLLTRCRSAPYRSPSSANSLFEDQEETNKAPFQRHASSENVSVSEEPKTSVTETTERLEDSRRESAASEEPKRSVLGSPRQCLILTRCNSEPARLVPEMGYRQNPRLGFT

SEQ ID NO: 31105 - protein, 2108 aa, Mycobacterium bovis AF2122/97
MGKERTKTVDRTRVTPVAVIGMGCRLPGGIDSPDRLWEALLRGDDLVTEIPADRWDIDEYYDPEPGVPGRTDCKWGAYLDNVGDFDPEFFGIGEKEAIAIDPQHRLLLETSWEAMEHGGLTPNQMASRTGVFVGLVHTDYILVHADNQTFEGPYGNTGTNACFASGRVAYAMGLQGPAITVDTACSSGLTAIHLACRSLHDGESDIALAGGVYVMLEPRRFASGSALGMLSATGRCHAFDVSADGFVSGEGCVMLALKRLPDALADGDRILAVIRGTAANQDGHTVNIATPSRSAQVAAYREALDVAGVDPATVGMVEAHGPGTPVGDPIEYASLAEVYGNDGPCALASVKTNFGHTQSAAGALGLMKAVLALQHGVVPQNLHFTALPDKLAAIETNLFVPQEITPWPGADQETPRRAAVSSYGMTGTNVHAIVEQAPVPAPESGAPGDTPATPGIDGALLFALSASSQDALRQTAARLADWVDAQGPELAPADLAYTLARRRGHRPVRTAVLAATTAELTEALREVATGETPYPPAVGQDDRGPVWVFSGQGSQWAGMGADLLATEPVFAATIAAIEPLIAAESGFSVTEAMTAPEVVTGIDRVQPTLFAMQVALAATMKSYGVAPGAVIGHSLGESAAAVVAGALCLEDGVRVICRRSALMTRIAGAGAMASVELPAQQVLSELMARGVNDAVVAVVASPQSTVIGGATQTVRDLVAAWEQRDVLAREVAVDVASHSPQVDPILDELAEALAEISPLQPEIPYYSATSFDPREEPYCDAYYWVDNLRHTVRFAAAVQAALEDGYRVFTELTPHPLLTHAVDQTARSLDMSAAALAGMRREQPLPHGLRALAGDLYAAGAAVDFAVLYPTGRLINAPLPTWNHRRLLLDDTTRRIAHANTVAVHPLLGSHVRLPEEPERHVWQGEVGTVTQPWLADHQIHGAAALPGAAYCEMALAAARAVLGEASEVRDIRFEQMLLLDDETPIGVTATVEAPGVVPLTVETSHDGRYTRQLAAVLHVVREADDAPDQPPQKNIAELLASHPHKVDGAEVRQWLDKRGHRLGPAFAGLVDAYIAEGAGDTVLAEVNLPGPLRSQVKAYGVHPVLLDACFQSVAAHPAVQGMADGGLLLPLGVRRLRSYGSARHARYCCTTVTACGVGVEADLDVLDEHGAVVLAVRGLQLGTGASQASERARVLGERLLSIEWHERELPENSHAEPGAWLLISTCDATDLVAAQLTDALKVHDAQCTTMSWPQRADHAAQAARLRDQLGTGGFTGVFVLTAPQTGDPDAESPVRGGELVKHVVRIAREIPEITAQEPRLYVLTHNAQAVLSGDRPNLEQGGMRGLLRVIGAEHPHLKASYVDVDEQTGAESVARQLLAASGEDETAWRNDQWYTARLCPAPLRPEERQTTVVDHAEAGMRLQIRTPGDLQTLEFAALDRVPPGPGEIEVAVTASSINFADVLVTFGRYQTLDGRQPQLGTDFAGVVSAVGPGVSELKVGDRVGGMSPNGCWATFVTCDARLATRLPEGLTDAQAAAVTTASATAWYGLQDLARIKAGDKVLIHSATGGVGQAAIAIARAAGAQIYATAGNEKRRDLLRDMGIEHVYDSRSVEFAEQIRRDTAGYGVDIVLNSVTGAAQLAGLKLLALGGRFIEIGKRDIYSNTRLELLPFRRNLAFYGLDLGLMSVSHPAAVRELLSTVYRLTVEGVLPMPQSTHYPLAEAATAIRVMGAAEHTGKLILDVPHAGRSSVVLPPEQARVFRSDGSYIITGGLGGLGLFLAEKMANAGAGRIVLSSRSQPSQKALETIELVRAIGSDVVVECGDIAQPDTADRLVTAATATGLPLRGVLHAAAVVEDATLANITDELIERDWAPKAYGAWQLHRATADQPLDWFCSFSSAAALVGSPGQGAYAAANSWLDTFTHWRRAQDLPATSIAWGAWGQIGRAIAFAEQTGDAIAPEEGAYAFETLLRHNRAYSGYAPVIGSPWLTAFAQHSPFAEKFQSLGQNRSGTSKFLAELVDLPREEWPDRLRRLLSKQVGLILRRTIDTDRLLSEYGLDSLSSQELRARVEAETGIRISATEINTTVRGLADLMCDKLAADRDAPAPA

SEQ ID NO: 31106 - protein, 408 aa, Psychrobacter arcticus 273-4
MNHNLTTLHPYPFAKMATLLADSTPAHSYDEIKLGIGEPKHAPPAFVLDVLRENLDKISHYPTTNGLFELRQTIAHWLEKRFFLNHVNPNTQVLPVMGTREAIFSIVQAVINHQTETISQTATLNQSPVVVMPNPFYQIYEGAAILAQATPYFIPCTADNGFKGDFRSVPKDVWMRTQLLFVCSPNNPTGSVMTMDDWEQLLRLSDQYGFIIASDECYSELYFDKAPIGLLQACAALGRHDFKNCLVFHSLSKRSNLPGLRSGFVAGDATILDSYLQYRTYQGCAMPIPHQLASIAAWEDEKHVAHNRALYQEKFALWMSELGALLDLRMPEAGFYFWIKAPEQFDGDDELFVKALYEHANIHALAGRYLSREVNGKNPGQGYVRIALVASVEESREAIRRIRQLLGA

SEQ ID NO: 31107 - protein, 398 aa, marine gamma proteobacterium HTCC2143
MNPDLNRLQPYPFEKLNALKATVTPPASLSHIALSIGEPKHTSPDFVKQVLMDNIDKLSNYPTTKGLPELRESIALWLSHRFHLGQDGVDPERQVLPVNGTREALFSFAQAVIDRSEKPLVISPNPFYQIYEGAAYLAGAEPYFLPCLPENGFIPDFSAVADDVWERCQLLFLCSPGNPTGAVIDSDILKDLIELADRFDFIIASDECYSELYRDENNPPAGLLQACAEMGRRDFRRCVVFHSLSKRSNLPGLRSGFIAGDDQVLSRFLLYRTYHGCAMPVQHQLASAAAWSDEQHVKTNRTLYRAKFDAVLDILGDCMNVSRPDAGFYLWPETPINDTDFAVQLFAQQHMTVLPGQYISREVNGFNPGENRVRMALVAPLQECIDGALRIKTFINGL

SEQ ID NO: 31108 - protein, 464 aa, Oryza sativa
MRPAFSWRKLWRFTGPGFLMCIAFLDPGNLEGDLQAGAAAGYQLLWLLLWATVMGALVQLLSARLGVATGKHLAELCREEYPPWATAALWAMTELALVGADIQEVIGSAIAIKILSAGTVPLWGGVVITAFDCFIFLFLENYGVRKLEAFFGVLIAVMAVSFAIMFGETKPSGKDLLIGLVVPKLSSRTIKQAVGIVGCIIMPHNVFLHSALVESRKIDTNKKSRVQEAVFYYNIESILALVVSFFINICVTTVFAKGFYGSEQADGIGLENAGQYLQQKYGTAFFPILYIWAIGLLASGQSSTITGTYAGQFVMGGFLNLRLKKWLRAMITRSFAIIPTMIVALFFDTEDPTMDILNEALNVLQSIQIPFALIPLITLVSKEQVMGSFVVGPITKVISWIVTVFLMLINGYLILSFYATEVRGALVRSSLCVVLAVYLAFIVYLIMRNTSLYSRLRSAMTKST

SEQ ID NO: 31109 - protein, 559 aa, Ralstonia metallidurans CH34
MMGFPSRSANRERAAMTRVEPLRLVRSEQLDRLESEAFDILIVGGGVTGAYAALDASLRGYRVALVEKNDFASGTSSKSSKMVHGGLRYIEQGNLGLVRHSLLERQRLRRNARHLVQRLPFLFPVMERDGVFDKRLAKAFEGLLWTYDLAGGWREGILHQKLTKAEVLSHCPTFNDEHLKGGFLYFDARVDDARLTLNIARTAAFHGAVVTNHALVTEITRHASGKVDGAIIQADGREIRARADVVIMATGVWLRDWTGGRKGEQKTLNIRPAKGVHVAIPWLKIRNDCTVTIPVPGRSRRATITRWGNVSYLGTTDEDYEGDLDNVMCTRQELDFLLEGARSALKTDIAPEDVVGSIAGCRPLVAPPGGKTLEVRRDHHIHIAGDGLVTIVGGKLTTSRHMAEQTVDAAQKVLGKRAKCRTKSAFLLGAAGYDPQAIVASGGMSAHLGERYGTEARFVSDILQADPALARPIVEGLPHSEAEIVYAVRHEMAGTVDDVLSRRIRARLMARDASAQAAPRVAQILQAELGLSGQAVAQQVSDYLAAVALEKSVLMGEAT

SEQ ID NO: 31110 - protein, 707 aa, Oryza sativa Japonica Group
MGVVGALLGPEAEALVRLRAAAWRLRREVAAATDDDEHWAFAYSMLHRVSRSFAIVIQQLGPDLRNAVCVFYLVLRALDTVEDDTSIPTEIKVPILQEFHRHIYNRDWHFSCGTKDCKILMDKFHYVLTAFLELGSGYQEAIEEITRRMGAGMAKFICKELLSVILACAPGHLHMNTSLLAKAWLQPNHLVCSIPKPTAMQIAFVSYCIYVGLCVVETVDDYDEYCHYVAGLVGIGLSRLFHAAGLEDLAPESLSNSMGLFLQKVNITRDYLEDINEIPKSRMFWPREIWSKYVDKLEDLKYENNSVKAVKCLNEMVTNGLIHTEDCLRYMSALKDITILRFCAIPQSSLLSSTETATYFICKQREFIFQHSCTLIGLTARIINETNSMADVYTAFYEFSSLLAEKIDDNDPNASLTRKRVNAIKETCKSSGLLKIRGYDLDRPKRNPAMVTFLYTIIHRSPICPPRHLQYIQLREICTATQYCRQTIWIALSIRYCCVWDSGGCLTHAQNADEILLRRGVLLSSPTLLPPSSSAVTAGGSTATIAGEGSTSDSGLSGIPPAASPPPPPLPLSWRRNERGEDNERGEDNGNDDDAAPRGVDGASGETTMAANAAVGEGPCLRSSALSGSSKVRPDEPCRRNDTDDLCIFDIDRRPVSIITRQNALICIQVKKIAILRIIARVSLQENIQGKKWNLRKILALKGNKQL

SEQ ID NO: 31111 - protein, 358 aa, Solibacter usitatus Ellin6076
MNRHHYGLILAGGRGTRFWPRSRKRTAKQVLNVVGERSLIQATVDRLAPVIPPERIWILTNDHLRDIIIKQLPDVPARQILAEPMQRNTAPAIGLAAQILHQQDPEAVMGVFPSDHVIGKNPQYRAVIKSALKAAGQGHLMVVGIQPRWPETGYGYIEFPKSTAAGAGEALAVKRFHEKPVLAKAKRYVAAGNFYWNSGMFFWRTGVLLEQLRLHLPRTATVLASLPRFGGRRFAEQLKTAFPLCDNISIDYAVLEKAKGVHGIAAGDFGWNDVGSWNAVYELLERDQHGNAIALESIALDSHNNFVDARGKVVALVGVSDLIVVDTPDALLVASRDRAQQVGDIVKALEQRNRHDLL

SEQ ID NO: 31112 - protein, 176 aa, Xylella fastidiosa
MSGLFRGRVMTGLNVRIGQGYDVHAFGPGDHVMLGGVRVPHRCGVLAHSDGDVILHALCDAMLGALGLGDIGQHFPPSDVRWKGADSGVFVRHCHLLLRERDWCVGNVDATAICESPKIAPYVNAMREGIARLLEVQPECVSVKATTSEGLGFIGRGEGLAAQVVVLLYRLNGVVV

SEQ ID NO: 31113 - protein, 173 aa, Mycobacterium smegmatis str. MC2 155
MPEPLIIPILGHAPQLDPESFVAPNASVIGQVSLAARASVWYGATLRAESEPIEIGEGSNIQDGVTVHVDPGFPCRLGTGVTVGHNVVLHGCTVEDDSLIGMGAVVLNGAVIGAGSLVAAGAVVPQGMVVPPRSLVAGVPGKVRREMSDDEVEHNRFNAKAYVHLIDLHRQAG

SEQ ID NO: 31114 - protein, 295 aa, Mycobacterium smegmatis str. MC2 155
MPFQLSTADGVEEARRKFSELPRAEIHPELSVHDRTIEGPAGPIGVRVYRPPTAEGVKLPVVLFFHGGGWSVGDLDSYDATARRHAAGAEAVVVSVDYRLAPEHPYPAAVDDVWAATQWVAAHAEELGGDAERLAVAGDSAGGNLAAVVAQLARDAGAPALRMQLLWYPATTWDTSLPSFAENADAPVLAIDAVKGFSAWYAGHVDLTDPPATLVPARHDDLSGLAPAYIAVAGHDPLRDDGVHYGDLLAAAGVPVQLDNADTLVHGYLGYSGVVPAATEAFDRGLAALREALHS

SEQ ID NO: 31115 - protein, 98 aa, Zea mays
RPGRPHTSLSFSSRLEHSCCSDPTATGSAVRRSRSPAGTWKTAKFQKNITRRGSVPETTVKKGNDYPVGPLVLGFFIFVVIGSSLFQIIRTATSGGVA

SEQ ID NO: 31116 - protein, 355 aa, Cryphonectria parasitica
MSRSQAPNPAGSRKISFNVSEQYDIKDVVGEGAYCVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASQEDKSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTLFPKTSELALDLLEKLLAFNPVKRITVEEALKHPYLEPYHDPDDEPTAPPIPEEFFDFDKHKENLSKEQLKQLIYQEIMR

SEQ ID NO: 31117 - protein, 502 aa, Oryza sativa Japonica Group
MASFLLVSIMLSLLLVLFSHLLQRIAAARRRLPPGPCPLPLIGNLLDIGDLPHRSFARLAERYGPLMTVRLGAATCVVASSPATARAVLQTHNASLAGRGRQDAWHAGGHAENSVFVLPPGRKWRLLRKLGAAHLFSRRKLAELAPLRDEIVGGLLRRVAERADHRGGAPVNVGRLALAANVELLWRSVFSTRLDAATLDVLCDVAREAAVLLGTPNVSDFFPAVAALDLQGLRRRLAELMKNTYRLVDAQIDHRMRCRELRGGRGGEAMDLLDVLLDMSEQEREDGDDEVINRDLMRALLTDLFVGGSDSTATTVEWAMAELLQNPEIMKTLQQEIKMVLGTRSQVEESDIGQLPYLQAIVKETLRLHPIVPLRLYEAERTVEIEGHTIPKGSKVIVNAWAIHQSVKVWIQPEKFLPKRFITKDIDFAGRHFEFIPFGSGRHICIGLPLANRMLHMILGSLMHQFKWTMPQMVNRNGLDMAEKFGLAVSMATRPNIIARKM

SEQ ID NO: 31118 - protein, 264 aa, Psychrobacter arcticus 273-4
MMTKKSLIQSPEAIEKMRVAGKLASDVLVMLDEHVRVGISTEALNQIAHDYIVNVQQAIPAPLNYNGFPKSICTSINHVVCHGIPTENKLLKDGDIINIDVTVIKDGYYGDTSKMWIVGNGSIMAQRICKVAQDALYAGMSVVKNGARLGDVGAAIQAVVEPERFSIVREFCGHGISNEFHHEPQVMHYGKKGTGFELKTGMTFTIEPMINEGKWQTKILPDEWTAITKDRKLSAQWEHTMVVTDNGCEVFTTRPEEDLSFLTQ

SEQ ID NO: 31119 - protein, 386 aa, Mycobacterium sp. MCS
MTSTVPDTDRAVDPLEDYLALCKETCDREIERLYSSGRPGSGFEALLLDYPRRGGKALRPALSIAVCLGLGGQLDAILPTAATLELYHNAFLIHDDIEDESWWRRGKPTMHIDHGIPIAVNVGDAMLSLSLQPLLDNVERIGLGPALRILRAVAHMTRRTVEGQAIELEWVRSNAWRLDDADYLTMVELKTSWYSFITPLQAGAIAAGVDPDRLEPLESLGRHLGAAFQITDDLLNLRADPEEYGKEIGGDLWEGKRTLMLLHTLRTAQPQDRIRALQILARRRPAGLEAGLAGLLDRLTARGELSPTGRAEIAARFDTAEAKSLDDIQWLYELMHDVGSLGHAREVAARHAQQAAAVLAGLDWFPPSRHREALTHLVDYVHGRTR

SEQ ID NO: 31120 - protein, 423 aa, Streptomyces albulus
MGLVVQKYGGSSVADAEGIKRVAKRIVEAKKNGNQVVVVVSAMGDTTDELIDLAQEVSPIPSGREFDMLLTAGERISMALLAMAIKNLGHEAQSFTGSQAGVITDSVHNKARIIDVTPGRIKASLDEGNIAIVAGFQGVSQDKKDITTLGRGGSDTTAVALAAALNADVCEIYTDVDGVFTADPRVVKKARKIEWISFEDMLELASSGSKVLLHRCVEYARRYNIPIHVRSSFSGLQGTWVSNEPQGDRPMEQAIISGVAHDTSEAKVTVVGVPDKPGEAARIFRAIADSEVNIDMVVQNVSAASTGLTDISFTLPKAEGRKAVAALEKTRAAVGFDSLRYDDQIAKISLVGAGMKTNPGVTATFFEALSNAGVNIELISTSEIRISVVTRADDVNEAVQAVHSAFGLDSETDEAVVYGGTGR

SEQ ID NO: 31121 - protein, 438 aa, Oryza sativa
  misc_feature (26)..(26): Xaa can be any naturally occurring amino acid
  misc_feature (285)..(285): Xaa can be any naturally occurring amino acid
  misc_feature (289)..(289): Xaa can be any naturally occurring amino acid
CGHSSAPVFRAETCGAQLFCSHGVLXKAIESYKKAITTAASVAASVMLVRSVVNELVPYEVRDVLFSGLGYLATRINNNMQRLRVSSMDESSEKMVVTMEEGEELVDMHEGTEFKWCLISRSISADPNNGNGSGQREVRSYELSFHRKHKEKALKSYLPFIIATAKAIKDQERILQIYMNEYSDSWSPIDLHHPSTFDTLAMDQKLLYGPPGTGKSSLIAAMTNHLKFDIYDLELTGVHSNSELRRLLVGMTSRSILVVEDIDCSIELKQREAGEERTKSNSMLXEFDXPSTQVTLSGLLNFVDGLWSTSGEERIIVFTTNYKERLDQALMRPGRMDMHIHMGYCTPEAFRILASNYHSIDYHVTYPEIEELIKEVMVTPAEVAEALMRNDDIDVALLGLLELLKSKIKDASETKAALRPTWHRQVQPHRRHGQLPQV

SEQ ID NO: 31122 - protein, 362 aa, Mycobacterium smegmatis str. MC2 155
MLNARAAVLLDAGADPRLTDVQVRPPVGDELLVEIEAVGICHTDISVAARFRKVPMVFGHEGAGTVIDAGPAAAGRIGERVVLTFASCGVCDRCGAGSPAYCDHSTDLNMRGGRLDETAALRLDGAPVAGEFFGQSSFATHAISKSRNAVTIPGDLDPALAAPLGCSVQTGVGAVLNVLTPGADDAVVVFGAGAVGLSAVMGARIAGCRTIVAVDPVAGRRALATELGATITIDPTDTDVTRAVLDATGGAACAIDTTARPDVIATAVMALRSRGTLALLGLGALTAELPVALIMGKGLTVRGVVEGDSEPHSFIPALLEHHRRGELPVDKLVTTCPFEEFDRAWAAAKAGEVVKPVLVTRR

SEQ ID NO: 31123 - protein, 323 aa, Chlorobium tepidum TLS
METPIKIVAGRSNPELAKKIAAYLGTPLCDAKAENFSDGEISVNYFESIRGSDMFIIQSTNPPADNLMELLIMIDAAKRSSAYRITAVLPYYGYARQDRKDKPRVAITAKLVANLLTQAGADRILTMDLHAPQIQGFFDIPFDHLYSSVVLIDHVKNMDIADNLVVASPDVGGVKLARKFASELGTELVIVDKRRPKANVAEVMNIIGDVKGKNVLLVDDMIDTAGTIVNAAKAIKEAGGLKIYAAATHPILSGPAIERINTSVFEKVIVTDSLVSEHDFCSKIETVTISNLFGEAIKRIYDGESVSYLFDSKNISQKITNHH

SEQ ID NO: 31124 - protein, 610 aa, Photobacterium sp. SKA34
MSTPLETPQLSQLNVFPVKSIAGISQSKVWVEKQGISFDRRFMVATLSGDMITARKSPKMVKVKAALIADGIVLSYEDKACLVLKYAQFDMAEASSTVWGDTFIAYTTTEQANSWFSDVLGQPVQLLFTGEQSNRLRPKISQNVSFADGYPLLVISEASLQALNERSSEHHTMDQFRTNLVVSNTEAFAEDGWKRIRIGEVEFEAVKPCARCILTTVDPKSATFSESKEPLVTMAKFRADEKGNVYFGQNLVARNEGIISVGDTIEILETKPKEIYADNSEQKLQLTCVEREDIAQDFTTFWLESHQENQALPTYLPGQHLPIQLEVNGEYISRRYTLSSSPSRPGRYAISVKRVDDGRISNWLHEHFQVGDTLVSESPSGDFHLGVHTDKLLLLSGGSGVTPMMSMLRYLSDHDLVRDVVFYHQCRTEADIPYLEELRAIEEKHPSLDLRIVLTQPKRDWQGESGRLSIGHLAMMSDLDKRQVFVCGPDEFMSSAKKLLLNMGMAPSRYHQEAFGPIRHTLEEKKTVELSIDGQLFQGNNQATLLEQAETAGINMDYSCRAGFCGACKVTVKSGEVEQPEVPALSAKERAEGKVLACCCVPRSDLEIIK

SEQ ID NO: 31125 - protein, 400 aa, Glycine max
  misc_feature (62)..(62): Xaa can be any naturally occurring amino acid
EDDPESQLIVDCNALTVHIENESVIIHNFIRDKYRLKFPELESLVHHPIDYARVVKKIGLEXDEMDLTLVDLEGLLPSAIIMVVSVTASTTTGKPLPEEVLSKTVEACDRALDLDSAKKKVLDFVESRMGYIAPNLSAIVGSAVAAKLMGTAGGLASLAKMPACNVQLLGAKKKNLAGFSTATSQFRVGYLEQTEIFQTTPPSLRMRACRLLAAKSTLAARVDSIRGDPSGKTGRAFKDEIHKKIEKWQEPPPAKQPKPLPVPDSEPKKKRGGRRLRKMKERYAITDMRKLANRMQFGVPEESSLGDGLGEGYGMLGQAGSGKLRVSVGQSKLAAKVAKKFKEKNYGSSGATSGLTSSLAFTPVQGIELSNPQAHAHQLGSGTQSTYFSETGTFSKIKRT

SEQ ID NO: 31126 - protein, 410 aa, Acinetobacter sp. ADP1
MDVRLSDRVNAIKPSPTLAVTNKAAELKAAGKNVIGLGAGEPDFDTPQHIKDAAIEAINNGFTKYTAVDGTPGLKKAIIAKFKRDNNLDYQANQILVSCGGKQSFFNLALALLNKGDEVIIPAPYWVSYPDMVIIAEGTPVIVKCGEDQRFKITPEQLEAAITPNTRLLVLNSPSNPTGMIYTKAELEALADVLRKHPQVYIASDDMYEPIRWEDEFYNIATVAPDLYDRTLVLNGVSKAYAMTGWRIGYAAGPAKIIGAMKKIQSQSTSNPTSISQVAAEAALNGPQDVLEPMIEAFKRRHDLVVNGLNEIHGISCLPADGAFYAYANIRPLIRAKGLKSCTEFSEWLLEETGVAVVPGDAFGLGGFMRISYATADDVLVDALARIKKAADSIEGIDAAIASIEAEKNA

SEQ ID NO: 31127 - protein, 506 aa, Physcomitrella patens subsp. patens
MHCRAVLATEQVEAPIKSPFPVQYTKLFINNSFVDSVSGKTFPSIDPRSEEVAVEVAQAAAEDVDRAVKAARKAFEEGPWPRMPGCERAGIMNRIADLLDEHKDELSALDTLNMGKVYDMARLGEAPLAIGLFRYYAGRWCDKAQGMTLPTNGPFHAYTLHEPIGVVGSILPWNAPFYLLAMKVAPALACGNTIVLKPAQQSPLSALLIAKLAAEAGLPDGVLNVVTGYGDTGMHIASHMDVDKVAFTGSTQVGRQIMQAAAQSNLKPVNLELGGKSPFIIFGDADMDAAVESAHQAIFYNQGQMCVAGSRTFVHESVYDEYLERAKARAEKRVVGDPFKPGVEQGPQQADEAQFNKVMSYIRAGKDEGARLITGGERVGSKGYYIQPTIFSDVQDDMKICREEIFGPVMSVIKFKTVEEVIQRSNQSEYGLGATVMSKNVDIINTVTRSLKAGIVWVNTYGILTPSAPFGGYKSSGFGRENGAYALANYQQVKSVIMPICNPPYL

SEQ ID NO: 31128 - protein, 505 aa, Populus trichocarpa x Populus deltoides
MDLLLLEKTLLGSFVAILVAILVSKLRGKRFKLPPGPIPVPVFGNWLQVGDDLNHRNLTDLAKKFGDIFLLRMGQRNLVVVSSPDLSKEVLHTQGVEFGSRTRNVVFDIFTGKGQDMVFTVYGEHWRKMRRIMTVPFFTNKVVQQYRYGWEEEAAQVVEDVKKNPEAATNGIVLRRRLQLMMYNNMYRIMFDRRFESEDDPLFNKLKALNGERSRLAQSFDYNYGDFIPILRPFLRGYLKICQEVKERRLQLFKDYFVDERKKLASTKNMSNEGLKCAIDHILDAQKKGEINEDNVLYIVENINVAAIETTLWSIEWGIAELVNHPEIQKKLRHELDTLLGPGHQITEPDTYKLPYLNAVIKETLRLRMAIPLLVPHMNLHDAKLGGFDIPAESKILVNAWWLANNPAHWKNPEEFRPERFLEEEAKVEANGNDFRYLPFGVGRRSCPGIILALPILGITLGRLVQNFELLPPPGQSKIDTAEKGGQFSLHILKHSTIVAKPRSF

SEQ ID NO: 31129 - protein, 307 aa, Klebsiella pneumoniae
MNGKIWVLGDAVVDLLPDGEGRLLQCPGGAPANVAVGVARLGGDSGFIGRVGDDPFGRFMRHTLAQEQVDVNYMRLDAAQRTSTVVVDLDSHGERTFTFMVRPSADLFLQPEDLPPFAAGQWLHVCSIALSAEPSRSTTFAALEAIKRAGGYVSFDPNIRSDLWQDPQDLRDCLDRALALADAIKLSEEELAFISGSDDIVSGIARLNARFQPTLLLVTQGKAGVQAALRGQVSHFPARPVVAVDTTGAGDAFVAGLLAGLAAHGIPDNLAALAPDLALAQTCGALATTAKGAMTALPYKDDLQRSL

SEQ ID NO: 31130 - protein, 180 aa, Mycobacterium smegmatis str. MC2 155
MTQHHDTAEVSRVIATLTREVADFPEPGIQFKDLTPLLADARGLRVVTDALADIASGADLVAGLDARGFLLGAAVATRLGTGVLAVRKGGKLPPPVHGATYQLEYGTATLEIPAEGIDIAGRNVVIIDDVLATGGTLAAAARLLGDCGANVTGAGVVLELEALRGREAVAPLGVRSLHII

SEQ ID NO: 31131 - protein, 221 aa, Salmonella enterica subsp. enterica serovar Thompson
VDLDDQGERTFTFMVRPSADLFLVEEDLPQFAAGQWLHVCSIALSAEPSRSTTFAAMESIRSAGGRVSFDPNIRPDLWQDQALLLACLDRALHMANVVKLSEEELVFISSSNDLAYGIASVTERYQPELLLVTRGKAGVLAAFQQKFTHFNARPVASVDTTGAGDAFVAGLLASLAANGMPTDMTALEPTLTLAQTCGALATTAKGAMTALPYQRDLNRQF

SEQ ID NO: 31132 - protein, 307 aa, Salmonella typhimurium
MNAKVWVLGDAVVDLLPESEGRLLQCPGGAPANVAVGVARLGGNSGFIGAVGGDPFGRYMRHTLQQEQVDVSHMYLDDQHRTSTVVVDLDDQGERTFTFMVRPSADLFLVEEDLPQFAAGQWLHVCSIALSAEPSRSTTFAAMESIRSAGGRVSFDPNIRPDLWQDQALLLACLDRALHMANVVKLSEEELVFISSSNDLAYGIASVTERYQPELLLVTRGKAGVLAAFQQKFTHFNARPVASVDTTGAGDAFVAGLLASLAANGMPTDMTALEPTLTLAQTCGALATTAKGAMTALPYQRDLNRQF

SEQ ID NO: 31133 - protein, 307 aa, Vibrio alginolyticus
MNQVWVTGDAVVDLIPESETSLLKCPGGAPANVAVAIARLSGKSAFFGRVGDDPFGRFMQSILDQEGVCTEFLIKDPEQRTSTVVVDLDDQGERSFTFMVKPSADQFMSVEDMGNFKQGDWLHVCSISLANEPSRSSTFEAIKRAKAAGGFISFDPNLRDEVWQDQSEIQAVVMKAVAMADVVKFSEEELLFLTDSTSMAQGLQQIAAMNIALVLVTQGAKGVWRVFESQSELITGQVVSPIDTTGAGDAFVGGLLACLSRHADWKNHPVVSSAIQWANGCGALATTQKGAMTALPTQTELLRFIGQ

SEQ ID NO: 31134 - protein, 417 aa, Ashbya gossypii ATCC 10895
MSVKFSAEEVPQVSSEISDELQQRYTNWKKNTKLLYDYLNTNSTKWPSLTCQFMPDLEVPTDKHRLLLSSFTSSQLPEDEAVYISELSTMRHVPWSSLNNFDMDEMEFKVDNQAKLPNKNLVETVRIQFPSGDCNRACYMPQNPDIIGAIASTGAVNIFDRTKHGTNRPKLLGSAASYEIQLNEPESLGDADSAEALSLAWNWQKAGIIASSYSNGLIKVWDITRYQKSQPTISNPELRILQDKAGTNDVSWMVHHSSILAACGESNTIGLLDTRAPDAFKPTKASPHTGGINALQFNYANDMLLCAADSNGGIALWDCRAFSKPLSVFNHGDSVSALQWNPNLPTIVATAGQGDGLIKIWDTSREPEDSLLFVHGGHMLGVNDIAWNYHDPWLMCSVANDNSVHVWKPAANLVQAK

SEQ ID NO: 31135 - protein, 1167 aa, Solibacter usitatus Ellin6076
MALNSIHISLRRLLAAWIAVTGLMAAEHHGTVKFGGLPVPGASVTVTKDDKKHVTTTDENGQYAFNDLADGVWHIDIEMMGFAKLTNEIGIAFDAPPAEWTLKFLPMSEIKAPAAAAPVTSTATPAPAAPAPTPAATPAATPNKPAATTTAVAPAAPKPAANANGARGQQGGRGQGANNGRPSLLAGNNGFQRVDVNSSGDAAAAPDAGIPAGDMADMSSSADPSLMVNGSVSRGLDQPQQNDWFGGPGGRDGMGMGMGGPGGMLGMNGPGGGDAAGGGVAQMGGRGGPGGGPGGGRGGPGGGGFGGGPGGGFAGGFGGRGGRGGPGGPGGRGPANRPGVASFGNGRRDRRMQYNGNAAFTLDNSVWDARSYSINGQDTAKPAYAKARANMTFGGPLKIPKLLSGQKGQFNINYSLGRTRNGTTSTNTVPTLLERSGDFSQSIGAQGPVTIFDPLTGNPFPGNVIPQNRMNSASLGLLKYYPLPNSPGYKYNYQAPITTIQNSDNLNARLNQTLNTKNRINGGIGYMGSNNTTPNIYNFVDTGTARNINTNVAWGHNFSTRLINNLRYTFSRSRNSGIPFFAYQQNVAAELGILGTSQAPQNWGPPNLSFTNYTALTDGTSSLTRNQTSAVGDSLIWVHGVHNMTFGADYRRQQINRASDPNARGQYTFTGLSTASLANGVPVSGTGFDFASFLLGAPDTSALRYGNSNLYFRTHAYDVYATDDWRLSQKLSINFGLRWDYASPITELYNKLVDLDVAPGYAAIAQVLPGQVAPYSGALPASLVRPDRNNISPRIGFAWRPIPKHSMVIRGGYGTYYNTSVYNTMANNMAQQPPYAQSFSVSNSPLNPLTMQTGFLAPVTNSLTNTYAVDPNYLIGYAQMWQIAIQNDLGHSLVGTITYNGTKGTHLDQTILPNSAPSGAKANGLPSGYLFEQSNGNSIYQGVSAQLQRRFRNGISANAVYTYSKALDNAVQAQNYLDTAAERARSNTNRTHVLNFNWQYSTGVGRTGATMVNGWKGALVKDWTFTNSISLSSGLPLTPTVGGIRSTTTGTGITGSLRASATGLPVNDAPAGEPFNFAAFTLPAAGEWGNAGRNTITGPVQFGLNASLGRVFRIGERKSIDLRFDATNALNHVTFRSFNTTIGSNNLGLLAGASNMRSMLATLRFRF

SEQ ID NO: 31136 - protein, 555 aa, Ashbya gossypii ATCC 10895
MATTNTFSDFKLASELPAWAKLQELYEKKGKTLSLKEAFATDEQRFQKYSRTFSNHDGSKILFDFSKNLVDDEILGALAQLAREANVTQLRDQMFNGEHINSTEDRAVYHVALRNRANKPMYVDGKNVAPEVDAVLQHMKEFSEQVRSGAWKGYTGKSIKDVVNIGIGGSDLGPVMVTEALKHYAGPLKVHFVSNIDGTHLAETLKEVDPETTLFLVASKTFTTAETITNATSAKNWFLSKTGNNPAHISKHFAALSTNETEVAKFGIDTKNMFGFESWVGGRYSVWSAIGLSVALYIGFDQFEDFLKGAEAVDKHFTSTPIEDNIPLLGGLLSVWYNNFFDAQTHLVVPFDQYLHRFPAYLQQLSMESNGKSVTRGNVFANYSTGSILFGEPATNAQHSFFQLVHQGTKVIPSDFILAAQSHNPIENNLHQKMLASNFFAQAEALMVGKDEAQVKAEGATGGLVPHKVFSGNRPTTSILVQKITPANLGALIAYYEHVTFTEGAIWNINSFDQWGVELGKVLAKVIGKDLDTTGETTSHDASTNGLINQFKAWL

SEQ ID NO: 31137 - protein, 225 aa, Moritella sp. PE36
MAKIGTTLNITHPTFVAKQQAMQDLVQQLEINIEQVKKGGGEIAQQRHLARGKMLARERIDALLDPGSPFLELGQFAAWQYYPDSVPAAGIVAGIGRVNGIECMIIANDATVKGGTYYPLTVKKHLRAQEIAERCCLPCIYLVDSGGAFLPRQDEVFPDRDHFGRIFFNQANMSAKGIPQIASVMGLCTAGGAYVPAMADESIIVKQQGTIFLAGPPLVKAATGE

SEQ ID NO: 31138 - protein, 427 aa, Shewanella sp. MR-7
MELYNLKHPSQKVSFKEAVQLGLGKDRGLFFPTQIPVLHDIEALLAMPFVERSKKVLGAWLASELGQGAVDKLVERAFNFDLPLVAVDEQRSCLELFHGPTLAFKDFGARFMAQCINAFAQDSRLTILTATSGDTGAAVADAFYGLDKVNVVVLYPKGKISELQEKMFTTLGKNIHTVAVASDFDACQHLVKQAFEDSDVRDGLHLNSANSINISRLLAQICYYFEAVAQSKQRHEADPVIAVPSGNFGNLTAGLFAKAMGLPVKRFIAATNANDTVPRYLESGDWQPNPTQATMSNAMDVSEPSNWPRVEAICEKLGWPLSDLVGIRLSEAQTSEALAELQTKGYVSEPHAAIAAKALSLNLVPDEVGIFLGTAHPAKFKDVVDRELNLDLPLPAELKAVEHKPILSAELAADFAQLKSHLFAVLS

SEQ ID NO: 31139 - protein, 326 aa, delta proteobacterium MLMS-1
MSTTCSSKCGGAAGDSDCGQRAAVDAQRNLSIDRALGRIRYKIMVMSGKGGVGKSTVAVNLAVGLARRGFKVGLMDVDLHGPDICRMLNLSEAPVTTAAGRITPLPAAAGLQVMSLENMMENRDDPVIWRGPLKNQAIRRFIADVEWGPLDYLIIDAPPGTGDEPLTVARMIKDAWALVVTTPQKVALADVRKSINFCGHVDMKILGLVENMSGFICPHCQQTSELFKSGGGQRLAAENRLEFLGGIPLDPRVMLSGDEGIALLADDRQSPAVAALDTVVANVSRLLPVAAPAPAMAQFPAPGGGIPLAASACGCGGVCDPVKCDC

SEQ ID NO: 31140 - protein, 251 aa, Moritella sp. PE36
MTDKSNNTTHFGYKTVESDQKVDMVASVFHSVAAKYDVMNDLMSMGIHRLWKRFTIDCSGVRPGHKVLDLAGGTGDLTAKFSRIVGDTGAVTLADINDSMLKVGRAKLRDRGIVGNVTYVQANAEELPFPDNHFDLITIAFGLRNVTDKDKALASMFRVLKPGGRLLVLEFSKPNSDALNKIYDFYSFNILPKMGELIADDGDSYQYLAESIRMHPNQETLKGMMEAVGFESVEYHNLTGGIVALHRGYKF

SEQ ID NO: 31141 - protein, 463 aa, Delftia acidovorans
MNTVDITEIIEKQKPNRKVLALLILSFLIMFCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFLAMSLPESIKYLVLSGQKAEAVARVVNAIDPSIRASSQTRFVLGTAEESARIAGWKDSVKALFGGQLSKITPALWGAFVCSSVTVFFLASWIPVLTVGTGRSASLAAVGLALFSAGGAFGGIFSSRIIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMSADRANDPEARPIVA

SEQ ID NO: 31142 - protein, 229 aa, Chlamydophila pneumoniae J138
MKKQESVLVGPSIMGADLTCLGVEAKKLEQAGSDFIHIDIMDGHFVPNLTFGPGIIAAINRSTDLFLEVHAMIYNPFEFIESFVRSGADRIIVHFEASEDIKELLSYIKKCGVQAGLAFSPDTSIEFLPSFLPFCDVVVLMSVYQGFTVQSFLPHTIEKIAFARHAIKTLGLKDSCLIEVDGGIDQQSAPLCRDAGADILVTASYLFEADSLAMEDKILLLRGENYGVK

SEQ ID NO: 31143 - protein, 119 aa, Rubrivivax gelatinosus
GATLGDVGHAIQTVARREGFGVVREYGGHGIGTVYHGDPHVAHFGQRGQGLRLTEGMIFTIEPMLNAGSAAIRDAGDGWTVVTRDGSLSAQWEHMVAVTRDGYEVLTPWPDGLGGYAPI

SEQ ID NO: 31144 - protein, 258 aa, Burkholderia sp. 383
MNANTKPAQLDGRIALVTGASSGIGRASAIELARRGAKVVVSARRKAELDRLVDEIVTAGGEAKAFVADVANEDDLRKLFDFAVETYGRLDIAFNNAGTEGVFAPLLEQDAERFDRVFEPNVRGVFNSMKYAAEIMLRQGSGSIINNASMGGLIGFENASVYIASKHAVIGMTKTASIEWFKRGVRVNALCPGLIETPFHHRGIWPSEDAQQAFAASTPAGRWGSAEEMATIVAFLASDDSSYVSGHALVADGGYSVA

SEQ ID NO: 31145 - protein, 451 aa, Vibrio sp. Ex25
MATHFDYICIGGGSGGIASANRAAMYGAKVALIEAQDLGGTCVNVGCVPKKVMWHGAQIAEAMNLYAEDYGFDVDVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVVGAGYIAVEIAGVLHALGTETHLFVRKESPLRSFDPMIIDTLVEVMEAEGPTLHTHSVPKEVVKEADGSLTLHLENGESQNVDQLIWAIGRHPATDAINLASTGVATNEKGYIKVDEYQETNVKGIYCVGDIMEGGIELTPVAVKAGRQLSERLFNNKPNAKMDYDLVPTVVFSHPPIGTIGLTTQEAEEKYGKDNIKVYTSGFTAMYTAVTKHRQPCKMKLVCAGEEETVVGLHGIGFTVDEMIQGFGVAMKMGATKADFDSVVAIHPTGSEEFVTMR

SEQ ID NO: 31146 - protein, 151 aa, Haemophilus influenzae
MVSSLIFSCHYLTMAFTRIEKRKVKMAYSEKVIDHYENPRNVGSLDKKDSNVGTGMVGAPACGDVMQLQIKVDDNGIIEDAKFKTYGCGSAIASSSLITEWVKGKSLEEAGAIKNSQIAEELELPPVKVHCSILAEDAIKAAIADYKAKQG

SEQ ID NO: 31147 - protein, 292 aa, Zea mays
MGKDDVVESGAGGGEFAAKDYTDPPPAPLVDAAELGSWSLYRAVIAEFIATLLFLYVTVATVIGYKHQTDASASGATADAACGGVGVLGIAWAFGGMIFVLVYCTAGISGGHINPAVTFGLFLARKVSLVRALLYVVAQCLGAVCGVGLVKAFQSAYFDRYGGGANSLASGYSRGAGLGAEIVGTFVLVYTVFSATDPKRNARDSHVPVLAPLPIGFAVFMVHLATIPVTGTGINPARSLGAAVVYNKDKPWDDHWIFWVGPLLGAAIAAFYHQYILRAGAIKALGSFRSNA

SEQ ID NO: 31148 - protein, 150 aa, Zea mays
  misc_feature (75)..(75): Xaa can be any naturally occurring amino acid
QYDAFDIGFITTDEFGNADILEATYPAVAKRLHGDWIQDPAIPVVTGFLGKGWKSGAVTTLGRGGSDLTATTIGXWKDVDGVLTCDPNIYPHAKTVPYLTFEEATELAYFGAQVLHPQSMRPAREGDIPVRVKNSYNPKAPDNLIHVSLS

SEQ ID NO: 31149 - protein, 280 aa, Oryza sativa Japonica Group
MAAGSGSGSNPKDYQDPPPAPLVDTGELGKWSLYRAAIAEFTATLLLVCISVSTVIGEKRQSGEGGAGVLGIAWAFGGLIFVLVYCTAGISGGHMNPAVTFAMVLARRVSLPRAALYTMAQCVGAVCGAGLARAMHGGGQYARHGGGANELAAGYSAGAGVVAEMVGTFVLVYTVFSATDPKRKARDSHVPVLAPLPIGLAVLVVHLATIPITGTGINPARSLGPALVLGLGTTKAWSHLWIFWVGPFAGAAAAMIYHHYILRGAAAKAFASSSYRSPHF

SEQ ID NO: 31150 - protein, 275 aa, Triticum aestivum
MEGPKVKARWDREATRIFCECAAAQVRLGNRPTKALTPAGYKGLIAAFNAQTGRNYVQKQFRNRWDDMKDIYSAWVFYKNKATGLGWDDVEQTITADDDQWASLIAIHKPIKAFRHGPPDSLNKLAIMFEKANVDGLSSVMPGVDNEEVEETKTEEDIHELYEEENETQRKRPKSAIPCSPSKFKKNNVPKDFKRFVDHVIQEDCAGQTSKTADNDDILAIMEEVAKCGASETSDEYYMARKLFAKPSNRSFFYAMKTNEGRLNWLKRQFDDRKK

SEQ ID NO: 31151 - protein, 532 aa, Prochlorococcus marinus str. NATL1A
MAITDIFQLNNNDKWERYCDLLYSDDSLGFWLDISRMDVAINDFEDFNEIYSKAFDALESLENGSIANIDEGRQVGHYWLRNPKVAPSAEISDSITKEIQNISKFGASILNGEITNRHGKKYTDVFWIGIGGSGLGPLLIKESFKRESIGLNLHFLDNVDPEGISHKLNSILPNLDSTLFVVVSKSGGTPEPLIGMEQAMKFVLDHSQNWSSRAIAITSKGSKLDVLANNENWLDIFDLPDWVGGRTSITGAVGLLPAALIGADINKFLNGASQMDALTRVKDIKNNPAALLSLAWFKSGNGKGLRDMVVLPYRDRLEVFSRYLQQLVMESLGKKFDRDENQVNQGIAVYGNKGSTDQHAYVQQLRDGIDNFFVNFIEILHDPLEIVEVKNKRPGDYLSGFLQGTRSALTEGGRQNLTITFKSFDESSLGALIALFERAVSLYAELINVNAYNQPGVEAGKEAATKIIKLQKEIEELLDDGKQRTLNEINDALSSDSTESIYLILRKLSENSDHYSMIGNQSNPDKLIISKT

SEQ ID NO: 31152 - protein, 235 aa, Oryza sativa Japonica Group
MGAADDANHRHEEASPLLPPGGGGGGGKKLHQSPPPSPPEAAKCCADGVPVVMGEPLGAPAPPRESWNSGVLSCLGRNDEFCSSDVEVCLLGSIAPCVLYGSNVERFAARPGTFANSCLPYTGLYMLGNALFGWNCIAPWFSHHTRTAIRRRYNLEGSFEAFTKQCGCCHGLVEDEGNREHLEVACDLATHYFCHPCALCQEGRELRRRVPHPGFNGRSVLVMTPPKEQTMGRGM

SEQ ID NO: 31153 - protein, 240 aa, Pisum sativum
MKTPISGFYRNPVKFRMPTSENLVPVRLDIEIDGHRYKDAFTWNPSDPDSEVVVFAKRTVKDLKLPPPFVTQIAQSIQSQLAEFRSYEGQDMYAGEKIIPIKLDLRVNHTLVKDQFLWDLNNFDSDPEEFARTFCRDMGIEDPEVGPAVAFAIREQLYEIAIQSVVSARESRLSKKGRRGADFTPVSKGGAVAVDLVKLFGIKSSVVRKRKEWDVYEPIVDLLSNEEVDVLEAKEERNFR

SEQ ID NO: 31154 - protein, 346 aa, Bacteroides fragilis NCTC 9343
MLAYTYVEHGKFELLEKLRPQIKDARDAIVRVTLGSICTSDLHIKHGSVPRAVPGITVGHEMVGIVEEVGSGVISVRPGDRVTVNVETFCGECFFCRHGYVNNCTDPDGGWALGCRIDGGQAEYVRVPYAEQGLNRIPDNVSDEQALFVGDVLATGFWATRISEISEDDTVLIIGAGPTGICTLLCVMLKKPRRIIVCERSAERIRFVREHYPDVLVTEPENCRDFVLCNSDHGGADVVLEVAGSEETFRLAWECARPNAIVTIVALYDKPQFLPLPDMYGKNLIFKTGGVDGCDCAEILSLIEQGRIDTTPLITHRFPLNEIEEAYRIFENKLEGVIKIAITGGR

SEQ ID NO: 31155 - protein, 626 aa, Haemophilus ducreyi 35000HP
MSVDIVHLADSELGKIVALLATSITIVPLFKRLGLGSVLGYLVAGCLIGPSVLGLFQNPQSIVHMAELGVVMFLFIIGLEMHPELLWSMRKAIFGRGFLQVLTCGTLLTFAGIHLIGLTTAVAFVVGAGFTLSSTAIVMQVLEDKGISSAPKGQRIVSTLLFEDLAIVPLLASMTFLAPSTEGATTGINSAAISIAVIGIIILVASSKWIMNPLFRMISKAKVREMMTAAALLVVLGAALLMELSGLSMAMGAFVAGVMLSESSFRHQLEADIEPFRGLLLGLFFMGVGMSLDLKFVFDDLFLLLSLVVILVLGKAISVYVIGLLTLLSHREALMRMSIMSHGGEFAFVLFSAAAAVGILDEDQQATFTAAVIISMLLSPLVVLMVQRIMTRKAKPEAPSMAGIEVAEDLENSVIVIGFGRFSQIVCQILLARGITVTVIDANTDRIRAAARFGFKVYYGDGTRLDVLRASGLAKADCVVLGINDPTRSASIVEQIKHEFPLMPIFARTYDRYSAIQLTKLHVDFQIRETFESALVLSKATMMKLGIDEVEALEVIESVRVLDKERFKEELIYGTSAELIRKYFTPKPLVKPQQPAEALNEYAAEILAETDESQHCQDNLNKKADV

SEQ ID NO: 31156 - protein, 572 aa, Saccharomyces cerevisiae YJM789
MLSKSEKNVDLLAGNMSNLSFDGHGTPGGTGLFPNQNITKRRTRPAGINDSPSPVKPSFFPYEDTSNMDIDEVSQPDMDVSNSPKKLPPKFYERATSNKTQRVVSVCKMYFLEYYCDMFDYVISRRQRTKQVLEYLQQQSQLPNSDQIKLNEEWSSYLQREHQVLRKRRLKPKNRDFEMITQVGQGGYGQVYLARKKDTKEVCALKILNKKLLFKLNETKHVLTERDILTTTRSEWLVKLLYAFQDLQSLYLAMEFVPGGDFRTLLINTRCLKSGHARFYISEMFCAVNALHDLGYTHRDLKPENFLIDAKGHIKLTDFGLAAGTISNERIESMKIRLEKIKDLEFPAFTEKSIEDRRKMYNQLREKEINYANSMVGSPDYMALEVLEGKKYDFTVDYWSLGCMLFESLVGYTPFSGSSTNETYDNLRRWKQTLRRPRQSDGRAAFSDRTWDLITRLIADPINRLRSFEHVKRMSYFADINFSTLRSMIPPFTPQLDSETDAGYFDDFTSEADMAKYADVFKRQDKLTAMVDDSAVSSKLVGFTFRHRNGKQGSSGILFNGLEHSDPFSTFY

SEQ ID NO: 31157 - protein, 149 aa, Arabidopsis thaliana
MEQTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 31158 - protein, 815 aa, Ashbya gossypii ATCC 10895
MNSKLNNRSTRPAHRQEAHMSQKGQKQPTKPAPSSIRPGQQQGSSSSQAAKPSSGFSASDLNRIVLEYLNKKGYHRTEQMLRAESSRTLTPSNKSSVASSTLPAPATSATQEVTTNGKPASNPPMPLKRDANGNLVQQAQVTPQHYFRAYAMLKNWVDSSLDMYKPELSRIIYPIFIYVFLTLVSKAPVQARRFFDKYSEDYKALHGTEINKLFSVNSVDHIKENELAQGFQSNKYRVTISRTTLNLLLYFLNENESVGGSLLISIINQNLEPNAVDNIISQDTLTDGIKDISAGAIDVDNHNSVPVKLGPFPRDQEFTKEVEVELMRKDEQEIEENPDENRKTLVEEYKSMTGATAAVAPVGAQPEAPATQKGDESDDASEKKEHDEKAGEKGTAPSSSGQPAVPIPAGTLPLNAPVGLPLSTTATDLINPMMESPLPGALPLPPKTALDLKLEIQKVRESRDAIKMDNLQTSAPSVCMYTFHNTNREMTCLRFSDDSRLVAAGFQDSYIKLWSLDGTPLESQLPSKAKDASNTVTLIGHSGPVYSVSFSPDNRYLVSASEDKTVRLWSLDTYTCLVSYKGHNHPVWDVKFSPLGHYFATGSHDQTARLWSCDHIYPLRIFAGHLNDVDCVTFHPNGTYVLTGSSDKTCRMWDIQTGDSVRLFLGHTASVVSVAVSPDGRWLTTGSEDGVIIVWDIGTGKRIKQMRGHGKSAVYSLSFNKEGNILVSGGADQSVRVWDLKKFTNEPSLEPEQPYSGYLGDMEASVNQDVKEYGRRRTVFPTQDLMASFHTKKTPIYTVKFTRTNLVLAGGAFTE

SEQ ID NO: 31159 - protein, 146 aa, Deinococcus radiodurans R1
MRLHLITVGEPKLAYARSGWDEYEKRLRRYHKVQVSRVSGKTQQAESEAILKAAGKSPLILLDPRGKQFSSEKLSEYLDAEALGGHGELAFAIGGPDGHTDALRGQAKLLWSLGELTLPHDLAMLVLVEALYRAATISAGEPYHRG

SEQ ID NO: 31160 - protein, 468 aa, Glycine max
MEVLLPKLPSFKFPSATYCCSITSRSSSYVRFGFRRVSVCASTVNEAVAKPIVGFLSLGHSTRPHFPILHQEVNGSKLVYLDNAATSQKPTAVLKALQNYYEAYNSNVHRGIHFLSARATDEYESARRKVASFINAIDSREIVFTKNASEAINLVAYSWGLSNLKPDDEIILTVAEHHSAIVPWQIVAQKTGAVLKFVDLNQDEIPDIDKLKEMLSRKTKIVVVHHVSNVLASVLPIQDIAQWAHDVGAKVLVDACQSVPHMMIDVQSLNVDFLVASSHKMCGPTGIGFLYGKIDLLSSMPPFLGGGEMISDVYLDHSTYAEPPSRFEAGTPAIGEAIGLGAAIDYLSGIGMQTIHDYEVELGRYLYERLLSVPNIRIYGPAPSEKVERAALCSFNVENLHPTDLATLLDQQHGVAIRSGHHCAQPLHRYLGVSSSARASLYFYNTKEDVDYFIHALNDTVSFFSSLM

SEQ ID NO: 31161 - protein, 209 aa, Glycine max
SLRHALVFVLIGALWNLQRAEGIRFVIDRDECFSHDVKYEGDTVHVSFVVIKADSPWHYGDEGVDLVVKGPSGEQIQDFRDKTSEKFDFVAHKSGVHKFCFTNKSPYHETVDFDVHVGHFSYFEQHAKDEHFTPLLEQIGKLEEALYNIQFEQHWLEAQTDRQAIVNDAMSRRAVHKAIFESAALIGASALQVYLLQRLFERKLGTSRV

SEQ ID NO: 31162 - protein, 445 aa, Mycobacterium sp. MCS
MSDSLFDLPADGPVAAAGAPVSAPLAVRMRPASLDEVVGQQHLLKPNSPLRRLVEGSGAASVILYGPPGTGKTTLASLISHATGRRFEALSALSAGVKEVRAVIETARQGILRGQQTVLFIDEVHRFSKTQQDALLAAVENRIVLLVAATTENPSFSVVAPLLSRSLILQLQPLAPDSITEVVRRAVADPRGLADSVDVSDDAVDLIVQLSAGDARRALTALEVAAESAAAADGRVTVDIVEQSLDKAAVRYDRDGDQHYDVVSAFIKSVRGSDVDAALHYLARMLVAGEDPRFIARRLMILASEDIGMADPTALPLAVAAAQTVQLIGMPEAQLTLAHATVHLATAAKSNAVTTALGAAMSDVRNGKAGQVPAHLRDGHYSGAAKLGNAVGYVYAHDHPDGVVPQQYPPDELVGVDYYRPTGRGAEREIGGRLDRLRAIIRKRR

SEQ ID NO: 31163 - protein, 225 aa, Physcomitrella patens subsp. patens
MADAWAREFHETALLTEEIDGRIAEKNALPAHSSESIRVVSVSRRKLAVLNNKLDRLESLLQSDSLKSSLNEKELNRRQNMLVDIRFKFKQMSESLSSTRDNRASLMEGGIAPVETSRTQDLDNTGLVKLQRQIMKEQDQDLESLEKTVLSTHHIALAVNEELDLHTRLLDDMDQDADVTNNKILAAQKRLGYLNKNLGQEWSLLTMIILMVVVVVLVLVLFKLL

SEQ ID NO: 31164 - protein, 391 aa, Mycoplasma mobile 163K
MNSKVSKIQAIIDTQDNGLNLSGIDSRKSFPLVNVLSRYRMIDFCLSNIVNSKINSVFIVIDKPNRHIFNYIDNGIFWDLNRINSGIKYLFAAGDTQNKKFSNIDAIFNNYTFLTEIDNNTEYVLFTNSDSVNRIDYEDMFKQLIENKADVIWAYKSIEIFDYNAENYKRAKILSFESNSKKIKTFGKNTFKNIKINLDIGIFILKKELFYQALIESMADNKINSIQEFIRNFYVSKWEIIGYEIKNFVGNFWTIEEYFRGQISLLLDEKNLSEILKPPLYTHEYNYSPSYYSKTANINNSLLGQNCVIDGEVINSIISNNVKIEKGAKVENCILLDNVIIKKNANLKNIIVDNDSIVSENKKIIAIEESPLVLKKSIHRKDQNEIIKVTR

SEQ ID NO: 31165 - protein, 398 aa, Moritella sp. PE36
MMSVAEIKMNDSDGIDDIAAMEQIFATQKEAYLSQPEWDKAERKKRLLLFKAAFLANKEALLTAVSEDYGHRSRYDTLIADILPTTAQFNYTLARLAKWMKPTRRSPGLLLAPASVTIHYQPVGVVGIVVPWNFPINLAIVPLITSIAAGNRAMLKMSEFTPKTNQVLKKIITSVFDRKDVCIVEGETALSAAFTKLPFDHLLFTGSTVVGKHVMRAAADNLTPVTLELGGKSPVVVAPDIDIKVAVNRIMLGKSLNAGQICVAPDYILCPREKVADFVKEYRNEFNRRYPKAMDNDDYTNIVDDRQYNRLKAWLEDAKQKGAEVETMQEGDSLNDQRHRMLPHLLLNVNDDMQLMQDEIFGPLLPILPYDSIDDAISVIKSRPHPLALYIMSFDNNT

SEQ ID NO: 31166 - protein, 381 aa, Mycoplasma mobile 163K
MVKKEMIAMILAGGQGTRLKNLTKKIAKPAVPFGAKYRIIDFTLSNCINSGIDTVGVLTQYRPLSLLKHIGSGIPFDLNRLNGGVVLLSPYVKESEGYWYAGTAHAIFENIDFMNEYDPTYALILSGDHIYKMDYSKMLDFHKEKNANVTIATINVSFEEASRFGILNTNENNMVEEFEEKPKIPKSTKASMGVYIFNYQLLKDTFEELKSKGNNFQDFGHNILPYILKKYSKIFAYEFNGYWKDVGTISTFYEANLDLIKNHKNLDLREKNWTIFTKSSSHSPQYITSGGNVVNSLVANGAKIEGHVSNSVIFENVKIGKNTIIEDSVIMSNAIIGENSFIKKTIIMENTVVKEKMVLNSLNNQSLNEEDGIILYDGKEK

SEQ ID NO: 31167 - protein, 388 aa, Arabidopsis thaliana
MDKTFFSSNEGKPITCKAAICRKAGEALVIEDIHVDPPQAYEVRIKILCTSLCHTDLTFWKLSFGPISRFPRILGHEAVGVVESIGENVDGFKQGDVVLPVFHPYCEECKDCKSSKTNWCDRYAEDFISNTRRYGMASRFKDSSGEVIHHFLFVSSFSEYTVVDIAHLVKISPEIPVDKAALLSCGVSTGIGAAWKVANVEEGSTIAIFGLGAVGLAVAEGARLRGAAKIIGIDTNSDKFELGKKFGFTDFINPTLCGEKKISEVIKEMTEGGVDYSFECVGLASLLNEAFISTRTGTGKTVMLGMEKHAAPISLGSFDLLRGRVICGSLFGGLKSKLDIPILVDHYLKKELNLDSFITHELNFKEINKAFALLEEGKSLRCILWMDK

SEQ ID NO: 31168 - protein, 181 aa, Brassica napus
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 31169 - protein, 351 aa, Clostridium acetobutylicum ATCC 824
MKGIIYLEDGTVFYGTGFGKEGNEFGEIVFNTSMTGYQEILTDPSYAGQIINMTYPLIGNYGVNESVNQSKCVYAKGFIVKNIDENPSNYTSEINIDQMLKNMGVVGVFGVDTRSITKKIRSYGTMKCIISNGELSIEELKKMMDASNIVDDYVNTVSTKEIIHIAGNGNKVAVMDFGIKNDIIENLKERQCDITIFPYDTDYNEILNINPDGIFLSNGPGDPKSIPEAIENVKKLIGKRPMFGICLGHQIIALASGGNTYKLKYGHRGGNHGIYDVQRDKAYITAQNHGYAVDEESVLENGMIITHRNLNDGTVEGMKHKSIPLFSVQFHPEGAPGPTDTTYLFDQFVNL

SEQ ID NO: 31170 - protein, 344 aa, Enterococcus casseliflavus
ATAFENDWVKASGLPQEATGFKVAIVGSGPAGLSAAWRLNQLGHQVTVYERSDRFGGLLMYGIPNMKLDKDVVQRRIDLMAELGVTFVANTEIGRDLSAEELAAQYDRVILATGASVPRDLKIPGRELTGVQFAVDYLTEATKDVLKHGKAATSKKLAGKHVIVIGGGDTGNDCIGSAIRQGAASVRQLEITPQLPLTRTDSNPWPEYPMTARTGYGQEEAAEVLQTQVTYHGVSTTAFIGAERGQLIAIETVSVDQQFQPIPGTEQVIKADLVLLAMGFVGAETQLFDAFGVREVYDDYTTNNERVLVAGDAKRGPSLVIWAIREGRLAAEKVDQALRSLVYQ

SEQ ID NO: 31171 - protein, 314 aa, Saccharomyces cerevisiae YJM789
MFKEEDSLRKGQNVAAWKTLLAGAVSGLLARSITAPMDTIKIRLQLTPANGLKPFGSQVMEVARSMIKNEGIRAFWKGNIPGSLLYVTYGSAQFSSYSLFNRYLTPFGLEARLHSLVVGAFAGITSSIVSYPFDVLRTRLVANNQMHSMSITREVRDIWKLEGLPGFFKGSIASMTTITLTASIMFGTYETIRIYCDENEKTTAAHKKWELATLNHSAGTIGGVIAKIITFPLETIRRRMQFMNSKHLEKFSRHSSVYGSYKGYGFARIGLQILKQEGVSSLYRGILVALSKTIPTTFVSFWGYETAIHYLRMY

SEQ ID NO: 31172 - protein, 436 aa, Vibrio vulnificus CMCP6
MSTETKKMSVVQLTILTFINMAGSGIIMLPSKLAQVGTISVLSWLITAAGSLALAYVFAKCGRFSKRDGGMNGYASYAFGKSGAFMAGWTYGLSLLIANIAIAITCVGYGSAFFEVTLSPVETCLYTIAILWICTFANFGGAKITGQIGSFTVWGVILPVCSLGIVGWFYFSPTMYVEAWNPHHLPFGEAVSASIAMTLWAFLGLESACANSEAVENPEKNVPIAVLGGTLIAAVVYIVSTNICSGIVANSELAASTAPFSTVWTVMLGSTAGKVVAGMAVLACAGSLLGWQFTIASVFKSSSDAGFFPKLFSQVDKRGTPIKGMVAITVIQSVLSLMTISPTLNEQFEALVNLAVVTNVIPYILCMGAIFIMQQVAHVPEREMKTTNIIALVGSLYSFYALYGSGYEAMMWGSIVTFLGWSAYGLIAAKHEPLAN

SEQ ID NO: 31173 - protein, 388 aa, Deinococcus radiodurans R1
MTSPFRLSARAQSLKPSATVAVTSRALELQRQGLDVISMSVGEPDFDTPPHVKAAGIAAIEEGKTKYTPVSGIPELREAISAKFRRENGLDYAPNAVTVTSGGKQALFNAFFALLNPGDEVLIPAPHWVSYPEMVALTGAVPVTVPTTPQQGFQLDPDALAAAITPRTRMVILNSPGNPTGAVFPPETLRAVADLATQHGLMIVTDEIYEHLVYDAEQVSIGTYAPEHTLTINGASKAYAMTGWRIGYAGGPREVIAAMNALQSQSTSNASSVSQYAALAALEQHEETMRFIDRARTAYRERRDRIVAGLNALGLPTPTPQGAFYVMADTRAIHTDELEAARIILDEAQVAVVPGTDFAAPGQVRLSYATSMDNIEEVLRRLEGVVRR

SEQ ID NO: 31174 - protein, 94 aa, Triticum aestivum
LHVLSLYNSTVSPDGLLQQSSTVADSSLFTFADGITESIPRSYIEFAERLPLPQFRDLQDEEVKEHHRRDGFEVGNADKIFESTSKDQLTRRSA

SEQ ID NO: 31175 - protein, 138 aa, Zea mays
MALRALYNEIRSMKVRDVPAYLKPRLTWDNVKKSADQAVDRYIEKYIDTSSPDPLYHVCIGGMIFSYFVNPAPPSTAPRSTDRWNHSGGSSLVGWQRTWPSAACSRRRSRDVLATCVSCIRLAHNKEVDHAPTSDHFV

SEQ ID NO: 31176 - protein, 498 aa, Yarrowia lipolytica CLIB122
MTGTLPKFGDGTTIVVLGASGDLAKKKTFPALFGLYRNGLLPKNVEIIGYARSKMTQEEYHERISHYFKTPDDQSKEQAKKFLENTCYVQGPYDGAEGYQRLNEKIEEFEKKKPEPHYRLFYLALPPSVFLEAANGLKKYVYPGEGKARIIIEKPFGHDLASSRELQDGLAPLWKESEIFRIDHYLGKEMVKNLNILRFGNQFLSAVWDKNTISNVQISFKEPFGTEGRGGYFNDIGIIRDVIQNHLLQVLSILAMERPVTFGAEDIRDEKVKVLRCVDILNIDDVILGQYGPSEDGKKPGYTDDDGVPDDSRAVTFAALHLQIHNDRWEGVPFILRAGKALDEGKVEIRVQFRDVTKGVVDHLPRNELVIRIQPSESIYMKMNSKLPGLTAKNIVTDLDLTYNRRYSDVRIPEAYESLILDCLKGDHTNFVRNDELDISWKIFTDLLHKIDEDKSIVPEKYAYGSRGPERLKQWLRDRGYVRNGTELYQWPVTKGSS

SEQ ID NO: 31177 - protein, 486 aa, Photobacterium sp. SKA34
MTFINNVQVEKSLYIAGEWQSGINTIANINPSDISENLGDFAQASEAQVEQAIQAAKVAQPEWEKTPIERKQAVLQAIGDELIARCDELGTLLSREEGKPFAEGRGEIYRAGQFFHYFAAEVLRQIGDNAASVRPGVFVEVTREAVGVIAIISPWNFPTATAAWKIAPALAFGNSVVWKPANLTPASAVALTEVIHRQGLPAGTFNLVLGSGSQVGNTLIHSKDVNGVSFTGSVDTGRKVAAATASNFVRCQLEMGSKNALVVANDADIQIAVEATIAGSFSGAGQKCTASSRLVVMDGIHDAYVEALIKRMSELKVGHALEEGIFMGPVVDGNQLEANFVWIDKACQSGAELAFGGERLNLKNEGFYMSPTLFLNTQNSWEVNQEEVFAPMASVIRVSDLDEAIAVANDTRFGLTGGIITQSLRNSAIFKQQIQTGCVMVNLPTAGTDYHVPFGGRKESSFGPREQGQYAKEFYTVVKTAYQRPY

SEQ ID NO: 31178 - protein, 73 aa, Triticum aestivum
  misc_feature (60)..(60): Xaa can be any naturally occurring amino acid
MTTSRRLADRKTAKFQKNITKRGSVPETTVKKGNDYPVGPIVLGFFIFVVIGSSLSLQLXFQIIRTASSGGMA

SEQ ID NO: 31179 - protein, 329 aa, Oryza sativa Japonica Group
MTNVEGSKADEDGDEVGEEGHAGSLCSIVADVKEPEADEVDNDGIEAGRAQGDGVAEDSNEVSGESDDENNGGDNEGVLTTEAGECVRDAKVLDIGGRGGRGGRRGPRQEEEKWVPVTKLGRLVKENKIHKIEEIYLHSLPVKEHQIVEQLVPGLKDEVMKITPVQKQTRAGQRTRFKAFVVVGDGDGYVGLGVKCAKEIVPVRRGYWGNKIGKPHTVPFKVTGKCGSVTVRMVPAPRGPGIVAAHVPKKVLQFARASRTSSLVARLHQDPRQLRQGHLPNCLMKTYGFLTPDFWRETRFIKTPFQEYTDLLARPKGLVIEAPAEKIEA

SEQ ID NO: 31180 - protein, 133 aa, Glycine max
  misc_feature (115)..(115): Xaa can be any naturally occurring amino acid
MLDGWVCAFLLVLSWSVEVIDASAGDADPRYRGCITQCQETGCIGQRCFPNCKFSSDGEFIDRPWYMHFHGWVSFFILIHYKLPLKDGKKAYYEYAGLWHMYGLLSLNSWFLSAXFHSRDVDLTEKLDYSSAV

SEQ ID NO: 31181 - protein, 456 aa, Oryza sativa Japonica Group
MAHGGGEEEEERVLSHGDVVLLRCDLTILRGPHFLNDRIIAFYLAHLAADHHDDDLLLLPPSVPYLLSNLPDPASVAAVADPLRLASRRLVLLPVNDNPDVSHAEGGSHWTLLVLDNSNAVSGPRFVHHDSLPPTNLPSARRLAAVLRPLLPASAIPLIEGPTPRQTNGYDCGVFVLAVARAICNWWPTRARHSNSDSDWLEAVKREVNADSVKAMRTQLLQLIHTLIQNNTTTNQHSPSTQLPSHPSIASTSLPVTAQDFGTWLEDSGTHTAYDQKKADTGKGACWDNLTVSQSVRKPNVSAKNSLSYDGYSWRKYGQKQVKGSEFPRSYYKCTHPTCPVKRKVEMTPDGRIAEIVYNGEHNHPKPHPPRKPTLSTSVETLVATNDAGLENKLEGCDQAIGSDAVVEALRGGCHCLDGFRNGNEISDCKKRYAYAVIFIQNLLMFFCAKNVQVVA

SEQ ID NO: 31182 - protein, 608 aa, Ashbya gossypii ATCC 10895
MSNANHHHQQQKMYTGGRNMPHGMHRPGSIPIGQRIGKYQVIKTLGEGSFGKVKLAHHVSTGQKVALKIINKKVLAKSDMQGRIEREISYLRLLRHPHIIKLYDVIKSKDEIIMVIEYAGNELFDYIVQRDKMSENEARRFFQQIISAVEYCHRHKIVHRDLKPENLLLDEHLNVKIADFGLSNIMTDGNFLKTSCGSPNYAAPEVISGKLYAGPEVDVWSSGVILYVMLCRRLPFDDESIPVLFKNISNGVYSIPKFLSQGAANLIKRMLIVNPLNRITIHEIMEDEWFKVDLPDYLVPVDMKADATSKPGTDDERIDEALVAVLANTMSYDKDEIYEALEDPNQTDPTVLEIRDAYLLLKENKSLIDGLRSNKQKLDQLDTFLSQSPPTFESHSQLGPGSGFQAALGGSQHGDQNPHQVKRLASRQRTYQLSFSEQQDEDSTIAILPSSLPQIHRANMVAQGSPAAVKISPLSNKKSKTRWHFGIRSRSYPLDVMGEIYLALKNLGAEWAKPSEEDLWTIRVRWKYDVGTQQNERIPDLMRMVIQLFQIETNNYLVDFKFDGWESSSGNPISSSSTDDEMSTFSAYPFLHLTTRLIMELAVNSQSS

SEQ ID NO: 31183 - protein, 371 aa, Brucella suis 1330
MSYNQKQVVDAIRAFERGEIVVVMDDDGRENEGDLIVAAVHCTPEKMAFIVRHTSGIVCTPMTREEAKRLNLTPMVAENESAHTTAFTVTVDYRHGTTTGISAEDRTLTVRNLANPNAGASDFVRPGHIFPLVAREGGVLMRSGHTEAAVDLCKLANLPPIGVICELVNDDGTVKRGPDVAAFAEEHKLHRVTVADLIAYRQRKETLVRRIGDAPVETCAGKAHAYSYELPWEPMRHVAVVFGDIRDGEEVPVRLHREDVLNDVFGKGGSNLDAIMQRMGQEGRGILVYLREGSVGVRSDHRDARAREALQGEHEAHAEAVAREEEWRQIGLGAQILKDLGVSSIVLLASRERHYVGLEGFGICITRTEII

SEQ ID NO: 31184 - protein, 642 aa, Physcomitrella patens subsp. patens
MPYIRCKLLLQLNEEETSLFDVLWLLLASVVFVPLVQKIPGGSPVLGYLAAGVLIGPYALSIIQNVHGTKAIGEFGVVFLLFNIGLELSVERLSSMKKYVFGFGSAQVLATAVAVGYFTFLVSGASGPAAIVIGNGLALSSTAVVLQVLQERGESTSRHGRATFSVLLFQDLAVVVLLILIPLLSPNSSKGGVGFQAIAEALGLAAVKAVAAITVIIAGGRLLLRPVYKRMADNHNAEIFAANTLLVVLGTSFLTARAGLSMALGAFLAGLLLAETEFALQVESDIAPYRGLLLGLFFMTVGMSIDPKLLVAKFPMIMGALTLLIVGKTLIVTGLGRCFGLSTVAAVRAGLFLAPGGEFAFVAFGEAVNQASAKSDLKTMNLGIMSAEMSSLLFLVTGLSMAITPWLAAGGQLVASRFDQQDVRSLLPVESETDDLQNHMIICGFGRVGQIIAQLLAERLIPFVALDVRSERVSMGRALDLPVFFGDAGSREILHKVGAERASAAVIALDTPGANYRTVWALSKYYPHVKTFVRAHDVDHGMSLEKAGATAVVPETLEPSLQLAAAILAQAKLPASEIAAAIDQFRTNHLSELTELSEASGSSLGYGTTRSKTKPKLIPTELLSKEVDDGNYSAPPGIVAVP

SEQ ID NO: 31185 - protein, 435 aa, Xanthomonas campestris pv. campestris str. 8004
MMFISTRGAAPAVSLSQGIAAGLAPDGGLYVPQTLPPARTLQAGATLADTATTLLQPFFEGDALAGELAAICAEAFDFPAPLVPLATPGDYALELFHGPTAAFKDFGARFLAACLTRLRRAEDRPLTILVATSGDTGAAVAAAFHRQPGLRVVVLYPDGRVSPRQAHQLGCFGDNIQALRVAGTFDDCQAMVKQALNDGELQVQVPLSSANSISLGRLLPQMSYYAHAALQHHAGSGAALNLVVPTGNLGNGLAAILARALGVPLGQIVLASNANHVLPDYFAGDDYAPQPSVATVANAMDVGAPSNFERLRWLYDGDDAALREAFRALSVDDTAIRHTVQQRFARYGEVHCPHTATAVHVLEQLRAEGPEGGTGDWAVAATAHPAKFEAVVEPLIGRAVEIPPALAALLQRPAHAEPLAPDYQAFRQRLLADAP

SEQ ID NO: 31186 - protein, 389 aa, Physcomitrella patens subsp. patens
MSSNLLLSGAPNEIVVPFMGDSVPDGNLASVLKNVGDSVVVDEIVAQIETDKVTIDVRSSVAGRIEQILARQGDTVTPGTKVAIVAIGEPRAASPPGPTAFTTPSPRAPAAASPAVTVAPPPPKPGPVKVDAAAAASPKADDLSSPKRAAIPQLQGGERRVLVPMTRLRKRVATRLKDSQNTFALLTTFNELDMGNLMELRSQHKDTFLEKHGVKLGFMSGFVKAAVSALKQFPAVNAVIDGDDIIYRDYIDISIAVGTKKGLVVPVLRGVDGMNFAQIEKMINMLGKKANDGSITIDDMAGGTFTISNGGVYGSLISTPIINPPQSAILGMHSIVKRPMVVGKDIIARPMMYVALTYDHRLIDGREAVLFLRAVKDNVEDPRRLLLDI

SEQ ID NO: 31187 - protein, 291 aa, Zea mays
MAEHLASIFGTEKDRVNCPFYFKIGACRHGDRCSRLHNKPSISPTLLLCNMYQRPDMITPGVDAQGNPIDPERIQEDFEDFYEDIFVELSKHGEIESLHVCDNLADHMIGNVYVEFREEEQAARALQALQGRYYSGRPIIAEFSPVTDFREATCRQFEEHSCNRGGYCNFMHVKQVGRDLRRKLFGHLHRSLRSHSRGSRSPSPYRRRGSSSRSRDRDDYHDYYYYNYRSGSGSRRSSERHRSHDSDGSRRRRGRSRSRSRSRSPSPVREGSEERRAKIEQWNREREAAQV

SEQ ID NO: 31188 - protein, 470 aa, Chlamydophila pneumoniae J138
MNKKKRFLSLLFLTAVLLGIWFSPHPASINSNAWQLFAIFTTTIMGIIFQPVPMGAIAIIGISTLLLTQTLTLEQGLSGFHNPIAWLVFLSFSIAKGIIKTGLGERIAYFFVSALGKSPLGLSYGLVITDFFLAPAIPSVTARAGGILYPVVTSLSDSFGSSAEKGTQDLIGSFLIKVAYQSSVITSAMFLTAMAGNPLVAALAGHVGVSLSWVLWAKAAIIPGLLSLFLMPIILYKLYPPKITSCEEAIRSAKLRLKEMGPLKKEEKTILMIFFLLVVLWTFGDLLGISATTAALIGLSLLILTNILDWQKDVIANTTAWETFIWFGALIMMASFLNQLGFIPLVGDSAAALVSGLSWKIGFPLLFLIYFYSHYLFASNTAHIGAMYPIFLAVSISLGTNPIFAALTLAFASNLFGGLTHYGSGPAPLYFGSHLVTVQEWWRSGFALSIVNIVIWIGIGSLWWKALGLI

SEQ ID NO: 31189 - protein, 643 aa, Brucella suis 1330
MSRPSTPLLDKAPTPDRLRALPEQDLPQLAEELRTELIDAVSTTGGHLGAGLGVVELTVALHHVFNTPYDRIIWDVGHQAYPHKILTGRRDRIRTLRQAGGLSGFTKRAESEYDPFGAAHSSTSISAGLGMAVASELSGEKRNVIAVIGDGSMSAGMAYEAMNNAGALDARLIVILNDNDMSIAPPTGAMSAYLARLVSGRTYRSVREAAKQVAQKLPKFLQDKARKSEEYARAFFTGGTLFEELGFYYVGPIDGHNLDHLLPVLKNVRDTQKGPVLIHVVTQKGKGYAPAEAAADKYHGVNKFDVITGKQAKPPANVPSYTKIFGTSLIEEARHDDKIVAVTAAMPTGTGLDLFGEAFPKRVFDVGIAEQHAVTFAAGLASEGYKPFCAIYSTFLQRGYDQVVHDVSIQNLPVRFPIDRAGLVGADGPTHAGSFDTGFLAALPGFVVMAASDEAELRHMVRTAAEYDEGPISFRYPRGDGVGVDLPERGSVLEIGKGRIVREGTKVALLSFGTRLQECLAAAEELGAAGLSTTVADARFAKPLDHDLIRRLAREHEVLVMVEEGAVGGFGSHVLQFLATDGLLDRGLKVRALTLPDIYQDHGKPDAMYAEAGLDRTGIVRTVFAALHRDELGHEALPTPFRA

SEQ ID NO: 31190 - protein, 373 aa, Physcomitrella patens subsp. patens
MRASERGSGYLPPRFSVAPMMDWTNNHFRTIARLMSKHAWLYTEMVVDDTINYQQDNLDMILKFPESHHPIVLQLGGCNPEKLFRASQLASLYGYDEINLNCGCPSDNVTGRSFGAALMLEPELVGQCVTAIAKGSPGTPVSVKCRIGVDDFDSYDFLHNFIRIVSSTSPTKHFIIHARKAVLKGLSPDENRRIPPLKYDYVFALMRDFPNLKFTLNGGVVGIHQVNEALNRGVFGVMLGRTAYNSPWSVLANVDRVVYGDMTPVLTRRQILEKYVVYGDAELHRYGYKKPGIRQIAQPLSGLFYREKGVGLWRRALDEYIRSSQTLHALLRDTLRVIPDSVLDDSPKLEESAVLLIDISFLVERPQLFECSV

SEQ ID NO: 31191 - protein, 468 aa, Chromobacterium violaceum ATCC 12472
MKTPPQSSCPFHAVGRPPTPPRSSAGRWPPGPESGLTGWGLLKLMSRDLMGTLAGWQREFGDLVHVRTWPEHQVIVSDPQLARELLVNQADALQRWERALTVYRRVHGHSVLIAEGQVWREKRQALQPDFTRKSVQAFSPSIVEAARRAFEQWPARHAAWPIESELTSVTMEVILRMMFSSGVGSEAQQAEEAVHTLMVASTEELWRPASLPDWVPWQRKRRRARLLMNGLIERHLQARLAMPQDAWPEDLLSRLLRLHLQQPQSWPLQAVRDECKTAFLAGHETVATSLTWWAWCMASHPEIQERAREEALAALSGGGQADPAALQYVSQTLLETMRLYPAVPLLMSRRALKPVTLGDWTFPAKTVFMVPMQLMQHDERWFPEPRSYRPERFGPDAARPQQGAYLPFGGGPRVCLGQHLAMAEMALVAAQLLLRYRLSAPEGAEPPRPVFHVSQRPSQPLTLGIARI

SEQ ID NO: 31192 - protein, 301 aa, Thermus aquaticus
MRHLLDFQGWTRPEVESLLDTARVMREVLERPVKKVPALQGFTVATVFFEPSTRTRISFELAARRMSADVVSFAAQTSSLQKGESYKDTLLTLEAMGVDAYVIRADSAGVPHQATRWVKGAVINGGDGRRAHPTQALLDAYTLLEALGTLEGKKVAIVGDILHSRVARSNAELLPLLGAQVFCAGPPSLLPQSLPGAHLTPRLEEALEEADAVMVLRLQKERMEAGLVHLEDYIARYQVTEKRLALAKPQAPLLHPGPMNRDVELEGTLADSARSLVNRQVQNGVAVRMAVLYHLLVGKGR

SEQ ID NO: 31193 - protein, 254 aa, Oryza sativa Japonica Group
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFHRHHQLRHREVRL

SEQ ID NO: 31194 - protein, 427 aa, Coxiella burnetii
MTELTGVSIVTYQHIKVPSQGEKITVNKAVLVVPDRPIIPFIEGDGIGIDIAPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 31195 - protein, 359 aa, Chromobacterium violaceum ATCC 12472
MIHNTIPRWTIVTPVLAWAAIAASSAAGGHALYLALLAALLAGTVFAAVHHAEVVAHKVGEPFGTLILALAVTVIEVALIISFMLGGGEEKLALARDTIFSAIMITCNGILGICLLLGGLRHREQNFQLSGAKAALTVLAAISVLALVLPNYGTSQPGPLLSSSQLAFTGVVSLVLYGAFVFVQTIRHRDYFLVEGSHDEDEHAPPPSNKVAMLSVGALLVCLVAVVTLAKLLSPSIERFVVDAGAPAAVVGIIIASLVLLPEGLAAANAARADKVQTSLNLALGSALASIGLTIPTVAMIFVFMGEPLILGLENKETIFLLLTLVACSLSLSVGRTTILQGIVHLVIFASFVFFAISP

SEQ ID NO: 31196 - protein, 319 aa, Oryza sativa Japonica Group
MEQVVNAVLDLVVPPASMVMLAFAWPTLSFLRGVEWVVKTLTVENMHNKVVLITGASSAIGEQIAYEYARRNANLVLVARREHRLFAVRENARALGAGQVLVIAADVVKEDDCRRLVGDTISFFGQLNHLVNTVSLGHDFCFEEAGDTVAFPHLMDVNFWGNVYPTYAALPYLRRSHGRVVVNAAVEIWLPMPRMTLYSAAKAAVIDFYESLRYEVGDEVPLAGGQVEAYARMVVAGACRGDAHVKHPNWYDVFLVFRAFAPDVLAWTFRLLLSTPSPSPPASARRHQLAALPAPPLHPLLEYPSARSPGRAAQQHKLE

SEQ ID NO: 31197 - protein, 427 aa, Coxiella burnetii
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGRKEAADLVVQGIEGAIESKTVTYDFARLMTGAKEVSTSQFGKAIIKHIL

SEQ ID NO: 31198 - protein, 474 aa, Clostridium tetani E88
MSRRIRGRSLMDRFKRTPIKVQDAKKRIKNFKEVCLGYTEEEAIKEASRCLNCKNPICVPNCPVAINIPKFIQHVKNREFEEAAKVINEASSLPAICGRVCPQETQCEGKCVLGVKGEPIAIGKLERFVGDWSRENNVDLSFKGKKKDKKIAVIGAGPAGLTCAGDLAKLGYNVTIFEALHEPGGVLVYGIPEFRLPKDTVVKHEIDNVKKLGVEIETDVIVGRTITVDELLNEEGFHAVFIGSGAGLPKFMGIPGENLNGVFSSNEFLTRNNLMKAYREDYDTPIKVGEKLAVVGGGNVAMDAARTAKRLGAEVHIVYRRSEEEIPARREEVEHAKEEGIIFNLLTNPTEIIGGEDGWVKAMKCIKMELGEPDKSGRRRPVEIEGSEFILDVDTVIMALGTSPNPLISGTTKGLETDKWGCLVAKDENGETTKRAVFAGGDVVTGAATVILAMEAGKKAAKGIDEFLSDSEKK

SEQ ID NO: 31199 - protein, 317 aa, Oryza sativa
  misc_feature (79)..(79): Xaa can be any naturally occurring amino acid
GIQESSLGIILNFCFAVSNVLKRHEDLKERLSRDSDKLIFERLQREFEAARTAQTEEIPIDDEQWNDGLLATIREKVQXHMEADRKAMANQANVPADPQFQSRTTYRVKNKVIYCLDGARIGIQYETYFAGEPCEIYHCVLESKSFLEKMTVIEHTLPFFLPIREVESEFLSSNAIKFIDHLEEILQSYVDRREQVRLIKELYGNQIGELFHSLSYNLIEFVMEDFECKVTVSIRYSDLLFTLPSQARVLAWPLRSSRGISVTERRASRSASAQLVPFRLPYAEDALKTLSLPEAFAEIVLSLPRALKRILSSQESD

SEQ ID NO: 31200 - protein, 324 aa, Candida tropicalis
MSTTVNTPTIKLNSGYEMPLVGFGCWKVTNATAADQIYNAIKTGYRLFDGAEDYGNEKEVGEGINRAIKDGLVKREELFITSKLWNNFHDPKNVETALNKTLSDLNLDYVDLFLIHFPIAFKFVPIEEKYPPGFYCGDGDNFHYEDVPLLDTWKALEKLVEAGKIKSIGISNFTGALIYDLIRGATIKPAVLQIEHHPYLQQPKLIEYVQKAGIAITGYSSFGPQSFLELESKRALNTPTLFEHETIKSIADKHGKSPAQVLLRWATQRNIAVIPKSNNPERLAQNLSVVDFDLTKDDLDNIAKLDIGLRFNDPWDWDNIPIFV

SEQ ID NO: 31201 - protein, 471 aa, Saccharomyces cerevisiae YJM789
MSRSLLVENSRTINSNEEKGVNESQYILQKRNVPRTILGNVTNNANILQEISMNRKIGMKNFSKLNNFFPLKDDVSRADDFTSSFNDSRQGVKQEVLNNKENIPEYGYSEQEKQQCSNDDSFHTNSTALSCNRLIYSENKSISTQMEWQKKIMREDSKKKRPISTLVEQDDQKKFKLHELTTEEEVLEEYEWDDLDEEDCDDPLMVSEEVNDIFDYLHHLEIITLPNKANLYKHKNIKQNRDILVNWIIKIHNKFGLLPETLYLVINIMDRFLCEEVVQLNRLQLVGTSCLFIASKYEEIYSPSIKHFAYETDGACSVEDIKEGERFILEKLDFQISFANPMNFLRRISKADDYDIQSRTLAKFLMEISIVDFKFIGILPSLCASAAMFLSRKMLGKGTWDGNLIHYSGGYTKAKLYPVCQLLMDYLVGSTIHDEFLKKYQSRRFLKASIISIEWALKVRKNGYDIMTLHE

SEQ ID NO: 31202 - protein, 199 aa, Kluyveromyces lactis NRRL Y-1140
MSEEEEFKQFDEENDTYKVGEKKTVEEYKNLDADDEALRKWKDSLGLGGDVLPLEHPGDERRVVIQKIQLIVDTEPAPITFDLTNEKTLKDLASKRYKIKEKSIYHLKITFKVQHEIITGLRYVQYTKKAGIAVDKIDDHLGSYAPNTTKNPFYEVELPESEAPSGFLVRGNYSAVSKFIDDDKNNHLTLNWGVEIVKR

SEQ ID NO: 31203 - protein, 469 aa, Zea mays
GRVGGTFAKVYHARHVDTGDNVAIKVLDKEKAVKSGLVPHIKREIAVLRRVRHPNIVHLFEVMATKTKIYFVMELVRGGELFSRVSKGRLREDTARRYFQQLVSAVGFCHARGVFHRDLKPENLLVDEQGNLKVSDFGLSAVAEQFRPDGLLHTFCGTPAYVAPEVLGRRGYDGAKADVWSCGVILFVLMAGYLPFHDKNIMAMYKKIYKGEFRCARWFSKDLTSLLMRILHTNPNTRITLPEIMESRWFKKGFKPVKFYIEDDQLHNVIDDEDGLLDMGPAGPVPPPLPPPPPPLPPPKVDGDESGSDSDSSISSCPASMLSDESQRPRGSLPRPASLNAFDIISFSRGFNLSGLFEEKGDEVRFISAEPMSDIITKLEDIAKLKSFKLRRKDWRICLEGTREGVKGPLTIGAEIFELTPPLVMVEVKKKAGDNEEYENFCDKELKPGMQHLVHHMVRAPSMLLTDAK

SEQ ID NO: 31204 - protein, 404 aa, Haemophilus influenzae Rd KW20
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEDANWFPTIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIHSDEKMVLDLLRQEKVLLVHGKGFNWHSPDHFRIVTLPYVNQLEEAITKLARFLSDYRQ

SEQ ID NO: 31205 - protein, 442 aa, Solibacter usitatus Ellin6076
MIEPQIVSPTATTEILAEKIRTRKARVGIVGLGYVGLPLAVEFAKAGFEVTGIDISEEKANRVNAGDSYIGDIASSALAPLVESGKLRATTDFSAVLDLDTINICVPTPLRKTKDPDMSFIVSSCQEIARHFHAGMLVILESTTYPGTTDEVVLPMLAKTGLEVGRDFFLCFSPERVDPGNPRYQTSNIPKVVGGCTPECTEMGRRFYSEALQHVVPVSSTQVAEMVKLLENTFRMINIGLVNEIAMMCDRIGINVWEVIDAAATKPFGFMPFYPGPGLGGHCIPIDPFYLSWKTKQAGIEARFIELAGYINGQMPHFVVDKIQNALNDAGLAVKGSKIHVMGVAYKRDIDDVRESPALDVLLLLQRKGATVTYSDPHVPSLRLDGVELQGAPESTAAGADCVVIITDHAAFDYAALLERSRLIVDTRNALKGVSSNKIVRL

SEQ ID NO: 31206 - protein, 242 aa, Mycoplasma mobile 163K
MRKKIIIGNWKMNKTKTEAENFVKEFNKITSELNLKLDKNLVAGLALPFTSLGIKKEGNFANLVIAAQNFHQNNSGAFTGEISAEMLLDLGVKMVVLGHSERREFFHETDEIVNMKMHQAIKNNLVPIVCVGETELQYNSNKSKEVIKNQIEKSLKNLSDFSKIIIAYEPIWAIGTGKTATVEYAQEMCKYIRSLTNEKTIIQYGGSVKPNNIKELLSQKDIDGALVGGASLNVKDFIDLIK

SEQ ID NO: 31207 - protein, 305 aa, Glycine max
MSITSSTSFKSLTMAESCLLSSPSSLFNNKTKPSLFSPPSKPLTLQFSCINSSVSLSLAARAHRSPLVTRVAQTSDWAQQEEDDTATFQDEEQGLSETQAGLSSWEPNGEDAGEESFAEPPEEAKLFVGNLPYDVDSQKLAMLFEQAGTVEIAEVIYNRETDQSRGFGFVTMSTVEEAENAVEKFSRYDFDGRLLTVNKASPRGTRPERPPPRHSFEPSLSIYVGNLPWDVDNTRLEQIFSEHGNVVNARVVYDRETRRSRGFGFVTMSDETEMKDAVAALDGQSLDGRPIRVSVAEDRPRRGSF

SEQ ID NO: 31208 - protein, 499 aa, Burkholderia xenovorans LB400
MTDMTHFDTSLVPTGDIFIGGEWRQGRGNPYTSLYPADQSVNMEISTANADDARDAVEAADIAWRRADWSGLKPHQRALILYRIADLIMARHEALAQLQRRDNGKPIGETRVLVASAANTFRYFAACLETLDEEVTPSRGDYLTMSIYEPIGVIAAITPWNSPIASDAQKLAPALAGGNAVVLKPAEVTPLVSLALARICEEAGVPKGVLSVLPGKGSVIGDVLVRHPLVKKVSFTGGTEVGRGIARIAADKLMPVSLELGGKSPTIVFDDADLDHAVNGVLYGIFSSSGEACIAGSRLFVQRSIYDTFMKRLADGARKLRVGDPSRSETQMGPLITAAHRETVERYVALGLEEGGRLLCGGERPVGDGREAGTYFQPTILEGLTNNARICQEEIFGPVLVAMPFDDEASLLKEANNSVFGLAAGIWTRDYKRAYRIARALEAGTIWINTYKLFSISTPFSGWKESGMGREKGRLGIREYMQQKSLYWGLNDAPLAWAN

SEQ ID NO: 31209 - protein, 78 aa, Bacteroides fragilis YCH46
MSEIASRVKAIIVDKLGVEESEVTETASFTNDLGADSLDTVELIMEFEKEFGISIPDDQAEKIGTVQDAVAYIEEHAK

SEQ ID NO: 31210 - protein, 516 aa, Oryza sativa Japonica Group
MASLMEVQVPLLGMGTTMGALALALVVVVVVHVAVNAFGRRRLPPSPASLPVIGHLHLLRPPVHRTFHELAARLGPLMHVRLGSTHCVVASSAEVAAELIRSHEAKISERPLTAVARQFAYESAGFAFAPYSPHWRFMKRLCMSELLGPRTVEQLRPVRRAGLVSLLRHVLSQPEAEAVDLTRELIRMSNTSIIRMAASTVPSSVTEEAQELVKVVAELVGAFNADDYIALCRGWDLQGLGRRAADVHKRFDALLEEMIRHKEEARMRKKTDTDVGSKDLLDILLDKAEDGAAEVKLTRDNIKAFIIDVVTAGSDTSAAMVEWMVAELMNHPEALRKVREEIEAVVGRDRIAGEGDLPRLPYLQAAYKETLRLRPAAPIAHRQSTEEIQIRGFRVPAQTAVFINVWAIGRDPAYWEEPLEFRPERFLAGGGGEGVEPRGQHFQFMPFGSGRRGCPGMGLALQSVPAVVAALLQCFDWQCMDNKLIDMEEADGLVCARKHRLLLHAHPRLHPFPPLL

SEQ ID NO: 31211 - protein, 395 aa, Dechloromonas aromatica RCB
MQYGAFSTDSLMYITNRPDLVFERGEGSWLIDHQGKRYLDFIQGWAVNCLGHCPPEITEALVEQAGRLINPSPAFYNGPMVELAGLLTANSCFDRVFFANTGAEANEGAIKLARKWGRLHKGGAHEIITFEHSFHGRTLATMSASGKAGWDTLYAPQVSGFPKAAYNDIAAVEALIGPKTVAVMLEPVQGEGGVIPAGIEFLKALRELTRQRGILLIVDEVQTGVGRTGKLFAHEHADIEPDIMTLGKGIGGGVPLAALLAREAICCFEPGDQGGTYNGNPLMTAVGVAIMKRMLAPGFLAEIEARGQYLAKCLRELSAKHGLKGERGSGLLRALILDDERAPQIVQRALTMQPVGLLLNAPRPTLLRFMPALNVSETEIDQMIAMLDELLAKQD

SEQ ID NO: 31212 - protein, 521 aa, Candida maltosa
MAIEQIIEEVLPYLTKWYTIIFGAAVTYFLSIALRNKFYEYKLKCENPVYFQDAGLFGIPALIDIIKVRKAGQLADYTDTTFDKYPNLSSYMTVAGVLKIVFTVDPENIKAVLATQFNDFALGARHAHFDPLLGDGIFTLDGEGWKHSRAMLRPQFAREQIAHVKALEPHVQILAKQIKLNKGKTFDLQELFFRFTVDTATEFLFGESVHSLYDEKSGIPNDIPGRENVREAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 31213 - protein, 641 aa, Clostridium tetani E88
MNKQMIILSCKNLTKSYGIDSILHSISFNIKDTEKVGLIGPNGSGKSTLLKILANKLDHDGGEIFVEKNKKIGYLPQHYSIESSKTIYNEMLYVFKSLMDLEEKIADLEEKMNEPYDSSNAEYHDKIIKNYTTAVETYTLRGGYTYKGEINKVLTGLGFEESDFDTPVNILSGGQKTRLALCKLLLINPDILLLDEPTNHLDLDAIEWLEEYLKNHKGTMIIISHDRYFLDSVTNKTMEISNNHLKSFDGNYTKFIEFKKKDYEAQLKAYSIQQSEIKRQEEIIERYRSFNREKSIRAAESRQKALDKMEKIDKPTVDSSSAKIKFKASIKSGSDVLYIEDLSKSFDEVELFHNINLDIKRGDRSALVGENGRGKTTLFKMIMDEIPADNGTKVLGRNVFIGYYDQEQSDLNPNKTIIDEVWDDFPNMTTTEVRNALASFLFTGDDVFKEISKLSGGEKCRINLLKLMLSKANFLLLDEPTNHLDIVSREALEDAIVNYDGTVLVISHDRYFLNKVIDKIYELKKDEIKEYLGNYNYYIEKKKNPSRFEALEENEGMTKTQIKMEKKKKREAEKEQKQIKMKAKNIEELISSKENELLKLQEELCLEEVYSNPDKAQDINLKILNIEKSLEELYNEWENYL

SEQ ID NO: 31214 - protein, 508 aa, Burkholderia xenovorans LB400
MSHTSVGEAEVACGESEVVRTEKSTAALATRLVPVVLAGGAGSRLWPMSREHYPKQLIDVLGSDSLLQATVQRMEGFRADGSMVSAPIIVCGDEHRFVTSEQLRARGIDARIVVEPARRDTAPALTIAAADLCSEGDDAIIVAMPADHAIENLVAFHSAIAVAVQHAQRGAIVTLGVPPTRPDTGFGYIRLGSELGRGAHRIASFVEKPAAELAEQYLASGRYWWNSGIFAVRASVWLAMLRIMQPVMHDACVLAHAQGTHDGAYFRPGADAFKSSPADSIDYAVMERLGSDERFADGVVVPLDAGWSDLGSWDAVWEALDKDADGNAARGRVVFEGTTSSFAHSQGRLIACVGLTNVVVVETDDAVLVADRSRVQEVKSVVSRMRALQAPEVDAHRKVRRPWGYYDSIDHGERFQVKRIVVNPGGRLSLQLHHHRAEHWIVVSGTALVTRGNEEFMLSENQSTFIPLGVTHRLENPGKLPLELIEVQSGPYLGEDDIVRFDDTYGRA

SEQ ID NO: 31215 - protein, 162 aa, Glycine max
HFFSGDSQFAKSNQEALKNILIIFAKLNPGVRYVQGMNEILAPLFYVFKNDPDEENAAFAEADAFFCFVELLSGFRDNFVQQLDNSVVGIRATITRLSQLLREHDEELWRHLEVNPQFYAFRWITLLLTQEFNFADSLHIWDTLLSDPDGPQETLLRVCCAM

SEQ ID NO: 31216 - protein, 270 aa, Clostridium tetani E88
MEKSIGFIGCGNMAQAMITGIVTSKIVKGKNVFVSDRDEEKLKYIKDNFNVNTSKSNEEVAEKSDIIILAVKPNKYGEVIEGIKDYVKKDVIIVVIGAGITIDYVEESFKKKLKVIRTMPNTPALVGEGMSAICYNELVEEYDLKVVVDIFKSFGKVEIIEENLMDAIPAISGSSPAYVYMFIEALADGAVLDGVPRDKAYKMAAQSVLGAAKMVLETGEHPGELKDRVCSPAGTTIEAVYSLEKNNFRGTVMEAMRKCTDKTREMSKRN

SEQ ID NO: 31217 - protein, 219 aa, Onion yellows phytoplasma OY-M
MFPLLANLITVFRIVLVFVLLPLMCVSESEPEFANVLTFQIIFIVAAITDYLDGYIAKKYQQQTVFGKFFDPIADKLLVIITLFYICQCRLSATQGTFLFADTQMPKKFFTAVIMIIVIREFLVTGIRLVASNKEGVVISASFWGKAKTVFTFVAIICLFFGLYTSSTFACDANLKKWFGYLSNIGDICLLVSVVLTIVSGFDYFFKNYKIIRKNFAPE

SEQ ID NO: 31218 - protein, 316 aa, Colletotrichum gloeosporioides f. sp. malvae
MPAPFSARPCLAPFPPKQLFGVSQVLLQIRHPGCRGPGRLWTGLIRTHRISPGPATRILMASMSSAIRIHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYIRNLPFMPKKPFPQLFAQANPDALDLLDRMLAFDPSSRFSVEQALEHPYLHIWHNASDEPDCPTTFNFDFEVVEDVGDMRKMILEEVYRFRQLVRPSRQHPTGAQAAGQAGAGQVPFLWKPRLDSSDPD

SEQ ID NO: 31219 - protein, 498 aa, Nostoc punctiforme PCC 73102
MTTPLSCRNYINGQWLNAVGEATLESRNPADKTEIVATYPRSQVNDVDTAVASARKAYRSWRTVPAPARAEYIFRVGEILLQHKEELAQLISREMGKPLTEARGDVQEGIDCAFYSAGEGRRLFGQTTPSEMSNKFAMTVRMPIGVCALITPWNFPVAIPCWKAMPALVCGNTVILKPAEDTSACATKLIEIFQQAGLPPGVINLVHGVGEEAGKALVEHPNVDLVSFTGSSETGAFVGATCGRTHKRVCLEMGGKNAQIVMEDADLELALDGAVWGAFGTTGQRCTATSRLILHRDIKEKFTTMLYERTSKLRLGAGNDTDTDIGPIINEKQLQQVSKYLDIAREEGAKVLIGGEIASEGSLKNGYFFQPTILDRVTPDMRVAREEIFGPVVALIEVSSFEEAIAILNDSNYGLSSSVYTRDINRAFTAMRDIEAGITYINGPTIGAEVHLPFGGVKQTGNGHREAGTTALDVFTEWKSVYVDFSGSLQRAQIDNRS

SEQ ID NO: 31220 - protein, 413 aa, Bacillus cereus G9241
MGKLFLKICFFALMTVCSFATKVIYAEESQQNNYPIILVNGFAGWGREEMLGVKYWGGVHDIQEDLKRNGYTVHTAAVGPVSSNWDRACELYAQINGGTVDYGAAHAEKHGHNRFGRTYSGFMPSWSETNKVHLVGHSMGGQTIRTLVQLLKEGSFEEKNYVKNHPNNKISPLFEGEKSYVHSVTTLATPHNGTTLADGSLLLPFVKDLLITAASLGGNSNLSLYDFKLDQWGVKKNAGESSLQYTDRILNSSIWKNTKDISQWDLSTDGAKELNTWVKTQPNVYYLSYSGHASQAAPITGLHLPHITMNKVLMGNAFFLGSYARYEENRPLINTSWWQNDGVVNTNSMIAPSSNATVNNNESLQIGKWNHIEMKANWDHLDMVGLSISDTLGFSNIQEFYRTIAEKLSRLPK

SEQ ID NO: 31221 - protein, 293 aa, Burkholderia xenovorans LB400
MLKVTKAVFPVAGLGTRFLPATKASPKEMLPIVDKPLIQYAVEEAMAAGITEMIFVTGRSKRAIEDHFDKSYEIEAELEARGKDKLLELVRSIKPSHVDCFYVRQSEALGLGHAVLCAEKLVGDNPFAVILADDLLHGTPPVMRQMIEAFDHYHSSMIGVEEIPSQDTGSYGVIDGSEWGDSIIRMAGIVEKPEPNVAPSNLGVVGRYVLKPRIFKHLRAIKAGAGGELQLTDAIQSLLADEQVLAYKYHGTRFDCGSKLGYLKATVEFALRHPEVRSEFRAYLEKHLSLLQM

SEQ ID NO: 31222 - protein, 390 aa, Onion yellows phytoplasma OY-M
MNIKEKALEIHEKNKGKVGIVSKVKVQNLDDLALAYTPGVAEPCLKIKENPSDVYRYTMKGNMVGVVTNGTAVLGLGNIGPKASLPVMEGKAILFKELAGIDSFPICIDSTDSQEIVNIVSKISTVFGAINLEDIKSPQCIEVEDALEAKLDIPVFHDDQHGTAIVVAAGILNSLKVVKKSIEDVQVVINGAGSAGMAIAKMLLLLKVNNIVLVDKTGALYKGVANLNEPQKKLVEVTNKYQEKGTLKEVLKGKDIFVGVSAPGIVTAEMVSTMAKDAIVFALANPVPEIMPDEAKKGGARIVATGRSDFPNQVNNCLAFPGVFRGALDAKATKITEEMKKAAIYALKNIIKEQDLNENNILPTSFNKEVVKQIALAVCKVAKETGVVRK

SEQ ID NO: 31223 - protein, 814 aa, Oryza sativa Japonica Group
MTTLLYISLGFLLFSLHVTPPCSAATNDTLAAGEVLAVGDKLVSRNGRFTLGFFQPSVVVKSGNITSPNWYVGIWFSNISVFTTVWVANRDSPVTELQLNQTQLKLSKDGNLVISSNASIIWSSTVNRTSATTMNSSTSVVLSNDGNLVIGSSPNVLWQSFDYPSDVLLPGAKFGWNKVTGFTRRFTSKKNLIDPGLGLYYVELDNTGIDLSRSNPPNMYWSWSSEKSSSALISLLNQLININPETKGRINMTYVNNNEEEYYEYILLDESYYAYVLLDISGQIEINVWSQDTQSWKQVYAQPADPCTAYATCGPFTICNGIAHPFCDCMESFSQKSPRDWELDNRTAGCSRNTPLDCSNTTSSTDVFHTIARVRLPYNPQIVDNATTQSKCAQACLSYCSCNAYSYENSKCSIWHGDLLSVNRNDGIDNSSEDVLYLRLAAKDVPSSRKNKIKPIVAVVAASIVSLLVMLMLILLVLRKKLRFCGAQLHDSQCSGGIVAFRYNDLCHATKNFSEKLGGGGFGSVFKGVLSDSTIIAVKKLDGARQGEKQFRAEVSSIGLIQHINLVKLIGFCCEGDERLLVYEHMVNGSLDAHLFQSKATVLNWTTRYNLAIGVARGLSYLHQSCNECIIHCDIKPENILLDASFAPKIADFGMAAFVGRNFSRVLTTFRGTVGYLAPEWISGVAITPKVDVYSFGMVLLEILSGRRNSYKVHTDDNSDQVAFFPVQAISKLHEGDVQSLVDPQLNGDFSLVEVERVCKVACWCIQENEIDRPTMNEVVRVLEGLQELDMPPMPRLLAALAECTVVAHCDDDS

SEQ ID NO: 31224 - protein, 110 aa, Triticum aestivum
  misc_feature (74)..(74): Xaa can be any naturally occurring amino acid
  misc_feature (81)..(81): Xaa can be any naturally occurring amino acid
MAGKARVFMCVALVVLLLLVETTAPSGQAHAVDCGSACSYRCSKSSRPNLCNRACNTCCRRCDCVPPGTAGNEXVCPCYAXMTTHEGRQKLPMIQTAFSNERIGLNAWLD

SEQ ID NO: 31225 - protein, 417 aa, Ashbya gossypii ATCC 10895
MMLSRRLAHGAHKAVRVQTRALSIHEYQSSELLRQYGIGTPRGQAASTAQQAYDAAAGLGHELVVKAQALTGGRGKGHFNTGLQSGVHMISSAEEARELAEQMLGNRLITKQSGAKGKPVSAVYVVERVKARHEAYLSILMDRQTKKPLIICSSQGGMNIEEVAHSNPDAIKKFYVDVKKGLDAETAAAVARSLGFSQEAEADAADAVQKLYKIFREKDATQIEINPLSEVEGQHTKVMCMDAKFGFDDNASFRQQEVYSWRDLTQEDPDEVVAKNSDLNFVKLQGNIGCLVNGAGLAMATMDVIKLYGGDPANFLDCGGGATPETIETAFKLILSNTKVKAIFVNIFGGIVRCDYVAQGLVAATKNLDVKVPIVARLQGTNLEEGRRIIKESGLKIYGFDELDPAAEKVVGLAASS

SEQ ID NO: 31226 - protein, 446 aa, Deinococcus radiodurans R1
MAFPTILAALFTLTALLSYLNARFLRLPPTIGVLLGGLFLAAGVAVLGRLGVQGAQDLPRHIAALPFDQVVIAGLLSFLLFASAIQTDVRALLRERGVVLALAVVTTLLTMLLLGAGLYVVMQLFGSPLTWTQALLFGAIVAPTDPVAVTPLLERARVPERLRALIAGESLFNDGVGVAAFTVLSSAALQGSAVRLGELGGLLLREMLGGMALGAALGWLTARLTTSARSQDTAVLLSLALVTGGYALGEALHVSAPVTVAAAGVTLMLLGQLARRRRAASGFPTLSAEARRASLQIRSFWEVTDQVLNAVLFVLLALEVLVLRPRPGLLLAGIVVAMLAIVARGIAVGVPLTLYQWRARRRPELQPFTPYTRRLMTWAGLRGTVALALAFSLPPGELRDTLLFLTYVVVIFSLLVQGLTVPILGRKAAAAAKAAEAQGSVPGASV

SEQ ID NO: 31227 - protein, 812 aa, Kluyveromyces lactis NRRL Y-1140
MADTLPRSDDLEATWNFVKPGIDQILDRDGTSDIKTNRVQKVLSPRMYMEVYTAIYNYCVNKSRSTGHFQSDIIGKQMNQSSILVGGEIYENLKNYLKDYISNLKKDDNVTFLNFYVRRWERFTIGAIFLNRVFDYMNRYWVQKERSDGKRHIFDAHTLCLMTWKEVMFETHKTELVTEIFDQLDLQRRGELVNKSAITIAIKSFVILGIDPSDLKKLNLNVYIQNFEQPFLQKTKEYYTKMSNEFLDSHSVSEYIEKANECIIFEEKDMILYLDSHTSAPLSTALNQVLIADHADKLKKEFILLLDKQDQRLIKLIYELMKRDYRMLPDLVDTFDMYIKRVGNEEIDKLIDAHNKSAAQDSNAKRQPGLSPRDYLKCLIGVYKLFYNITIECFENHPAFAKALDYGCRCFINNNSFAIPPGSPKFATSRAPEMLAKYSDQLLKKSTKNNEQVDLTVDDIMTVFKFLADKDAFEMHYRKNLAKRLIHGSSKSEADEEIIIQRLQSENSLEYTSKITKMLQDVKLSKNLHDEFSTFISQDGNNTTSAATFRSKVPELEPLILADNVWPFSYQPTEFALPPVLEHSKNKLETMYTDKHSGRILKWLWPMSRGEIKAHIGKPGKPPFQFTVTIFQMAILTLFNDISTLTFEQIQERTNLKATQIASNMYPFVKMKLLIQSPEGVESMIKLDTKYTLNKPYRLSKTSVNFAAAVKNDLTFTATVNGSALDETEASEQKKAEKELNQQRLMFLRACIVRIMKAKRKLPHSSLMNECIAESQQRFNAKVSMIKKAVDNLIEQEYLKRTDDGECYEYLA

SEQ ID NO: 31228 - protein, 189 aa, Alteromonadales bacterium TW-7
MSTSLINTKIQPFNATAYHNGDFVEVSEKDVLGKWSIFFFYPADFTFVCPTELGDVADYYEQLQEMGVEVYSVSTDTHFTHKAWHDTSDTIGKIKFPMIGDPTGRITRSFGVMIEDDGLALRGTFVMNPEGEIKVIETHDLGIGRSAKELVRKVQAAQYIATHDGEVCPASWQPGEDTLAPSLDLVGKI

SEQ ID NO: 31229 - protein, 438 aa, Physcomitrella patens subsp. patens
MYPFLQSVLGIILGGGAGTRLYPLTKKRAKPAVPIGANYRLIDIPVSNCINSNINKIYVLTQYNSASLNKHVSRAYATNLGSYRNEGFVEILAAQQSHDNPNWFQGTADAVRQYLWLFEEAQVMDYVILGGDHLYRMDYQKFIQVHRDTGADITVAALPMDEARASAFGLMKIDGKGRIYEFAEKPKEDELRAMQVDTTVLGLDSERAKLKSYIASMGIYVVRKEAMVSLLRKDFPEANDFGSEVIPGATKSGMKVQAYLFDGYWEDIGTIEAFYNANLGITKKPVPDFSFYDRISPIYTQPRFLPPSKMMDADIRDSVIGEGCIIRNAAIYHSSLGLRSWVSEGAVVEDTLLMGADYYETDQQRRELLSSGGIPMGIGRNSIVKRAIVDKNARIGENVQIVNVDNVREAEREADGFFIRSGLVTIFKDAIIPDGTII

SEQ ID NO: 31230 - protein, 265 aa, Aspergillus nidulans FGSC A4
MPLDTSTTYPLTKLRLDGRRWNELRLLQAQISTNPASSGSSYLAMGNTTILCSVHGPAEGRRGDATGGSAGSSGAVVEVDVNIAGFASVDRKRRAGGSDRQSGRIASTLRSAFQSHLHTYLYPHSTISIHVSVLSSDGSVLAAAVNACTLALVDAGIPMPGLLCGCTAGMSGSASTPRDPMNDTLDPLLDVSLPEEQELPFLTVATTSAPAVMTDGDEDDMKVSMLTMDSKVHYSYIETMLAVGVDGCKQVREILDSVIKGSSRR

SEQ ID NO: 31231 - protein, 257 aa, Triticum aestivum
  misc_feature (17)..(17): Xaa can be any naturally occurring amino acid
  misc_feature (217)..(217): Xaa can be any naturally occurring amino acid
  misc_feature (226)..(226): Xaa can be any naturally occurring amino acid
ATQSSEYYKGLRYRAAXLFIFGFWMLDLANNTVQGPARALLADLSGPDQCNSANAIFCSWMAVGNVLGFSAGASGNWHKWFPFLMTRACCEACGNLKAAFLIAVVFLLFCMAVTLYFAEEIPLEPKDAQQLSDSAPLLNGSRDDHDASSEQTNGGLSNGHADANHVSVNSSADAGSNSNKDDVEAFNDGPGAVLVKILTSMRHLPPGMYPVLLFMAXTWLSWFPFXLFDTDWMGREVYHGDPKGNRVKESYDYGVGE

SEQ ID NO: 31232 - protein, 321 aa, Burkholderia sp. 383
MTSRQHPLHSGFGAASTANDVLVDLDLDGKTAIVTGGHSGLGLETTRALAQAGATVIVGARNADAAREATRGIAGVEIAALDLADLASVAAFAARFVEARRDVDIVINSAGVMACPETRVGDGLEAQMAVNHLGHYALVNGLWPVLAQGDGARVVAVSSLGHRLSPIRWDDAQFAHGYDKWLAYGQSKTANALFAVQLDALGAPYGVRAYSLHPGKIATPLQRHLTREEMMAQGWVDEHGLPIDPTFKTPAQGAATQVWAATSPRLAGIGGVYCEDCDIAVVTQGNEESGVRPHAIDPEEAARLWAWSAALTGIDAFAVRR

SEQ ID NO: 31233 - protein, 454 aa, Vibrio vulnificus CMCP6
MTITNPFNDEVIGTVPNMGEKETQEVIAGADKAFQQFKALTAQERANLLHRWHQLILEHSDELAHIMTLEQGKPLAEAKGEVLYAASFIEWFAEEARRAYGTLVPSHKANAKILVTKEPIGVVAAITPWNFPAAMITRKCGPAFAAGCPVILKPAPDTPFTALALAVLAEKAGFPAGVFNVITGDAVAIGGELTSNKRVRKLSFTGSTPVGKLLMRQSADNIKKLSLELGGNAPFIVFEDADLDAAVEGAMIAKFRNAGQTCVCANRLYVQRSVYSEFCQKLVAKVSALKVGNGFDQGVHIGPLINDAAVAKVVQHVEDAQSKGAQIECGQLPTAGSRLVQPLVLSGVTDEMLVAQEETFGPMAPLFVFDSEEEVLARANNTDFGLAAYFYTQSLSRAWRMSEALEAGIVGINEGLISTTVAPFGGVKESGLGREGSFLGMDDYMESKYILMGL

SEQ ID NO: 31234 - protein, 330 aa, Oceanobacter sp. RED65
MTTKTLPDNARRFCTAPMMDWSDSHCRLFWRTLSKDAFLYTEMVTTGALIHGDGGPDRFIRYRDEEHPVALQLGGSNPKDLAQCAKIAQDFGYDEVNLNVGCPSDRVQNNMIGACLMGHPQLVADCIKAMQDAVEIPVTVKHRIGIDDQDSYEHLHHFVDTVAATGCETFIIHGRKAILDGLSPKENREIPPLRYEVVQQIKQDLPQLEVILNGGIKTHKEATEHLKWADGVMLGREAYHNPSVLMDVDALYYGHEPQTKDKKDCIRALYPHIEDHLSKGFKLSYVTRHILGLFNGQPGSRLFRRHLSEQAFKKDASIQTIEDALAYMPD

SEQ ID NO: 31235 - protein, 323 aa, Acinetobacter sp. ADP1
MSNLTLAQYLQQKNGNLTPELAQVIETIANSCKKIDHAIQKGALADLLGSAGNENVQGETQKKLDVLSNDFLIDALKVHPHVGGLASEELDEFTPGQQDGKYLVLFDPLDGSSNIDINMCVGTIFSILPAKNSITQTQDFMQAGTEQVAAGYVLYGPSTMMALTCGEGVAFFTFDPESQTFILTSDAIQLDADTQEFAINASNQRHWEEPVKRYIDELLAGKTSVRGKDFNMRWVACMVADIHRILCRSGIFMYPYDLKDPSKAGRLRLMYEANPMSFLIEQAGGSATTGRVRIMDIQPNDLHQRVPVIIGSKNEVDLVTSYH

SEQ ID NO: 31236 - protein, 271 aa, Haemophilus ducreyi 35000HP
MKHIELNQMWQKIRQEAQQLADQEPILASFFHATILTHHNLGSALSYILANKLANAIMPAIALKEIIEQAYEADPQIIESAAYDINAVTTRDPAVDRWTTPLLYLKGFHALQSYRVTHYLWQQGRRDLAVYLQNQISVAFDVDIHPAARLGHSIMFDHATAIVIGETAVIENDVSILQGVTLGGTGKEHGDRHPKIREGVMIGAGAKILGNIEIGRYSKIGANSVVLQAVPDHTTAAGIPARIIGRAPQQKPAFDMNQYFEEIEGTDGDGI

SEQ ID NO: 31237 - protein, 152 aa, Rhodopirellula baltica SH 1
MQRTLVLLKPDCVQRRLIGDVLSRFEAKGLHIVAMKLLQVTPELSKQHYAEHVEKPFYPSLEEFITSAPVVAIALEGLEVIRVVRDMLGATNGLQAAPGTLRGDYSSSRQMNLVHASDSEESAQRELDLYFNADEFCDYSLVLTPFMRADDE

SEQ ID NO: 31238 - protein, 455 aa, Oryza sativa Japonica Group
MSKPQQQSPPSTTTTSPPPPPPSTPPPASSSRSLLSALRRSPVTTLVAAFFLLALFMYGEDVRTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSSPPSTHPSLPPQ

SEQ ID NO: 31239 - protein, 336 aa, Haemophilus ducreyi 35000HP
MTTDDTRPIAVLGAGSYGTALAIALARNGQRTHLWGHNPDKMVKMAEQRMNTESLPAIPFPNALIIEKVLAHTLQQAQDILIVVPSHAFADILHQIKPLLTTQHRIMWATKGLEHNTGRLLQTVATEIIGEQHPFAVLSGPTFAKELALGLPTAITLASHDAKFADEMQQRIHCSKAFRVYLNTDMIGVQLGGAIKNVIAIGAGISDGMGFGANARTALITRGLAEISRLGESLGANPKTFMGMAGLGDLVLTCTDNQSRNRRFGLALGQGKSAEQAIAEIGQVVEGFYNTKETYLLAQRQNIEMPIVEQIYQMLFCNKNANDVVTSLLERQRKKE

SEQ ID NO: 31240 - protein, 340 aa, Escherichia coli CFT073
MSTMKVLICQEIKNLVWEVRERPVPGDNEALIKIKTVGICGTDIHAWAGNQPFFSYPRVLGHEICGEIIESGKNIHNFNIGQQVAVIPYISCQQCPACKSGRTNCCEKISVIGVHQDGGFSEYLSVPVANILPADGIDPQAAALIEPFAISAHAVRRAAIAPSEQVLVVGAGPIGLGAAAIAKADGAQVVVADTSPARREHVATRLELPVLDPSAEDFDAQLRAQFGGSLAQKVIDATGNQHAMNNTVNLIRHGGTVVFVGLFKGELQFSDPEFHKKETTMMGSRNATPEDFAKVGRLMAEGKITADMMLTHRYPFATLAETYERDVINNRELIKGVITF

SEQ ID NO: 31241 - protein, 284 aa, Pyrobaculum aerophilum str. IM2
MRVGVVGLGIMGGPMAMHLHRAGLLAAVYNRTRAKAEPFEKLGVYVAQSPGDLAKRVDVVIIMVSDAPDVEQVLFGPGGIVEGARPGLIVVDMSTNSPDWARRFAERLAQYGVEFLDAPVTGGQKGAVEGTLTVMVGGKEELFKRLLPVFQAFGKNIVYVGPVGYGQAMKLVNQVVAALNTVAMVEGLRLAKALGLDMDKVVQVLTGGAARSGSIELYLPKLLKGDLTPGFKAAHLKKDLSYVMELANRASLSLPATALALELYKKMVEKGLGELGIHALGEIY

SEQ ID NO: 31242 - protein, 254 aa, Gossypium hirsutum
MEARLKGISSSLDSENQIQATNNPNSIIFSFVNLQLEVNNSKSAMADQTNGVTLNENQRIRKEETLYDVLHRSVSMILPDASSTESAPLLQRIKISVSENGPRLGEASRNTGQTLLRWTRRGSPLRALLVISLGSVAFLALTGLLTFMLIFLVATVNAIIVSLLISLAAAGGFLFFSLACVTAIYIGAMSIAALVFSIATISAIFAAMIAAGWVGFFWVIWLGTRKSVGFAKQSLSKTGSVISAYSFAQHARID

SEQ ID NO: 31243 - protein, 647 aa, Gibberella zeae PH-1
MSASDSVPATPEDWKDLSTPGSPGSEDSSEPTTPLESPSHDSPSEPPRRVPSLRSVSDPRNMNPNSTPIGVLGIARRPVQPSFSFAGNSSASVENSAMAKARALHQQRLQKGNSASPVGQSPTSSISNGFPVNLRMPPNMQRPQPPHANSAPVVSKPSLSERRAKMGMGMKLSDMGGSSPAATTGKRGPPGKLSDITGDAPSNKESNGTGGGHGSKMDDFKKYIDTEKGWVTFDGAATITRTGVNFANGQTFSISLDEVEVLTELGKGNYGTVYKVKHAKRSLPRFGQGLSRKPPAVQYTQSDPSPVRPVEDSAGGQSNSGDGTTGTVMAMKEMRLELDDAKFTTILKELVILHECVSPYIIEFYGAFFQEGAVYMCIEYMDGGSIDKLYAGGIPENVLRKITYSTVMGLKSLKDEHSIIHRDVKPTNILVNTRGQVKICDFGVSGNLVASIARTNIGCQSYMAPERISGGGYAQAGNSDGSYSVQSDVWSLGLTVIECAKGAYPYPPEVSSTIFSQLSAIVEGEPPAMPEEGYSDTATDFVRSCLHKIPKQRPTYAMLLKHPWLIDFTKPQTITEEAEDGDEADKVAEAVGKIALNSTTEDAEVADWVNGVLQKERDGLKVGGPLRPALHTAPLDSVSPISSPNDA

SEQ ID NO: 31244 - protein, 521 aa, Oryza sativa Japonica Group
MAAKRPAAGEGGGKAAAGAAAAKKRVALVNITNVAAAANNAVNRLNSLEGLLAPSKVQNKSFLGIREKFNSATWAAPVKKGSLASGRNVCTNRVSAVKSASAKPAPAISRHESAPQKESVIPPKVLSIVPTAAPAPVTVPCSSFVSPMHSGDSVSVDETMSMCDSMKSPDFEYIDNGDSSSVLGSLQRRANENLRISEDRDVEETKWNKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRCWNESNSNNSLIAYNRRFVRVAQVSDEDPALHLEFLANYVAELSLLEYNLLSYPPSLVAASAIFLAKFILQPTKHPWQNSTLAHYTQYKSSELSDCVKALHRLFSVGPGSNLPAIREKYTQHKYKFVAKKHCPPSVPSEFFRDATC

SEQ ID NO: 31245 - protein, 299 aa, Idiomarina loihiensis L2TR
MSSKHPIIAVTGSSGAGTTTTGQAVRHIFRSLDVSAAFVEGDSFHRYSRPEMDLAIRKAQEQGRHISYFGAEANDFDRLESLFRSYSQTGNGKVRRYLHSFDDAVPYNQMPGTFTPWEELPESTDALFYEGLHGGVCGDGYDVTQYVDLLIGMVPIVNLEWIQKLIRDTSERGHSREAVTTSIIRGMEDYIHHIVPQFSRTHINFQRVPTVDTSNPFSAKDIPSLDESFVVIRFRGIKNVDFPYYLQMIDGSFMSRTSTLVVPGGKMALAMELILTPLIEQIMERKNQVRRQVDWISSK

SEQ ID NO: 31246 - protein, 271 aa, Haemophilus influenzae Rd KW20
MQHKLIAFIGGGNMAQAIILGLLKQGYPAEQIIVNDPNEEKRAFFANLDVATSENNVGSAIKAEVVLLAVKPQMMAEVCSPLSAVDFSDKLLISIAAGISTERLNALIPSVKSIVRVMPNTPALVGEGMAGLFAPKNTSENYRTFAQDLLGAVGRTVWVNDETQMHAVTAASGSSPAYFFLMLEAMQKALIKMNIDEKTARELVQQSMLGAAKMVTENPQIALSTLRENVTSKGGTTAAALAVFDAQHFNQTIEQAMQACLSRSQEMETLF

SEQ ID NO: 31247 - protein, 406 aa, Kluyveromyces lactis NRRL Y-1140
MDSSAPLLSSTGAGIRRSSSALVRCIEVSKVVFHSSPVNYLLVFVPLGLIFGYGQLSTTWVFVFNFMAIIPLAAILAFATEQLSEKAGSTLGGLLNATLGNAVELIVSIIALKEGQIRIVQASMLGSLLSNLLLVLGFCFLFGGYNRVQQKFNQTAAQTMSSLLAISSASLLIPAAFKATLPHDKGTSHLVDDKILSLSRSTSIVLLVVYVLFLIFQLGSHRVMFEEQTEETEEVLNIHQQHEQISESMSLRSSLIFLAITTILVSICADFLVGTIDDIVVSTGLSKTFIGLIVIPIVGNAAEHVTSVIVAMKDKMDLALSVAIGSSLQIALFVTPFMVLVGWAIDVPMTLNFSTFETVIMLVSVFLSNYLILDGESNWMEGSMSLAMYALVALAFFYYPDEQAVN

SEQ ID NO: 31248 - protein, 693 aa, Triticum aestivum
VTFRTRVYKKAGATGPEFPGYRRPTRPKVPVFPLNPAYPPVFPRPYSPRNQDRSFLEVQSPDWSMRLRSAPPATPRLLLVLAVLLYGFCCCCEGRFVVEKNSLKVTAPDSLKGSYECAIGNFGVPQYGGTMVGVVAYPKSNRKACKSFDDFDISYKAKPGSLPTFLLVDRGDCFFTKKAWNAQNAGVAAILVADDKDEPLITMDTPEESGRADYLENITIPSALITKSFGDRLRKAVDGGHMVNVNLDWRESLPHPDERVEYEFWTNSNDECGPKCDSQIDFIKSFKGPAQILEKKGYTQFTPHYITWYCPEAFTLSKQCKSQCINHGRYCAPDPEQDFSKGYDGKDVVVQNLRQVCVYKVAKENKKPWLWWDYVTDFAIRCPMKEKKYTKECADGVIKSLGLDHKAIDKCIGDPNADEENHVLKAEQDAQIGKGARGDVTILPTLVINNRQYRGKLDKGAVLKALCAGFQETTEPAVCLSEDIQTNECLENNGGCWHDKAANISACKDTFRGRVCECPVVKGVKFVGDGYTHCEASGSGRCEINNGGCWKETRNGRTHSACTDGGCKCPDGFKGDGVHKCEDVDECKERTACQCKECKCNNTWGSYECGCGGGFLYMKEHDTCISKDAGARVGWNFLWFLLFGLAAVGIAGYAVYKYRIRSYMDSEIRAIMAQYMPLDNQGEIPNHSHHIEM

SEQ ID NO: 31249 - protein, 567 aa, Coccidioides immitis RS
MGFSEKEISQEDSTSVQLPPFASKDEEVALEVEVAQDQPGFWTRMGCTPESFKKRTLADKHNQLNQTLKSRHLHMIAIGGSIGAGFFVGSGSALAKGGPASVVIDFAIIGVMIFNVVFALGELAVMYPVSGGFYIYSSRFIDPSWGFAMGWNYVLQWLIVLPLELTVASLTINFWKVDLSVAVWITVFLAAIIIVNIFGVLGFGEEEFWSSALKLSAVVIFMVIAVVLVCGGGPKDGIYSEYWGARLWYDPGAFRNGFRGFCSVFVTAAFAFFGTELVGLAAAESKNPLKSLPSAIKQVFWRIILFYILGLFFIGLLVRSDDDRLLGANPLIDTNASPFVIAAHDAGLVGFDSFMNVIILVSVFSIGNSAVFAGSRTLTAIAEQGYAPRIFSYVDRAGTLIAFGGLAYVNVTASGVEIFDWLLALSGLTALFTWGSICLAHIRFRAAWAHHGRTLDEIPFKAALGVWGSWVGLCLVCLVLIAQFYIAICPVSGGINDAKGFFKSYLALPVVLFCWACGYAWKRKGWLKLDEIDIDSGRREIDWEVYNQVLEKRKNSSFMKRLYYRLF

SEQ ID NO: 31250 - protein, 329 aa, Clostridium acetobutylicum ATCC 824
MGRIVTLGEIMLRLSPQGYNRFVQAKQFNAFYGGSEANVAVSLAVFGKDVSYTTKLPDNAIAQCAINELRKYGVNTKDIVRGGDRIGLYFCENGESQRPAKLVYDRKDSAIAKAKREDFNWDKIFDGADWFHFSGITPALSDECAKITLDAVKAAKAKGLTVSIDLNYRENLWDAAAFSKAIRELLQYCDVALGSIEEAELAIGEGDGDDCNTVLKKLVEKFQLKYATIILRNRFTAEDVDWTAVLYDGSKFYNAKKYDIHVVDNIGGGDAFAASLIYAITSNFSNQEIIEFATAGSCLKYSMNGDVNLSTVDEIIKLMNGDGSGKVSR

SEQ ID NO: 31251 - protein, 272 aa, Shewanella sp. MR-7
MSQQKICFIGAGNMTRSIISGLVRSGYPAALVQATNPSQGKLDALAADFGVRVSQDNVSAAQDADVIVLSVKPQLMEQVCQALQGIDMSNKLVITIAAGIKAERYSQYLAQPITLVRTMPNTPMQIGVGMTGLYAPQPLSDAQQAITERLMSSGGEIVWVNEESEINQVIALAGSSPAYFFLLMESMIDAGKQMGMDEAKARSLVQQAALGAAMMAKQNPELTLGNLRENVTSKGGTTAQAIATFEAADLRGVVKNAMENCIKRAEEMANTF

SEQ ID NO: 31252 - protein, 405 aa, Idiomarina loihiensis L2TR
MTDNKTVNREMFNDVMVPNYNPASMIPVKGEGARVWDQEGREYVDFAGGIAVNCLGHCHPAMVSALQEQSQKLWHLSNVFTNEPAIRLAKKLTEATFADRVYYANSGAEANEAALKLARRWAIEKHGEHKQQIIAFTKGFHGRTFFTVTVGGQPAYSDGFGPKPGAIEHVDYNNIDALKELISDKTCAVMMEPLQGEGGVVSPDVEFVKAVRELCNENDALLIFDEVQTGFGRTGSLYAYEQLGVTPDILTSAKALGGGFPIGAMLTTTEIAEHLKPGTHGSTYGGNPLACAVSEAVFDVVNTKETLDGVKQREQWFKEQLAAINEKYNVFSEIRGQGLLLGAAMNKEYEGRARDFLLAGQEHGVMVLIAGANVVRFTPSLVISEEDIKEGLQRFEKAVAQVVGQ

SEQ ID NO: 31253 - protein, 339 aa, Cryptococcus neoformans var. neoformans
MVVKVGINGFGRIGRIVLRNAIEHGDLEVVAVNDPFIDLDYMVYMFKYDSTHGRFKGSVEVKDGKLYINNKAIAVFGEKDPANIKWGEAGAEYVVESTGVFTTTEKAGVHLKGSAKKVVISAPSADAPMFVCGVNLDAYKPEYQIVSNASCTTNCLTPLAKVIHDNFTIIEGLMTTVHATTATQKTVDGPSHKDWRGGRGAAANIIPSSTGAAKAVGKVIPSLNGKLTGMSFRVPTSDVSVVDLVCRIEKGASYEEIKNVIKKASESPELKGILGYTEDAVVSTDFIGSTESSIFDAQAGIALNANFVKLVSWYDNEYGYSRRVCDLISYIAGVDAKAQ

SEQ ID NO: 31254 - protein, 458 aa, Sodalis glossinidius
MYRKELLLVCQPCEKNLDYLTRQARFESNVRSYPRKLPLAIARAQGCWVTDVEGKRYLDCLAGAGTLALGHNHEAVVGAIQQFLASGLPMHTLDLTTPLKDAFSERVLSLLPAEGQDYCLQFCGPSGADAVEAALKLAKTVTGRSNVISFSGGYHGMTHGALSVTGNIGPKEALHGLMSGVQFFPYPHQYRCPLGIGGQRGEQALSHYFSQFIEDVESGVARPAAVILEAIQGEGGVNPAPVEWLRQVRTVTEKHGILLIVDEVQCGFARTGDMFAYQYAGIEPDIVVMSKAVGGGLPMALLGIKRGFDAWQPGAHTGTFRGNQMAMATGMATLNMLVGENIAAQAAQRGAWLQQQLNALRQRYPALGQVRGRGLMLGIEIVDERQPADALGSYPMDAPLAVAIQQHCFQQGLLLERGGRHGNVVRLLPPLTINEQECQSVIDRFTLALNGALVTSRC

SEQ ID NO: 31255 - protein, 309 aa, Aeropyrum pernix K1
MEGPEQWVIVGGWGSASAEFSEGLSRNMGLKLVKPVFKLFPDEEEYVRIEGDISGFTGAIVVQSFERPASRSLVYSLLIADALKEAGVGRIVLMAPYMGYTRQDRVFLPGEPVSVRAVMRALASSGYNALASIEVHKEYVLDYFDGSTLNIFPFTYMLKETGISCGDNTIIVAPDKGSLPRVERLARETGCRSYGYLVKERDRITGEVRLAKSTVDPRGKNAIVVDDIISTGGTIALASQWLLENGANSVFVLAAHYLGIGNAEEKMMKAGVSRVVTGNTLPRKPSKIVTYVDLTGLAAGQLTKLVSNL

SEQ ID NO: 31256 - protein, 297 aa, Elaeis guineensis
MAVPVINLRELDGDRRTETKSLLHEACEKWGFFWVENHGIKEALMEKVKGLVNSHYEEYLKQSFYESELAMGLGPQTQSSEADWESTYFIQHQPESNNIHDIPGHEIEFCEAMEDYIRQLIKLAETLAELMSENLGLDKCYLKEAFSPAFVGTKVAKYPQCPQPKLLMGLRARTDGGGIILLLQDDMVPGLEFFKHGKWVPITPKKDNRIFVNLGDQVEVMSNGLYKSILHRVAADKDGSRLSIATFYNPGADAIISPAPKLLYPGGYRFKDYLDYYTGTKFSDKGARFQTIKDMFK

SEQ ID NO: 31257 - protein, 305 aa, Acidovorax sp. JS42
MRVDNILHTIGNTPHVRINRLFGAGANVWVKSERANPGGSIKDRIALAMVEAAERSGALQPGGTIIEPTSGNTGIGLALVAAVKGYQLVLVMPDSMSIERRRLMLAYGARFDLTPKEKGMKGAIARAQELVAATPGSWMPQQFENPANVEVHMRTTAQEIAADFPDGLDALVTGVGTGGHITGVARVLKAQFPQLKVFAVEPSQSPVLSGGQPGPHPIQGLGAGFVPQIMDTSLLDGVIQVEAEPAREYARRAAREEGLLVGISSGATLAAIAQKLPELPAGARVLGFNYDTGERYLSVEGFLPA

SEQ ID NO: 31258 - protein, 261 aa, Bacteroides fragilis YCH46
MKEKMKEKLTVIKVGGKIVEEEATLNQLLNDFAAIEGHKVLVHGGGRSATKIAAQLGIDSKMVNGRRITDAETLKVVTMVYGGLVNKNIVAGLQARGVNALGLTGADMNVIRSMKRPVKEVDYGFVGDVERVDSTLLSDLIHKGVVPVMAPLTHDGQGNMLNTNADTIAGETAKALSAIFDVTLVYCFEKKGVLRDENDDESVIPQINHAEFQRYIAEGVIQGGMIPKLENSFEAINAGVSEVVITLASAIHTDGGTRIKK

SEQ ID NO: 31259 - protein, 107 aa, Brassica napus
RQLISAVFLKQHLTGLVFDSGFSGEEIAVANTVVEAETEEKMTILEDDDEEDEDKTEEVPVKKKKSKKEKRSIDKVSEKGEKIDQVRSKKIRDHKKKTKKVKLTQED

SEQ ID NO: 31260 - protein, 447 aa, Oceanobacter sp. RED65
MYQYDLFVIGAGSAGVRASRMAANLGKKVAVAESNYYGGTCVNVGCVPKKLFVYASEYPHFVEEAKGFGVNLELKGFDWATLRDNKTKEIERLNGIYEKLLDNAGVERIWGHAKLIDAHTVEVAGQQFSAEKILLATGGWPILPDIPGKEHCIDSNAFFYLENFPKSAVVFGSGYIAVEFAGIISNLGCDTSIASRSGKLLRGFDETTRQHAETEILKGPIKLLPHQPSAIEKVGEQYRVTLQGGEELIVDAVISAIGRTPNTSNLGIDDLQIETDEKGCIAVDDHFKTSVDSIYALGDLIDTPQLTPVALAEAMCFLRQQYQNDPTPMDYSSIPTAVFSQPNLATVGLSEEEAIDQGFVVSIFESEFRALKHTLSGLNHRSYMKLVVDKETDRVLGAHMVGEHAGEILQGFAVAVKAGLTKAQFDSTIGIHPTSAEEFVTMRTASR

SEQ ID NO: 31261 - protein, 361 aa, Vibrio vulnificus CMCP6
MKHAHETRSFLLGLLTVATFLFKGNDLLSHDLMSPLGILSVLILFAVTMVMIFAVVRHADALAHKLGEPYGTLILTLSVVLLEVAMISSVMLTGSENPVMARDTMFAVVMGVMNGLVGITLLIGGLRYHSQAYNVQGLKAYIAAIIPVVTICLILPNFTSQDSFGGMSTVMIFTLIVTSLLLYGVFLFIQTKSHTDYFINDVSETEHEHHETRSIGYHALFLVANLALVIGLAKSIAIPIDQSINTLGAPSALGGLIVAMIILSPEGVGAIKAALNNQLQRAMNLFYGSVLATISLTVPAVLLIAVFLGETVILGLGPADMVLLVATILVSMMTFSSGRTHPLNGATHLVLFIAYVVLMFD

SEQ ID NO: 31262 - protein, 506 aa, Oryza sativa Indica Group
MEREAWLLCAALAAAMVYYYYYYYLACTTRRAQRRLPPGPTPLPVIGNVLSLSGDMHHELARLAREQYGPVMTLKLGLFTAVVVSSPDAAREAFTKHDRRLAARTVPDISRARGLTGRSMIWLPSSDPRWKTLRSAVATHFFSPRSLAAARGVRERKVRDIVNYFAGHAAEVIDVGEAVYGGVINIVSNAFFSADVVDVGKESAHGLRETLEDIILAIAKPNVSDLFPFLRRLDLQGWRRWAEKRYDKVFGILDDKINSRLADADADASTKKHGDFLDSLLELMSAGKIACDDVTTVMFDAFGAGTDTISNTVVWAMAELLRNPSIMAKVRAEMEDVLAGKKTIEENDTEKLPYLRAVIKEAMRLHPVAPILLPHRAAEDGVEIGGYAVPKGSTVIFNVWTIMRDPAAWERPEEFMPERFLQRAEVDFRGKDFEFIPFGAGRRLCPGLPMTERVVPFILASLLHAFEWRLPVGVAAETLDLSEKFTTVNVLVTPLKAIPILASHQI

SEQ ID NO: 31263 - protein, 298 aa, Chromobacterium violaceum ATCC 12472
MANESFIGWMTSIQQYMEQALEKLLPSADCAPQRLHEAMRYATLEGGKRVRPLLVFAAGELVGAQADNLARIGAALEMVHAYSLVHDDMPCMDNDVLRRGKPTCHIAYDDATALLVGDALQTRAFELISQPMPDIAPASQLEMVRALAHAAGHAGMAGGQAIDLASVGLPLTLPELEFMHMLKTGALIRAAVLAGSMAGRELSAAEKEALDAFAKRIGLAFQVVDDILDCEADTATLGKTAGKDAANDKPTYVSLLGLAEAKRMAKDLHDQAFAALEGFGPQADRLKQLADYIVARSF

SEQ ID NO: 31264 - protein, 616 aa, Chromobacterium violaceum ATCC 12472
MYPLLENINSPADLRLLPRTQLPQLAGELREFLVESVSKTGGHFASNLGSIELTIALHYVFDTPHDRLVWDVGHQTYPHKILTGRRERMHTMRQHNGLAGFPKREESEYDTFGVGHSSTSIGAALGMAVAAKTLGVDRKSVAIIGDGAMTAGQAFEALNNAGAMDTDLLVILNDNDMSISPNVGALNNYLAKLMSGRFYAAMREGSSKVLGIAPPLKEIASKVEEHVKGFFTPGTLFEEFGFNYIGPIDGHDVDVLVDTLKNIRSLKGPQFLHIVTKKGQGYKLAENDPVKYHGVTKFDPANGLASGKGGAGKPQYTQVFGDWLCDMAKLDKRLVGITPAMREGSGMVRFEKEHPDRYYDVAIAEQHAVTFAGGMACDGLKPVVAIYSTFLQRGYDQLIHDVALQNLPVMFALDRAGLVGADGPTHAGAFDLSYLRCIPNMTVMAPSDENECRQLLYTAFQLDTPTAVRYPRGTGPGAEIQQQMAALPIGKGVVRRRGKQVAILAFGSMVHPALAAAEALDATVADMRFVKPLDAELIRKLAQTHELIVTVEENVVMGGAGSGCGEALQAMGLAVPTLHLGLPDDYVEHGDPALLLSLCGLDAAGIEKSIRERLAG

SEQ ID NO: 31265 - protein, 541 aa, Bacillus cereus G9241
MITVSNVSLRFADRKLFEDVNIKFTPGNCYGLIGANGAGKSTFLKILSGEIEPSTGDIHITPGERLAVLKQNHFEYEEFPVLETVIMGHTQLYKVMQEKNAIYMKEDFSDEDGMRAAELEGEFAELNGWEAESEAAILLKGLGIGEDLHDKKLSELTGAEKVKVLLAQALFGKPDILLLDEPTNHLDLKAIQWLENFLMNFENTVIVVSHDRHFLNKVCTHMADLDFGKIQLYVGNYDFWYESSQLALKLTQDANKKKEEKVKELQNFIARFSSNASKAKQATSRKKLLDKITLDDIRPSSRRYPFVGFTPEREVGNDLLTVEGLSKTIDGEKVLDNVYFTLNKGDKVAFIGRNDIAMTTLFKILMGEMEPDSGSFKWGVTTSQSYFPRDNSKYFENSDLNLVEWLRQFSPQDESESFLRGFLGRMLFSGEEVKKNVSVLSGGEKVRCMLSKMMLSGANVITLDDPTNHLDLESITALNNGLIAFKGTMLFTSHDHQFVQTIANRIIEVTPNGVIDKEATYDEFLENEELQKQVDAMYKGQ

SEQ ID NO: 31266 - protein, 186 aa, Yarrowia lipolytica CLIB122
MESGDLPNAATPRDVRLLHLILASMGVTSYQERVPLQLMDFAYRYTQGVLHDALLYSDHAAAANNSHNDKTGPVSGGSGGNANAAAAAVSTSALSVEDVRLAIAARVNYQFKPAPPKELLLEMAQERNRRALPQVQPGYGLRLPPEKYCLTAKEWDLDEEEEETVEGAEETNNNSSNEDKEMKDAV

SEQ ID NO: 31267 - protein, 622 aa, Chlamydomonas reinhardtii
MTAQAEARTLETLNFDNLSLRALPVDPVEGGPVRQVEGACFSRVKPTPVKGPQLVVASPEALALLDIPASEVGEGGKKAALYFSGNKLLPGADPAAHCYCGHQFGYFSGQLGDGATMYLGEVVNGRGERWELQFKGAGKTPYSRQADGRKVLRSSLREFLCSEAMYNLGIPTTRAGTCVTSDSKVVRDIKYDGNAILERATTITRIAPTFLRFGSFEIFKPTDNFTGRRGPSAGHEAAILPVMLHHAIRTYYPAIWAAHDGDRIAAGVGAMYLDWIKEVTRRTASLVAAWQCVGWCHGVLNTDNMSIVGVTIDYGPFGFLDRYDPDFICNGSDDSGRYDYKSQPDICRWNCERLAEAVRAVLPEGRGKRAVAEVFDAVYRKCVWRGALVCTLGAGRAAVEDEGLAAALLSVMEATGADFTNTFRCLSRFPTPAPGIDPASTAAVEAGGCCDAGTLVAAAAPRVPPQNLQMLVMLSQKNPELLHQMGVSQQMLTTEMARLRHSQELAKVTDADKRAADAAKWRSWLAQYGAVLQRRAAAGADDSRRVAVMNATNPRFILRNWIAQQAIQRAEQGDFSEVARVFALLRNPFSEAPGPAAASGVSCALPVYDGLPPTWAAELCVT

SEQ ID NO: 31268 - protein, 159 aa, Arabidopsis thaliana
MSGNKEEEDPRIHGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHIGAVEAGDRALVVDDLIATGGTLCAAINLLGKIPNLYENPIEF

SEQ ID NO: 31269 - protein, 238 aa, Shewanella sp. MR-7
MTTIADRLAVAQCRIAQAAQKCARLPHSIRLLAVSKTKPIEDIIAAYDAGQRCFGENYVQEGVTKIETLKSTHPDIEWHFIGPLQSNKTALVAQHFDWMHTLSREKIAQRLNEQRPAQLAPLNVCIQINISDEDTKSGIDAEQMLPLAHSISQLPHLQLRGLMAIPSATNDTAQQSRELSELKQLFDTLKQHYPAVDTLSMGMSNDLDVAIECGSTMVRIGSAIFGERDYGAKETTRN

SEQ ID NO: 31270 - protein, 830 aa, Kluyveromyces lactis NRRL Y-1140
MPEEHKKLLDSSGTAADADDATATAILRRKKKQNMLLVDDAVNDDNSIIAINSNTMDLLQLFRGDTVLVKGKKRKDTVLIVMIDDELEDGVCRVNRVIRNNLRIRLGDLVTIHPCTDIKYASRISVLPIADTIEGLTGNLFDVYLKPYFVEAYRPVRKGDHFIVRGGMRQVEFKVVDVEPEEYGVVAQDTVIHSEGEPINREDEENNINEVGYDDIGGCRKQMAQIRELVELPLRHPQLFKAIGIKPPKGILMYGPPGTGKTLMARAVANETGAFFFLINGPEVMSKMAGESESNLRKAFEEAEKNAPAIIFIDEIDSIAPKRDKTNGEVERRVVSQLLTLMDGMKARSNIVVIAATNRPNSIDPALRRFGRFDREVDIGVPDVTGRLEVLRIHTKNMKLADDVDLEKLAAETHGYVGADIASLCSEAAMQQIREKMDLIDLDEDEIDAEVLDSLGVTMDNFRFALGNSNPSALRETVVESVNVTWDDIGGLDEIKDELKETVEYPVLHPDQYTKFGLSPSKGVLFYGPPGTGKTLLAKAVATEVSANFISVKGPELLSMWYGESESNIRDIFDKARAAAPTVVFLDELDSIAKARGGSLGDAGGASDRVVNQLLTEMDGMNAKKNVFVIGATNRPDQIDPAILRPGRLDQLIYVPLPDETGRLSILSAQLRNTPLEPGLDLKTIAQATQGFSGADLLYIVQRAAKFAIKDSIEAQKRAEVVKKEEGAEETEKVKTEEDVEMSDVQQEDPVPFITKEHFTEAMKTAKRSVTDTELRRYEAYAQQMKASRGQFGNFSFGDDSGAAATQAGAEGSGAAFGDAAGEDDDDLYS

SEQ ID NO: 31271 - protein, 363 aa, Musa acuminata AAA Group
MGFTENQLCFDLIESWLENHPDPAAFKKDGALLFRELALFQDYHGLPAFKRALTKYMGEVRGNKVAFDPNRLVLTAGATSANETLMFCLAEPGEAFLLPTPYYPGFDRDLKWRTGAEIVPIHCSSSNGFRITKPALEAAYQDAQKRSLRVKGVLVTNPSNPLGTTLTRHELDILVDFVVSKDIHLISDEIYSGTNFDSPGFISIAEATKDRNNVSHRIHIVCSLSKDLGLPGFRVGAIYSENEAVVSAATKMSSFGMVSSQTQYLLAALLSDKEFTDKYLLENQKRLKERHDMLVEGLRRIGIGCLKGSAALFCWVDVRHLLKSNTFKGAMELWKKIVYQVGLNISPGSSCHCDEPGWFSVTF

SEQ ID NO: 31272 - protein, 363 aa, Musa acuminata AAA Group
MGFAENHVSFDLIESWLEDHPDLTGFKKDGGLVFRELALFQDYHGLPAFKNALARYMGEVRGNKVSFEPSKLVLTAGATSANETLMFCLADPGEAFLLPTPYYPGFDRDLKWRTGVEIVPIHCSSSNGFRITRAALEAALRRAQKRRLRVKGVLVTNPSNPLGTTLTRQELDTLVDFAVANDIHLISDEIYSGTTFGSPGFVSIAEATKGRDDVSHRIHIVCSLSKDLGLPGFRVSAIYSDNEAVVSAATKMSSFGLISSQTQYLLAALLSDKEFTEKYVRESQKRLKERHDMLVEGLRRIGIGCLEGNAGLFCWVDMRHLLRSNTFEGEMELWKKIVYRVGLNVSPGSSCHCDEPGWFRVSF

SEQ ID NO: 31273 - protein, 306 aa, Glycine max
  misc_feature (150)..(150): Xaa can be any naturally occurring amino acid
  misc_feature (179)..(179): Xaa can be any naturally occurring amino acid
AFYRFTQQNLPACKPVLTPAAVIATFLLMGFIFIPVGLVTLRASNSVVEIVDRYDIDCVPEDFRSNKVAYIKDDSIAKNCSRLLKVLKPMKAPIYIYYQLDNYYQNHRRYVKSRSDLQLLHGLGYNDTSSCKPLESSHNLPIVPCGLLAXSLFNDTYTFSRGPSELKVNRKNFAWKSDXRDHKFGNHVYPFNFQNGTLIGGGKLDPSIPLGDQEDLIVWMRTAALPTFRKLYGRIEEDLDADDVIVVHLENNYNTYSFGGKKKLVLSTSSWLGGKNDFLGVANLFVGAFCILISIIFLLLHVKNPR

SEQ ID NO: 31274 - protein, 193 aa, Idiomarina loihiensis L2TR
MIVLIDNFDSFTHNLARYFRELGEDVSVFRNNELTLTDIEQLAPQALVISPGPCTPNESGISLAAIEHFQTKLPILGVCLGHQALAQVFGANVVRAEKVMHGKTSVIKHSGEGLFRQLNNPLEVTRYHSLVVSPESLSTDFVIDADTGTEKGQREIMAIRHRHLPLFGVQFHPESVMTAQGHNLLANFLRYIR

SEQ ID NO: 31275 - protein, 950 aa, Arabidopsis thaliana
MAGAASALFLLDIKGRVLVWRDYRGDVSAAQAERFFTKLIEKEGDSQSNDPVAYDNGVTYMFVQHSNVYLMIASRQNCNAASLLFFLHRVVDVFKHYFEELEEESLRDNFVVVYELLDEMMDFGYPQYTEARILSEFIKTDAYRMEVTQRPPMAVTNAVSWRSEGIQYKKNEVFLDVIENVNILVNSNGQIVRSDVVGALKMRTYLTGMPECKLGLNDRVLLEAQGRATKGKAIDLEDIKFHQCVRLARFENDRTISFIPPDGAFDLMTYRLSTQVKPLIWVEAQIESHSRSRVEMLIKARSQFKERSTATNVEIELPVPTDASNPTVRTSLGSASYAPEKDALVWKIKSFPGNKEYMLRAEFHLPSITAEEATPERKAPIRVKFEIPYFTVSGIQVRYLKIIEKSGYQALPWVRYITMAAHNHHTFSSNSVSSLGSDSELGFYSKNLLVVVVYCSDEKMAMRHLSRSRDVTKRSTKKYIEEPLYNRLFKDGGTEVKVRQQLNQFLKGTKHVFKWEVGDTIKKLRNRGLYYPALKLSEVMEERGMNKTVSDQAIHLDLVAKAREITAGENYFVDLPETSKTELTYGSLLNCYCKELLTEKAEGLLNKMKELNITPSSMSYNSLMTLYTKTGETEKVPAMIQELKAENVMPDSYTYNVWMRALAATNDISGVERVIEEMNRDGRVAPDWTTYSNMASIYVDAGLSQKAEKALQELEMKNTQRDFTAYQFLITLYGRLGKLTEVYRIWRSLRLAIPKTSNVAYLNMIQVLVKLNDLPGAETLFKEWQANCSTYDIRIVNVLIGAYAQEGLIQKANELKEKAPRRGGKLNAKTWEIFMDYYVKSGDMARALECMSKAVSIGKGDGGKWLPSPETVRALMSYFEQKKDVNGAENLLEILKNGTDNIGAEIFEPLIRTYAAAGKSHPAMRRRLKMENVEVNEATKKLLDEVSQDV

SEQ ID NO: 31276 - protein, 754 aa, Mycoplasma mobile 163K
MKIQTIGNHNFNNRVVFVRVDYNIPFKNDKFLFEQKILDSLPTINKLVKDGAKIVLLTHHNLSEEKMSSINFLKESLEKVLNLKIKFSVETSGEVLENLINDLKNGEILLVDNVLKEDAKNNAESNNNLDLSKYWASLADDFVNDAFDISFKKTASNYGIATFKESKFIGESVKKELLILKRLIDTNPKTRPSLAILSGDSILEKARELNFLLKKFDRIILGGKLAYIFNSVNKNKIDHKEISIKEVEVTKKFLVARKNQLIIPEKYNIFLSLSKEKIYDVHEDSVKKFEEIIFKAKKVLWFEALGNTKYSSAKKGTQKLIEILSKTSEETFIGIYGYNIFKLVNEDLRKRFNHVSPNKLAVSTYLQGKILPAIEILSKTPSELMNENILKNTISLASTLQNTDAKNFQEETILKVKNLKVSFKTGRKKVINIIRGVDVSVKRGQIIGFVGESGSGKSVTSKALININFGAIVDADVMKLENIDLLSLKEDSQWNNIRGKYIGYIPQDPLTSLNPTRTIGKQLLDCIERDSRFKSKEEKIKFSIDLLESFGIRNAKEKFNSYPHTLSGGQKQRVVIAMVVARQPKIIIADEPTTALDPTVQASVLVLFEKIRQEFGISIIFISHNISVVAKFCDYIYVMYAGKIVERGTKKEIFEDPRHPYTWALISSIPENKEEKLYNIQGLPPDMANLPAGDPFASRNEHALEIDFEKEPPLFWINKTHAAATWLLHPDAPKVPMNRKIQERIKLFKKVFNE

SEQ ID NO: 31277 - protein, 878 aa, Arabidopsis thaliana
MKNLCWVFLSLFWFGVFLIIRFAEGQNQEGFISLDCGLPLNEPPYIESETGIQFSSDENFIQSGKTGRIPKNLESENLKQYATLRYFPDGIRNCYDLRVEEGRNYLIRATFFYGNFDGLNVSPEFDMHIGPNKWTTIDLQIVPDGTVKEIIHIPRSNSLQICLVKTGATIPMISALELRPLANDTYIAKSGSLKYYFRMYLSNATVLLRYPKDVYDRSWVPYIQPEWNQISTTSNVSNKNHYDPPQVALKMAATPTNLDAALTMVWRLENPDDQIYLYMHFSEIQVLKANDTREFDIILNGETINTRGVTPKYLEIMTWLTTNPRQCNGGICRMQLTKTQKSTLPPLLNAFEVYSVLQLPQSQTNEIEVVAIKNIRTTYGLSRISWQGDPCVPKQFLWDGLNCNITDISAPPRIISLNLSSSGLSGTIVSNFQNLAHLESLDLSNNSLSGIVPEFLATMKSLLVINLSGNKLSGAIPQALRDREREGLKLNVLGNKELCLSSTCIDKPKKKVAVKVVAPVASIAAIVVVILLFVFKKKMSSRNKPEPWIKTKKKRFTYSEVMEMTKNLQRPLGEGGFGVVYHGDLNGSEQVAVKLLSQTSAQGYKEFKAEVELLLRVHHINLVNLVGYCDEQDHFALIYEYMSNGDLHQHLSGKHGGSVLNWGTRLQIAIEAALGLEYLHTGCKPAMVHRDVKSTNILLDEEFKAKIADFGLSRSFQVGGDQSQVSTVVAGTLGYLDPEYYLTSELSEKSDVYSFGILLLEIITNQRVIDQTRENPNIAEWVTFVIKKGDTSQIVDPKLHGNYDTHSVWRALEVAMSCANPSSVKRPNMSQVIINLKECLASENTRISRNNQNMDSGHSSDQLNVTVTFDTDVKPKAR

SEQ ID NO: 31278 - protein, 136 aa, Physcomitrella patens subsp. patens
MSQIWSIFGVKDSLVAKPAAAKVEQGFQNRLERQLAAWGWYSSWIDEILILEVTVPKEALCKFDSRFELGIPPDAVYNILTDLSNKRVIKKNIEEVKYRKVLQDDGHHGLWDLSNLRVARFCGFLALECLCFGGSG

SEQ ID NO: 31279 - protein, 224 aa, Idiomarina loihiensis L2TR
MKPLIAPSILSADFARLGEEVDAVLNAGADVVHFDVMDNHYVPNLTIGPMVCKALRDYGIEAPIDVHLMVKPVDRIIPDFAEAGASIITFHPEASDHVDRTLQLIHEQGCQAGLVLNPATPLHYLDHVMDKVDVILLMSVNPGFGGQSFIPSTLDKLRAVRKRIKASGRDIRLEVDGGVKVSNIGEIAEAGADMFVAGSAIFNADDYASVIRTMRDEIAAVTGS

SEQ ID NO: 31280 - protein, 98 aa, Anabaena sp.
ATFKVTLINEAEGTKHEIEVPDDEYILDAAEEQGYDLPFSCRAGACSTSAGKLVSGTVDQSDQSFLDDDQIEAGYVLTCVAYPTSDVVIQTHKEEDLY

SEQ ID NO: 31281 - protein, 344 aa, Salinibacter ruber DSM 13855
MSTSITLFGAGSWGTALAVHLAAAGRDVTLWARRDEAVERMRTTHRNPTYLSDIEIPPSVHVTSDLEAAAGASSLWAVAVPSQNLRSVATRIAPLTRPGTTVVSLAKGIENETLQTMSQVLADELGGMEAQQIGVLYGPSHAEEVAENQPTTLVAAAPTEPRAEWVQDAFMTERLRVYVNTDVVGVEIGGSAKNVLAIAAGIGDGVGYGDNAKAALVTRGLAEIRRLGIAMGAKPRTFAGLAGIGDLLVTCMSPHSRNRYLGEQIGNGMTLEEIESEMDMVAEGVRTTQSVQDLARHHDIEMPVTEAVHRVLFENRRPEDMVDELMTRSAKREHWLPQGLRNVS

SEQ ID NO: 31282 - protein, 528 aa, Issatchenkia orientalis
MSVIKAIAADVQRYALLAYSHFQTFSLLQQTLLVISIPFLYSALWQLLYSFRKDRVPMVHYWIPWVGSAVVYGMQPYEFFENCRKQHGDVFSFLLLGKVMTVYLGPKGHEFVLNAKLSDVSAEDAYTHLTTPVFGKGVIYDCPNWKLMEQKKFAKVALTKESFIRYVPLIKDEMLKYFNANFRGDSGKTDVLKSQSEMTLFTASRSLFGDALRNRLDASYAEMYSDLDKGFTPLNFVFSYLPLPNYWKRDAAHKNISNTYLDLINTKRAGGEIKNEDLVDALLKNSVYKDGTRMTDEELAHLMIGVLMGGQHTSSATSAWFLLHLGEKPQLQEEIYREIQSVLGENFERELTYDDLQKLDLVNATIKETLRLHMPLHSIFRKVTRDLPVPNTSYIVPKGHYVLISPGYTMLSERYFPNASEFQPHRWDEIKSIDGGISLPAEGENAKETVDYGFGKISKGVASPYLPFGGGRHRCIGEPFAYTQLGTLLVHYIQNFKWTAKVPPIDYTSMVTLPTQPAEIKWERRQKN

SEQ ID NO: 31283 - protein, 191 aa, Oryza sativa
MLTAAMHMLDSSTSSSPWLPPDLMPPPPPPPPAAATLHHHFRAAAAAPGRRRIAKRRPRPSRRLPTTYISADPANFRRMVHQVTGADDLPPPPPSLSLQQTTELLLPAVHAAPAGSPGAAGALMLPTLDTSAFLLGRRAEPAAAAPPCDESVALVRGGAGNYGSNNNSISSSSSSGNCGGGFPTLDSWDLL

SEQ ID NO: 31284 - protein, 410 aa, Issatchenkia orientalis
MTHTDNTLPIPNILTLHSLLSGHPPLRPSLRALDEPRNLEINIVSSSESASQRSVEVKLGETYVSCKVSAQITQPYEDRPFEGTFAISTEITAMCSPAFSNSNNTDFSTAAPAIVPATSVNVPSNGESNNNNNSNNGSGSGNQENQLSMGGGAVMGLAADQGATEILLGRLIEKGVRRSNALDLESLCIIAGQKCWAVRADVRFLNYDGNLVDAASIAVITALLHFRKPDVELVGSGEGTELIIYDEKQREMVPLSILHIPICVTFQFFSTESVERNIKGESLDSRSRSRQVKSNNGDEGDDDLMDVDYEANDGPRASNEVVIVDATSEEELLSQGSMTVTLNSNKELCQISKSGGLNVDSKKVLECCQIASKIVDKWTKQIKQVLADDEKKRRNPLIEKTLSTVNDRSS

SEQ ID NO: 31285 - protein, 98 aa, Anabaena sp.
ATFKVTLINEAEGTKHEIEVPDDEYILDAAEEQGYDLPFSCRAGACSTCAGKLVSGTVDQSKQSFLDDDQIEAGYVLTCVAYPTSDVVIQTHKEEDLY

SEQ ID NO: 31286 - protein, 511 aa, Mycoplasma mobile 163K
MKKTLDQISLKNKKVIIRVDFNVPIVNGIVTSNKRIEAVIPTIKKVVNEGGKAILMSHLGRVKSEEDLKKKSLAPVVEILVNLLGMPITFVPATNGTELEETINSMKSGEIVMMENTRFEDLNNDAESSNNPDLGMYWASLGDVFINDAFGTVHRKHASNVGISTYIAESGIGYLVEKEIKNLDKALSRPERPIVAILGGAKVSDKIGVLNNLLKYVDKIIIGGAMAYTFLAAQGIGIGKSLVEEDKIDLAREYLKNNLDKFVLPIDYALAKDFEDVKPFYNLENTLEIPNGYMGLDIGPKSIEVFKKYIKDAKTILWNGPLGVTEFKYFKEGTKAIAKAITELKGNVYTVVGGGDSVAIIEELGLDRRFSHVSTGGGATLEFLEGKELPGIQAIQNEGELGRTKEEIFSILTQNSEEVLHEHTAAFSTSEVEPANEEFPSEYNDSNSQTYFSNEVENDEDFLLNTNDFPTREASFPNEVKTEEIILNENDDEFDIEDEELDSLPNDDIKF

SEQ ID NO: 31287 - protein, 442 aa, Oryza sativa Indica Group
MTLKLGLVTAVVVSSPGAAREAFTRHDRRLAARTVPDISRARGLAGRSMIWLPSSDPRWKTLRGVVAAHVFSPRSLAAARGVRERKVRDIVGYFAVHPGEAVDVGEAVYGGVINLVSNAFFSADVVNVGKESAHGLRKTVEDMISAIAKPNVSDLFPFLRPLDLQGWRRWAEKRIDEIYGILDNKINSRLADTDADADASTKKHGDFLDSLLELMSAGKIARDDVTNIMFEVFGAGTDTISITVEWAMAELLRNPSIMAKVRAEMDDVLAGKKTIEENDTEKLPYLRAVIKEAMRLHPVAPILLPHHTAEDGVEISGYAVPKGSTVIFNVWAIMRDPTAWERPDEFMPERFLQRAEVDFRGKDFEFMPFGAGRRLCPGLPMAERVVPFILASLLHAFEWRLPDGMSAEELDVSEKFTTANVLTVPLKAVPILASSASELQAS

SEQ ID NO: 31288 - protein, 450 aa, Idiomarina loihiensis L2TR
MSRHYDYLAIGAGSGGIASANRAAIRGAKAAVIEAKHVGGTCVNVGCVPKKVMWYGAHIAEAIKYSPSYGFELEQKGFDWATMVKNREAYIERIHGGYHRGFQGNGVEFIEGFAKFVDHKTVEVNGEKITADHITIATGGRPMIPEIPGAEHGIDSDGFFALTEQPKKAAVIGAGYIAVEIAGVFHALGTDTHLMVRRDRPLRTFDKDITDGLLERMKQDGPELHTETTVREVVKQDDGTLTLHFEGGQTMDGFDCLVWAIGRVPSTDKINLECTGVELDSEGFINVDKFQNTNVQGIYAVGDNTGAAALTPVAIKAGRLLAERLFNNMPNAHMDFENIPTVVFSHPTIGTVGLSEEDAKLKFGEDNITVYKSSFAAMYNAITPHRALSYFKLVCHGKEEKVVGIHGIGEGMDEILQGFAVALKMGATKADLDSTVALHPTSAEEFVTLK

SEQ ID NO: 31289 - protein, 270 aa, Mycobacterium bovis AF2122/97
MHLDSLVAPLVEQASAILDAATALFLVGHRADSAVRKKGNDFATEVDLAIERQVVAALVAATGIEVHGEEFGGPAVDSRWVWVLDPIDGTINHAAGSPLAAILLGLLHDGVPVAGLTWMPFTDQRYTAVAGGPLIKNGVPQPPLADAELANVLVGVGTFSADSRGQFPGRYRLAVLEKLSRVSSRLRMHGSTGIDLVFVADGILGGAISFGGHVWDHAAGVALVRAAGGVVTDLAGQPWTPASRSALAGPLRVHAQILEILGSIGEPEDY

SEQ ID NO: 31290 - protein, 353 aa, Streptomyces coelicolor
MPLLTRITGPRDLDRLSLEELTQLAEEIRTFLVDAVSKTGGHLGPNLGVVELTLALHRVFESPKDKVLWDTGHQSYVHKLLTGRQDFSKLKMKGGLSGYPSQGESEHDVIENSHASTVLGWADGIAKANQVMERDDHVVAVIGDGALTGGMAWEALNNIAAAKDRPLVIVVNDNERSYAPTIGGLANHLATLRTTDGYERFLARTKEVLERTPVVGRPLYDTLHGAKKGLKDFIAPQGMFEDLGLKYVGPIDGHDLEALESALTRAKRFGGPVIVHCLTEKGRGYQPALQDEADRFHAVGKIHPDTGLPISTSGADWTSVFGDEMLKLGKEREDVVAITAAMLQPVGLDKFAK

SEQ ID NO: 31291 - protein, 161 aa, Brucella suis 1330
MTIKVGDRLPAATFKVKTADGVTEMTTDDVFKGRKVVLFAVPGAFTPTCSLNHLPGYLENRDAILAKGVDQIAVVAVNDPFVMGAWAQSTGGEGKILFLADGSATFTKAAGLDIDLSGGGLGVRSKRYSAIVEDGVVKSLNIEEQPGQAVTSAASALLAQL

SEQ ID NO: 31292 - protein, 203 aa, Aeropyrum pernix K1
MSEEISFVKEIDTGVEGLPKPEVKIENIVATVILENQLDLNLIETKIQDVDYNPDQFPGLVYRLESPRVTVLIFKSGKMVITGAKSINQLIHVVKKLLKAFADQGIPISGKPQIQIQNIVASANLKVYIDLEKAALEFENSLYEPEQFPGLIYRMDEPRVVMLIFSSGKMVITGAKMENEVYDAVKKVARKLKEADAIIGIAE

SEQ ID NO: 31293 - protein, 331 aa, Saccharomycetales
VRVAIDGFGRIGRLVMRIALSRPBVZVVASBBPFIBLDYAAYMFKYDSTHGRYAGEVSHDDKHIIVDGKKIATYQERDPANLPWSSGDSVIAIDSTGVFKELDTAQKHIDAGAKKVVITAPSSTAPMFVMGVDSEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVBVSVVBLTVKLDKETTYDEIKKVVKAAAEGKLKGVLGYTZBAVVSSBFLGSBHSSIFBASAGIZLSPKFVKLVSWYBBZYGYSTRVVDLVEHIAKA

SEQ ID NO: 31294 - protein, 510 aa, Clostridium acetobutylicum ATCC 824
MDKQLVLVIDFGGQYNQLIARRVREHNVYCEIVPYTYSIDKIKEKKPSAVIFTGGQNSVYGEDSPRMDKEIFDLGVPVLGICYGHQLITYTLGGEVMGSEIREYGKTDVTLDSVCELFEGIDIENSCWMSHTDRVAKVPEGFKVVGHTNVCPVAAMANTEKKIYGVQFHPEVLHTPFGEQLFSNFLFKICGLKEDWSMSSFAKEKIQEIKDIVGDKKVLCALSGGVDSSVAAVLVHKAIGKQLTCVFVDHGLLRKDEGDQVESIFRKQFDMNLIRVNAKDRFLGKLKGISDPERKRKIIGEEFIRVFEEEANKLGQIDFLVQGTIYPDVVESGTDTSATIKSHHNVGGLPEDMQFELIEPLRELFKDEVRAVGEELGIPHKLVWRQPFPGPGLGIRVLGEVTEEKLEIVREADAIFREEIANAGLEEKIWQYFACLPNIHSVGVMGDGRTYCETIALRAVTSSDAMTSDWARIPYEVLDKVSRRIVNEVKGVNRIVYDVTSKPPATIEWE

SEQ ID NO: 31295 - protein, 212 aa, Zea mays
MMPPPPTAVSSCWRGTRRHRAKNLHPHPAAVSVKQPGSGVRFQQFSSLASAAAPALRVLRYQPASTLYESPSSTPPRQLQAMAMEKAASFLSSLLGGGGGEPAATVKSIFIYPIKSCRGLAVSQALIISTGFRWDRQWVVVNGKGRAYTQRVEPKLALVQVELPPEAFAEDWQPTPYDHLATRSLATDSKSFPNSKLNILETNLQILLAIQH

SEQ ID NO: 31296 - protein, 430 aa, Clostridium tetani E88
MEIDNAKDLLDFIYKSPTAFHVINNVEKILLSQGFKELREHEKWELQREGKYFIKKNNSAFIAFVIGKEKIIDNGFKIIGAHTDFPSFKVKPYAEILNGDKYLRLNTEVYGGPILNTWMDRPLSIAGRIVLEGENPLKPKEKIININKPLFIIPNLAIHMNKNVNKGIELNPQKDLLPLMTVEGEDLKEGILEEIIKKELNLDDKKILSYELSLYEFDKGILMGLNNEFISSSRLDNLAMVHAGLRAIVNSKVSKGTNVLVCFDNEEVGSSTKQGADSPLLSNVLERIMEKEEKGREAYFRALSKSFLISADLAHAVHPSAPEKADPVNKPMINKGPVIKVSERQSYTSDGISSAVYKQICKKANIPYQIFTNRSDERGGSTIGPISSRHLNINSVDVGSAVLAMHSIREFGGVRDHYYIIKSFEEFYNL

SEQ ID NO: 31297 - protein, 369 aa, Rhodobacter sphaeroides
KEWIMGFRMGIVGLPNVGQIHVFNALTRTAAAQAANFPFCTIEPNVGEVAVPDARLEILAEIAGSKQIIPTRMTFVDIAGLVRGASKGEGLGNQFLANIRECDAIAHVLRCFEDGDITHVEGRIDPVADAETIETELMLADMDSIERRLANLARKLKGGDKEAADQDRLLRVAMAALEAGRPARSVTVSADDQRAWRMLQLLTSKPVLYVCNVEEASAAKGNSQSARVAEMARAQGAATVVISARIEEEIAQLPPEEAGMFLEEMGLEEAGLDRLIRAGYELLGLQTYFTVGPKEARAWTITRGMLAPQAAGVIHGDFEKGFIRAETVAYADYVAGRGEAGAKEAGKFRVEGKTYEVQDGDVLHFLFNA

SEQ ID NO: 31298 - protein, 597 aa, Glycine max
MAFWWPLLVLALAFAICKFLLILIPPKVPSIDVDASDVLDDGSLTQENSFIYVPPRGTAQQSSGKVQCYEPATMKYLGYVPALTPDEVKEQVEKVRKAQKMWAKTSFKKRRHFLRILLKYIIKHQALICEISSRDTGKTMVDASLGEIMTTCEKINWLLSEGEQCLKPEYRSSGRAMLHKRAKVEFLPLGVIGAIVSWNYPFHNIFNPMLAAVFSGNGIVIKISEHASWSGCFYFRIIQSALAAIGAPEELVEVITGFAETGEALVASADKVIFVGSPGVGKMIMSNAAETLIPVTLELGGKDVFIVCEDADVDHVAQVAVRAALQSSGQNCAGAERFYVHRNIYASFVSKVTKIIKSVTAGPPLAGKYDMGALCMHAHSEKLEALINDALDKGAEIIARGSFGHIGEDAVDQYFPPTVIVNVNHSMRLMQEEAFGPIMPIMKFSSDEEVVRLANDSKYGLGCNVFSGSQSRAREIASQIHCGLAAVNDFAATYMCQSLPFGGVKNSGFGRFGGVEGLRACCLVKSVVEDRWWPFIKTVIPKPIQYPVAENGFEFQESLVEALYGLSVWDRLQALVNVLKMLTEQNSTSGSRKKKND

SEQ ID NO: 31299 - protein, 705 aa, Acidovorax sp. JS42
MSPAAQAPEVQTRREGAVLVVSINNPPVNALGQAVRAGLLAAVEQAEGDAAVRALLIVGEGKAFIAGADIREFGKPQVPPSLPEVCNRLESCGKLVVAAIHGAALGGGLEVALSAHYRLALPAASLGLPEVNLGLLPGAGGTQRAPRLMGVKAAAELMLSGKHLSAKAAAAAGLVDRLVEGTDPVAAGLAYANELLAQGAQPRRTRDLKIADQAAALAELDALALETAKKTRGLFSPGKIVECVRAAVELPFDEGIAKERALFVECLNSPQRQGLVHAFFAERETAKIPEAQAAAPRHFAKIAIIGGGTMGAGITVAALDAGLTVTMIERDAESIARGQKNVEKVYDGLIAKGRMTAEGKAAILARYTPSTRYDDIADVDLVIEAVFEDLEVKKAVFKELDRVCKPGAVLATNTSYLDIDAIAAVTSRPQDVIGLHFFSPANIMKLLEIVVPAKVAPDVVTTAFALAKKMKKVPVRAGVCDGFIGNRILAVYKQAADYLMEDGASPYEIDEAVRGFGFAMGPFQVTDLAGGDIGWATRKRRAATRDPQARYVEVADRVCERGWFGQKTGRGFYLYPQGARVGQPDPEVLAIVDAERAKKGITPRQFTADEIMRRYMAAMVNEGAKVVQEGIALRPLDVDVTFLSGYGFPRWRGGPMKWADMTGLDKVLADIRAFEKEDPLFWKPAPLLEQLVAEGRNFDSLNKAA

SEQ ID NO: 31300 - protein, 151 aa, Bacillus cereus
GVGLAKLGHSVTCFDIDDEKIERIKQGDLPIYEARLHELINYAYENNALTFTSNKEEAFDDVEFIFIAVGTPPLLDGTADLTYIQSACNDIGLYATNDIIVVTKSTVPVGTNDVMKGWIEEKLKGRHTVHIVSNPEFLREGSGIYDFFHGD

SEQ ID NO: 31301 - protein, 391 aa, Clostridium tetani E88
MSLDVKEEALRIHEEKKGKLEIIGTMSVETPRDLSLAYTPGIAAPCLEISKDKEKAYKYTIKGKTVAVITNGTAVLGLGDIGPEAGLPVVEGKALLLKRFGGVNAVPISIDSKDADDIVNTIKNISPGFGGIHLEDIKAPECFYIEDKLKEKLNIPVYHDDQHGTSIAVLAGLYNSLKILKKDIEDIKVVINGAGASGIAIAKLLIKAGVKEIILCDLQGALVEGDSTLNNAQKEIAKVTNRNFEKGSLEDVIKNKDVFIGVSDGNLLTKEMVNSMNKDSIVFALANPVPEIMPEEAKKGGARIIATGRSDFPNQINNVLVFPGIFKGALKVGAKDICNEMKIAAAKGLANLIKDNELNEEYIVPSVFEDGVADAVANEVISIAKKLNLTR

SEQ ID NO: 31302 - protein, 409 aa, Arabidopsis thaliana
MATMISNLPRDLMEEILSRVPLKSMRAVRLTCKNWHTLSITISESLAKMYISKTTRESREGESTIITLMNYKLCLTSLVVDVDPYIEHKGKLTCFNLEHQVKISQVFYYEDDTITTRLVVWNPYWGQTRQIKTRYSHHAFSGRDSTYMFNYSLGYENKNSCRSHKLLRFIDYHWNYRGLHQFFWYEIYDFDSDLWTTLDVTPHWFIVISQSGVSLKGNTYWCARKRSGGYSDHIICFDFTRERFGPLLPLPFSFIDRHHSCVILSCVSEEKLAVLFQYKDHYYKNVVEIWITAKLEAEMVSWSKFLRINTGPIIHTSFFINEEKKVAIGFNDNRKTINIIGEAGYFRELDLGEHAEPYRRRHVFSYVPSSVQIKETAPGNIKKHQSSIETRLFDRNMLRLVAFEKKVSE

SEQ ID NO: 31303 - protein, 172 aa, Prochlorococcus marinus str. NATL1A
MDHLKKYITEINDYPKKGIVFKDLNPIYKEPKAWKELMFPLQNLISTKKPDYIAGIESRGFISASALAFKLEIGLITIRKPNKLPGEVIGTNYKLEYGEDRLEIQQNIIEKDSKILLFDDLLATGGTAGAAGKLIKKAGGNLIGYAFLVELTELKGRENLDSNLLVETLIKY

SEQ ID NO: 31304 - protein, 332 aa, Triticum aestivum
  misc_feature (228)..(228): Xaa can be any naturally occurring amino acid
  misc_feature (230)..(230): Xaa can be any naturally occurring amino acid
  misc_feature (254)..(254): Xaa can be any naturally occurring amino acid
  misc_feature (265)..(265): Xaa can be any naturally occurring amino acid
MANPAPATGGKSFLQAMSTVTEEAAVQLRVVQMEGLAVLKIIKHCEEFAPALVTGQLLGLDVGSVLKVTNCFPFPIREDDEEADADGANYQLEMMRCLREVPVDNNTVGWYQSCLLGSFQTVELIETFMNYQENIRRCVCIVYDPSRSSQGVLALKALKLTDSFMELYRNNGLTGEKLREKKLSWVDIFEEIPITVSNSALVSACMKELEPESPVSQCDFDRLKLSTXAXFMGRNLEFMIGCMDGLSAERNEFXYYYCKPRMARXQGTGWLKRKGRKMFKRLLGEPFQKKSSTLFQPFLTLRFRGFLNHRSRYWTNNGFWPSFKGYLQRVGQ

SEQ ID NO: 31305 - protein, 1112 aa, Gibberella zeae PH-1
MADIMIPNVRSPLSEASNRINSNHPPQEAHRYKPRHDRPPASTNNPPRASYGHPAAYFSGRPPPTQPQSTGPKPQGNPTLKPPTDMDDDRRHSGASYDSSGSGHSKKNYKTHIGPWQLGKTLGKGSSARVRLCRHNVTHQLAAVKIVNRRMAYLVQDSSLAALSKWDNNLPEQIDGEIRVPMAIEREVAILKLIEHPHIMKIYDIWENRSEVYLILEYIDQGDLFTFINMKGRLSEEVSVYFFRQIISAISYCHSFNICHRDLKPENILISANLKIKIADFGMAALHQTDTHRLNTACGSPHYAAPELLKNRQYRGDKADLWSMGVILFAMLTATLPFDDPDIRVMMSKTKKGQYEMPDYLSPEAEDLIRRMLQVNPDRRITLKEIWRHPLVKKYAYLDNLDDLNSQPPDIRKGFQYTPVPAQDVDSQLVRQLRSMWHTFSENDLKLKLTCDEPNDQKAFYWLLYQYREQQLEDFKPEIAHSTSDYHHMKPGTWKKHPQAASLSKKTTMALTPGNQKGFEVDQVRAVDVEHQLEPPPQDAYYHREARCRPCTAVDKARRMHATRATNEESTSRMSGSVPPYVTEQGSTYQLEMARPFTPDVSELPSTVLPKTKDRHEAQVNTKRASGQAMRIALGSRYASEIFKEELRHFSSNIAKDCDEAFKSSLIEEDSIAGSLTEPDRTQYESTPISFTIDAPDESAPDILDLTAKSFSNRPLPPLPTPLQGHDERSLAPTPIGSRPTTGDSHLEELRAEQVKVAQPVILTRHAERRVVSAPAYHQKSKMNPALPSINETGAISNDKARIVSAPPHTPTKRGVDRIRGIEYLSQVENSIRVVNSPGDESPVKMPKPLNVRKKFCDSEEEEEDVMVKRASKVESTHGRESVDWQDCNSYLTSSDGKRSDSTTTDAPSKKKTFNFNFWKSNKQRDSIMSITKEPDDKEERPSVELSVVGKTNTSTKVSQSRWHESNSGPVRNIEVKQNWLARLFRVKPATDHICMTISRRRARQEVTILLREWRKYGIRDIQVDKQRNIVFARVADKNFLNLKEVSFAAEVITVIEHGKKQPLSIIRFTQERGAASSFYRVVDTMRMMFETRALVISDKNKQKMMIKTLNS

SEQ ID NO: 31306 - protein, 218 aa, Pyrobaculum aerophilum str. IM2
MRVKAKIFIRPLFATYVSVIDLSLWEPRTELGRMVKEGKIRTIDEIFANNYIIKEPEIVDILLPGLKQELLNVNLVQRQTHAGERNQFQAVVAVGNEDGYVGVGIGKARQVRQAIEKATREAKLNLVPVRRGCGSWKCSCDEPHSVPFVVRGKSGSVEITLIPAPKGVGLVAGDVAKAVLRLAGIKDVWTKTRGDTRTTLNFAMAVYNALRNTYYFKI

SEQ ID NO: 31307 - protein, 335 aa, Anaplasma marginale str. St. Maries
MQVTILGAGAFGTALSIALCNTGKKVRIWSRNGQVVESLRTHGENSVYLPGFKVPREVLVHSDMGLATDGPAAILMCVPAQELRSLCNTITAASALEAGVPLLVCSKGIENSSLKFPSEVVAEMFPQNPVFVLSGPALARELASGLPCAMVLAGDEITTAETLASQLSGPALAIVHSGDLMGVQVGAVMKNIIAIASGIIAGMGLGHNASAIVMVQGMSEIKAVCEAKVGVAATETLIGLSCLGDLVLTCTAPGSRNMSFGSSVGKAGRAGASGQQKPMLVEGVESVTAMVNMGKALNLELPICSAIARMLHGQLGVRQAAAEILSAPVKSRLNV

SEQ ID NO: 31308 - protein, 98 aa, Anabaena sp.
ATFKVTLINEAEGTKHEIEVPDDEYILDAAEEQGYDLPFSCRAGACSTCAGKLVSGTVDQSDQSFLDDDKIEAGYVLTCVAYPTSDVVIQTHKEEDLY

SEQ ID NO: 31309 - protein, 461 aa, Desulfitobacterium hafniense Y51
MKELIKSIAVLGSGPAGYVAAIRASQLGAEVVVIEEEDLGGVCLNRGCIPTKALLKTAEIAVMAKRSKEFGIESQLEAKNWGVAVDRKNRIVKNLNSGLDNLLRARGITVLKGKGTVLSERKILVQTTEEVIEVNCEKMILTTGAVPLILPIKGIDSAGVITSDEALNLKALPESIVIIGAGVIGLEFAAMLGHAGVKVTIIELQDRILPNEDREIAAELQKIMKRQGIIFKLSASVTEIHKIEDGLIVTYSMGEKEFRHPCEKVLVAAGRKTNSDIFEKLPLTIEKGAVVVDEFMETNVKGVYAAGDLVGGKQLAHLAFMEGKVAAENALGITSKVNYSAVPTCIYTNPEMASVGMTEEQAKRAGLSVKVGRFDFRNNGRALTLGEREGFVKVIADQDNTIIGGQILGVDASEMISELTLAITLKAKADDIADMIHPHPALSEAIWEACGEILGKPIHKL

SEQ ID NO: 31310 - protein, 98 aa, Anabaena sp.
ATFKVTLINEAEGTKHEIEVPDDEYILDAAEEQGYDLPFSCRAGACATCAGKLVSGTVDQSDQSFLDDDQIEAGYVLTCVAYPTSDVVIQTHKEEDLY

SEQ ID NO: 31311 - protein, 408 aa, Desulfitobacterium hafniense Y51
MASICFIWVFKINPLVSELKIEIGRCVMIYLDNAATTWPKPPEVVQAMNNFMIHNGGNPGRGTHAASIQAAHVIFDTRVELAELFGLKDPSRIVFTNNTTYALNQALFGLLNPGDHVITSSLEHNAVARPLKALAKYGVSVTEVSGEPGDEFNLEEYRQSFQENTKCVVTLHASNVTGTILPIEEIGNIAWEHGVKYLVDVAQTAGVFDLDLKNLPVDILTFPGHKGLLGPQGTGGLAIRKGVQLKPLIYGGTGSLSESEDQPDFLPDQLESGTLNGVGIAGLGGSVRYLRSVGIDERRESELELCRQLIDGLCGIKGVKIYGEKNVLKRAPIVSFNIGSLDSMFVADRLDQYYGIRCRAGMHCAPHAHRMLGTMDQGVIRFSPSHYTKSTEIADAIYAVSQLAKELL

SEQ ID NO: 31312 - protein, 430 aa, Brucella suis 1330
MGVEVTRLPNGLTIATDTMPHVESVALGIWVKVGARNEAPDRHGIAHLLEHMAFKGTENRTAWQIASDIENVGGEINAATSVETTSYYARVLRNDMPLAIDILSDILTASKFDEGELEREKQVIMQEIGAAHDTPDDIVFDRFTETAYRHQPIGRAILGEPETVMSFTSDDLRQYMQEQYSVDRMVVTAAGGIDHDEFVREVEKRLGSFRPHNTAPTLDLAHYVGGDFRENRELMDAQVLIGFEGRAYHVRDFYASQLLSMILGGGMSSRLFQEVREKRGLCYSVYAFHWGFSDTGLFGIHAATGRDELVELVPVIIDELHKAADSIGIEEVDRARAQYRASLLMSQESAASRAGQIARQFLLYGRPVENSELLDRLSLITPERLTDLAGRLFLNNKPTIAGVGPVGCLMSFDRLTDALSTNAHTRKIAV

SEQ ID NO: 31313 - protein, 480 aa, Pseudomonas fluorescens PfO-1
MQLKDTQLFRQQAFIDGAWVDADNGQTIKVNNPATGEILGTVPKMGAAETRRAIEAADKALPAWRALTAKERAGKLRRWFELMIENQDDLARLMTLEQGKPLAEAKGEIVYAASFIEWFAEEAKRIYGDVIPGHQPDKRLIVIKQPIGVTAAITPWNFPAAMITRKAGPALAAGCTMVLKPASQTPFSAFALAELAQRAGIPKGVFSVVSGSAGDIGSELTSNPIVRKLSFTGSTEIGRQLMSECAKDIKKVSLELGGNAPFIVFDDADLDKAVEGAIISKYRNNGQTCVCANRLYIQDSVYDAFAEKLKVAVAKLKIGNGLEEGTTTGPLIDEKAVAKVQEHIADAVSKGATVLAGGKPMEGNFFEPTILTNVPKDAAVAKEETFGPLAPLFRFKDEADVIAMSNDTEFGLASYFYARDLGRVFRVAEALEYGMVGVNTGLISNEVAPFGGIKASGLGREGSKYGIEDYLEIKYLCLGI

SEQ ID NO: 31314 - protein, 450 aa, Idiomarina loihiensis L2TR
MSYIKETIEKLKQTSPAQVEFYQAVEDVLESIEPLLEERPKYREHSIIERLLEPERQIMFRVPWMDDDGKIQVNKGYRIEFNSALGPYKGGLRFHPSVNAGIVKFLGFEQIFKNALTGLPIGGGKGGANFDPKGKSDAEIMRFCQSFMSELYRHIGPHTDVPAGDIGVGSREIGYLFGQYKRLANRFDGVLTGKSELWGGSQVRKEATGYGVVYFAQCMMDDQDDSLDGKRCLISGSGNVAIHAMEKLYELGAKPISCSDSSGTIYHDSGIDLDLVKRIKEEQGGRLKEYLETHEDAEYTSKDDYPEEGHCVWRYEADIAFPCATQNELTEKDAQALLENGCKYIVEGANMPTTQAAVDLFIESGVGYGPGKASNAGGVATSQLEMAQNASMLRWDFEEVDEKLKDIMSNIYQDAKRTAEDFGHPSNLVLGANIAGFRKVADAMLEQGVV

SEQ ID NO: 31315 - protein, 425 aa, Pseudomonas fluorescens PfO-1
MSKTNAELMARRTAAVPRGVGQIHPIFAESAKNATVTDVEGREFIDFAGGIAVLNTGHVHPKIIAAVTEQLNKLTHTCFQVLAYEPYVELCEKINARVPGDFAKKTLLVTTGSEAVENAVKIARAATGRAGVIAFTGAYHGRTMMTLGLTGKVVPYSAGMGLMPGGIFRALYPNELHGVSIDDSIASIERIFKNDAEPKDIAAIIIEPVQGEGGFYVAPKEFMKRLRALCDQHGILLIADEVQTGAGRTGTFFAMEQMGVAADLTTFAKSIAGGFPLAGVCGKAEYMDAIAPGGLGGTYAGSPIACAAALAVMEVFEEEKLLDRCKAVGERLVTGLKAIQAKHPVIGEVRALGAMIAVELFENGDSHKPNPTAVAAVVAKARDKGLILLSCGTYGNVLRVLVPLTSPDEQLDKGLAIIEECFSEL

SEQ ID NO: 31316 - protein, 525 aa, Burkholderia xenovorans LB400
MKTVQHAAYEILRRHGLTTIFGNPGSNELPFLKHFPSDFRYILGLHEGVVTGMADGYAQATGNPAFVNLHSAAGTGNAMGALANAWNSHTPLVVTSGQQVRSTIGMEPLLANVDAVNLPRPLVKWSTEPASAEDVPRSFAQAIHIARTPATGPVYLSIPYDDWDQPAPEYAHYLAAREVQHAGLPSEAILQALADRLQRATNPVLVLGPDVDAQHANESAVALAERLKMPAWMAPSAPRCSFPTTHACFRGVLPAGIASISRLLDGHDLILVVGAPVFRYHQYEPGALLPAGAELVSITCDVLEAARAPMGDAIVADIALTLEALAARAEPAARPMPVAVARPAAAAETPGPLAPERVFDIVDAIAPRDAIYVNESTSTTNLMWQRLRMTSQGSYYFAAAGGLGFAMPAAAGIQLAQPGRRVIGIIGDGSANYGITALWTAAQYSIPTIFIIMKNGTYGALRWFAGVLGVEDVPGLYVPGIDFCALARGYGVEALHADSGASLTVALERALSSSRPTLIEVETLA

SEQ ID NO: 31317 - protein, 426 aa, Coprinopsis cinerea okayama7#130
MATRLKQLFGHLSSSDMTAELWQNVPLAPPDSIFKLTAAYKADTFEKKVNLGVGAYRDDNAKPWVLPVVKKATERLLKDDTLDHEYLPITGLPEFTAAAAKLILGPDSPAIKENRAVAVQTISGTGANHLGALFLSRFYGWNGEPRVYLSNPTWANHHAIFRNVGIEPVDYPYYNPQTISLDFDRLIDSLKEAPARSVFLLHACAHNPTGVDPTPEQWEAIADVMLERGHYAFFDCAYQGFASGDLDKDAWAVRRFVEKNVPLLVCQSFAKNAGLYGERVGALHVVSPDAETANRVRSQLSVLQRSEISNPPSHGARLVSLILNDPELFEEWKRDIVTMSSRIIDMRKELYRLLTEVYKTPGNWDHILNQIGMFSFTGLNPEQSKAMVEKAHIYMTGNGRISMAGLNSHNIEYFASSLDKAVRGEL

SEQ ID NO: 31318 - protein, 397 aa, Oceanobacter sp. RED65
MSLAPLILKPKQDKRLRQGHIWIYSNEVDTKATPLKGFEAGQQVEVKTSQGKSLGVAHINPNNLICGRLLSRSSKLFGRGNMMKRIESALALREACFTDGPYYRLIYGESDGLPGLVVDRFGDYLVVQISTAGMEKMKSQIQGALTRILDVKGIVWKNDGKMRSLEGLDEYVECADDIPHMLPLMENGTRFEAPVIEGQKTGWFYDHRLNRQRVNQLVKGKRVLDICSYIGGWGVQAAHHGAAEVVCVDASQQALDWVKHNAELNGVAEKVSTIKGDAFKVMEQLQEQQEQFDVVILDPPAFIPKRKDIGPGERAYGKMNQLGMRLLKHEGFLVSASCSMHLDETRLVSLLNQAGRHLDRQVQIIERGSQGPDHPVHPAIPETRYIKSLLCRVSYRS

SEQ ID NO: 31319 - protein, 353 aa, Issatchenkia orientalis
KLGETYVSCKVSAQITQPYEDRPFEGTFAISTEITAMCSPAFSNSNNTDFSTAAPAIVPATSVNVPSNGESNNNNNSNNGSGSGNQENQLSMGGGAVMGLAADQGATEILLGRLIEKSVRRSNALDLESLCIIAGQKCWAVRADVRFLNSDGNLVDAASIAVITALLHFRKPDVELVGSGEGTELIIYDEKQREMVPLSILHIPICVTFQFFSTESVERNIKGESLDSRSRSRQVKSNNGDEGDDDLMDVDYEANDGPRASNEVVIVDATSEEELLSQGSMTVTLNSNKELCQISKSGGLNVDSKKVLECCQIASKIVDKWTKQIKQVLADDEKKRRNPLIEKTLSTVNDRSS

SEQ ID NO: 31320 - protein, 209 aa, Dechloromonas aromatica RCB
MNIDNASNWDPQALGLVPMVVEQSGRGERAYDIYSRLLKERVIFLVGPVNDVTANLVVAQLLFLEAENPDKDIYFYINSPGGSVTAGMSIYDTMQFIKPDVSTLCIGQAASMGAFLLNAGAKGKRFALPNSRVMIHQPLGGFQGQASDIAIHAKEILSIRDRLNRIMAEHSGQPLERIEKDTDRDNFLSAAEAAEYGLIDKVLTRRDAA

SEQ ID NO: 31321 - protein, 301 aa, Salmonella enterica subsp. enterica serovar Enteritidis
INGFGRIGRIVFRAAQKRSDIEIVAINDLLDAEYMAYMLKYDSTHGRFDGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVK

SEQ ID NO: 31322 - protein, 144 aa, Thiobacillus denitrificans ATCC 25259
MQIREILTLKSDEIYSIAPTDRVESAVARMVELGVGSLVVLKAGEMVGLLTERDVVHGMVEHGCDLKDTEVSAIMVTDPVVANADDSVDYARDVMTKSHIGHLPILDGNKLLAIISFHDVARACLKEANFENSLLKRYIKHWPE

SEQ ID NO: 31323 - protein, 515 aa, Oceanobacter sp. RED65
MSAQPKPVALIILDGFGERDAAQDNAITTANMPTWNRLVNEYPHVQINTSGAAVGLPDGQMGNSEVGHMNLGAGRIVYQNYTRINKAISDGEFQQNAALTAAMDKAISAGKAVHLMGLLSPGGVHSHQDHIMALASMAKDRGAKQIYVHAILDGRDVAPQSAKPFLETVSEHLAGLDMGDDARIVNLIGRYYAMDRDNRWERVQRAYDMYTQGKAEYQAASAIEGLEASYDRDEHDEFVKDTIIGDAVTINDGDSVIFANFRPDRAREITRAFVEQEFNGFSRTAHPTLSDYVMMTEYAADIETSCAFPPASMKNDLGEYVSNLGKTQLRIAETEKYAHVTFFFSGGQEAVYPGEERILINSPDVATYDLKPEMSAPEVTDKLVDAIENQKYDLIVCNFANGDMVGHTGVMDAAVKACEALDTCLKRVTDAIIKVGGECLITADHGNCEQMTDANGGPMTQHTTGPVPLVHVSKKGKQVSLKQGGALCDIAPTLLTMMGETAPEEMTGQVLVKYE

SEQ ID NO: 31324 - protein, 127 aa, Brassica napus
GNCVRSNRRDLGGRRSMDPRIWHKVAAVSGMAALGLGTYGAHVFKPENPSYKQVWQTASLYHLVHTAALVSAPSTKYPNIFGGLLTAGIVAFSGTCYMVALREDRKFSTLAPFGGFAFIAAWATLLF

SEQ ID NO: 31325 - protein, 101 aa, Brassica napus
MAESTQMEGVQFRKITIPPNRYTALKKAWLDIYTPVYDQMKVDIRMNLKSSKIELKTRADTPDVSNLQKSADFVQAFMLGFDIPDAVALLKMDKLSVECVV

SEQ ID NO: 31326 - protein, 366 aa, Yarrowia lipolytica CLIB122
MSSVFGSARTTSGFGGLTQTSSAGTVQDMANDPTLANPPEDSVSDICFSPQAEFLSVASWDKKVRIYEVSPQGQSRGVALYDHQAPVLSTHWSLDGTKVASGGCDNAVRVFDMQSQQAQQVGQHESSVRCVRFVAAGPSDTPILASAGWDKKLHYWDLRTPNPVSTIALPERAYSMDTSKQLLVVATAERHILAINLSNPGAVAKTLQSSLKFQTRVVSCWPAGDGFAVGSIEGRCGIQYVDDTQAKNKNFSFKCHRQTPNPSKNEVDIYAVNAISFHPQEGTFCTAGADGSLTFWDKDSRHRLKGYPQLGCTIPATAFNRDGSIFAYAQSYDWSKGHSYNNKDIPHTVRFHQTKAEEVKAKPKRR

SEQ ID NO: 31327 - protein, 305 aa, Thiobacillus denitrificans ATCC 25259
MLKHFLQFRDLSRDEHLYLFERARVIKSRFKRYEPYHPLADRTLAMIFEKSSTRTRLSFEAGMHQLGGSAIYLNTRDTQLGRGEPVEDAGEVISRMVDIVMIRTFEQEIIERFASHSRVPVINGLTNEYHPCQVLADIFTFIEHRGPIHGKTVAWIGDSNNMCNTWLQAAELLDFNVHVSTPPGYEVEPERAGLYGTDHFESFVDPMDACRGADLVTTDVWTSMGWEAENDARMKAFADWQVDAEMMAVAKPEAVFMHCLPAHRGEEVTAEVIDGRQSVVWDEAENRLHVQKALMEYLLLGKLET

SEQ ID NO: 31328 - protein, 339 aa, Triticum aestivum
  misc_feature (141)..(141): Xaa can be any naturally occurring amino acid
  misc_feature (218)..(218): Xaa can be any naturally occurring amino acid
MASSFLSLRLPTPSPPTATSSPFFPNPLVRSGRCSPPSSTLVARVAGSAAGAPSPLFNPRGDPFLSTLAAASPEQLAAAAGGERRGEDHLPFLEIFQNAKLMSSPAQVERSSSSYSQHSPRRPPPDLPSLLLHGRIVYIGXCPLVPAVTELIVAQLMYLDWMNSSEPAYIYINSTGTARDDGEPVGMETEGFAIYDAMMRMKTEVHTLCIGAAAGHAXCLVLSAGKKGKRYMFPHAKALIQQPRIPSYGMMQASDVVIRAKEVVHNRNTLVKLLARHTGNPPEKIDKVMRGPFYMDSLKAKEFGVIDKILWRGQEKYMSDMLSPEDWDKVAGVRGPGGM

SEQ ID NO: 31329 - protein, 123 aa, Neisseria gonorrhoeae FA 1090
MAITKEDILEAVGSLTVMELNDLVKAFEEKFGVSAAAVAVAGPAGAGAADAEEKTEFDVVLASAGDQKVGVIKVVRAITGLGLKEAKDIVDGAPKTIKEGVSKAEAEDIQKQLEAAGAKVEIK

SEQ ID NO: 31330 - protein, 394 aa, Thiobacillus denitrificans ATCC 25259
MTTTHLMNTYARQPVAFVRGEGAYLWDEAGKRYLDAVAGVAVNALGHAHPRLVKAIAEQAATLIHSSNLYRVLRQEELADKLCALSGMDRAFFCNSGCEANEAAIKLARLYGHGKGIELPTIIVVEKAFHGRTMATLTATGSRKIQAGFEPLLSGFARVPFNDIEAIRHVAEHNKSVVAVLIETVQGEGGINILPAEYLAELRTLCDAQGWLLMLDEVQTGIGRTGTWFGFQHAGVVPDVIALAKGLGGGVPIGACLARGAAAEVFTPGTHGSTFGGNPLACAAALATLETIEAEHLLDNARLRGDAIRAGLRGALDGVHGVLDIRGEGLMIGIELDRPCAELVGVARDAGVLINVTADSVIRLVPPLIYGADEVDLLVATVADVVRNYLQQAA

SEQ ID NO: 31331 - protein, 246 aa, Prochlorococcus marinus str. NATL1A
MRKPVIAGNWKMNMTCTEAIEYMRVLIPLLKDIPKKDREVVIAPPFTALYPLSEFIRDKNDCLSLSSQNVHWEDSGAYTAEVSPLMLNELSVKCAIVGHSEPRKYFSESDEQINKRAKSAQDHQLIPIVCVGETFQQREMGEAERVIRRQIEQGLEGIEVKKLIVAYEPIWAIGTGKTCEANEANRICGLIRKWIGYEDVIIQYGGSVKSNNIDEIMSMSDIDGVLVGGASLDPTNFARIANYEKI

SEQ ID NO: 31332 - protein, 287 aa, Triticum aestivum
  misc_feature (47)..(47): Xaa can be any naturally occurring amino acid
  misc_feature (77)..(77): Xaa can be any naturally occurring amino acid
MSGGPAAVSFLTNIAKAAAGLGAAASLLSASLYTVDGGERAVVFDRXFRGVLPETVGEGTHFIVPWLQKPYIFDIRXRGPHNFSSNSGTKDLQMVNLTLRLLSRPDVVNLPTIFTSLGLEYDDKVLPSIGNEVLKAVVAQFNADQLLTDRPHVSALVRDSLIKRAREFNIILDDVAITHLSYGADFSQAVEKKQVAQQEAERSKFLVAKAEQERRAAIVRAEGESESARLISEATAIAGTGLIELRRIEAAKEIAAELARSPNVAYIPSGDNGKMLLGLNAAGFGGR

SEQ ID NO: 31333 - protein, 294 aa, Xenorhabdus nematophila
EFLKEGAAVADCMRPERIIIGCDNDNVVDVMRELYEPFNRNHDRMIVMDIRSAELTKYAANCMLATKISFMNEIANLAEMLGADIENVRQGIGSDSRIGYHFIYPGCGYGGSCFPKDVQALIRTAEQIGYTPKILQAVEQVNEKQKSKLPTFVKHHFGDDLSGKTFAIWGLSFKPNTDDMREASSCVLMETLWECGAKVQAYDPEAMQETQRIYGQRDDLSLMGTKEAALKGADALIICTEWQNFRAPDFDVIKNSLRTPVIFDGRNLYDPERMQSRGFTYYGIGRGASISPVI

SEQ ID NO: 31334 - protein, 338 aa, Xenorhabdus nematophila
MKFLVTGSAGFIGFHVSQRLLNMGYEVVGIDNLNDYYDVKLKQARLNLLLPHANFRFEKLDLADRVATPELFAKHQFQRVIHLGAQAGVRYSIQNPMAYIDANIIGHINILEGCRHHHVEHLLYASSSSVYGLNKKQPFSTADSVDHPISLYAATKKADELMSHSYSHLYQLPTTGLRFFTVYGPWGRPDMALFKFTKAMSEGESIDVYNHGNMVRDFTYIDDIVESIIRLQNIIPIRNENWSVEDGQIFASSAPYCIYNIGNGQPTKLGAFIEAIEVSLGVEAKKNFMEIQDGDVLSTCADSSALYDKIGFSPNTPVKEGVKRFVDWYLDFYQKPVK

SEQ ID NO: 31335 - protein, 115 aa, Picea sitchensis
MRWHPSGAKKYQELESRSESLFVSENGERLPEEFVETDYYKDLNAIDKVHHPPGEAFIKLDCNGGSYFRLAFQEETGLMERIPVRSNPATNDWLPAPVDDQEMVMAASLKPVRSG

SEQ ID NO: 31336 - protein, 186 aa, Candida glabrata CBS 138
MSGGRAKYIPPLNFAPIVSTDVSLYRSGYPMPLNYSFIRGQLHLKTIIYVGDKSEPMPEYAEFLERERINYHHIHMDSCRDPDIDAQMDRVLQLVLRADNYPILIHSNKGKHRVGVVVGIIRKLLQGWSIAGIYQEYGLFSGGLKDEADLEYITMFETDILMDPRTVPRFALRRHHPTVIQQETTP

SEQ ID NO: 31337 - protein, 244 aa, Haemophilus ducreyi 35000HP
MSLKDMTGQKVPNVTFHTRQGDAWVDVTTSELFDNKTVVVFSLPGAFTPTCSSTHLPRYNELACEFKAAGVDSILCVSVNDTFVMNAWKADQESENVMVIPDGNGEFTEGMGMLVGKEDLGFGNRSWRYSMLVKNGVVEKMFVEPQEPGDPFKVSDADTMMKYLVAGWQAKESVSIITKPGCPFCAKAKETLKAKGYAFEEIVLGRDASTISVRAITGKTAVPQVFIGGKHIGGSDELTAYFAK

SEQ ID NO: 31338 - protein, 465 aa, Ralstonia eutropha JMP134
MSLFRTKDIDAMLVNSHVGGLKKVLGPVDLVLMGIGAIIGTGIFVLTGTGALTAGPALTISFVIAAMACGFAALCYAEFASAIPVSGSIYTYSYATLGEIIAWMIGWDLLLEYGLATSAVSVGWSGYFQSLAAGFGLHLPAALTAAPGAVPGVQTLFNLPAFLIMLITTWVVSCGVRESARLNNVMVAIKVAVVVLFIAVGVWHVKPANWQPFAPFGVSGIFNAAALVFFAFIGFDAVTSAAEEVRNPHRDLPVGIIGSLAVCTVLYVIVAAIMTGVVPFAKFAGIDHPVSLVLQYAGQNWVAGFVDLGAILGMTTVILVMTFGQTRVIFAMSRDGLLPARLSSVHPVHATPFFATWTVGIVFAMIAAFVPLNVLAELINIGTLSAFTLISIAVLVLRRTRPELHRAFRCPGVPVVPLLSVGFCLFLMAHLQALTWIAFLTWLAIGLSVYFLYARRNAVLHEGSR

SEQ ID NO: 31339 - protein, 334 aa, Haemophilus ducreyi 35000HP
MKTLGEFIIEKQAEYPEAKGELSGILASIRLAAKIIHREINRAGLSQDILGFAGSENVQGETQMKLDIFANETMKKALLAREDVAGFASEEDDNFIAFDSERNRNAKYILMTDPLDGSSNIDVNVSVGTIFSIYKRISPIGSPVTIEDFLQEGRKQVAAGYVTYGSSTMLVYTTGNGVNGFTYDPSLGLFILSHPDMKMPAEGKYYSINEGQYVTFPLGVKKFIKYCQENDEASKRPYSSRYIGSLVSDFHRNLLKGGIYIYPTSTVYPQGKLRLLYEGNPMAFLAEQADGMATDGFQPILDIKPTELHQRVPFFIGSKTMVKQANTFMQTFTE

SEQ ID NO: 31340 - protein, 157 aa, Oryza sativa Indica Group
MSCQEERPPAVADGTKITIGEALEAAALSAGDQPVEPSDAAAIEAAEARAAGRLQDDDDDDDDDDADAAAAPAGLAARARAAADANARAERDEDKTTLGDVLADAAAKLGGADKEVEREDAVRVVGVEVRSKPDAAARPGGVAASIAAAARLNRGRQ

SEQ ID NO: 31341 - protein, 315 aa, Opitutaceae bacterium TAV2
MDLVGVGYCSWDYVCVVPEIPIDGKIQITDSLEQGGGPSATAIVAAQRLGARTAFVGTVGDDDSGRKILREFQAEGVDVAAVVTRQNAKSAVSYCWAARESGQRSIAWMHSTAKPLSVTEVDEVLICSARVLHLDGHQTGAAIHAARVARAAGVTVCLDAGTLVPEIDSILENVDIVIASETFAEKYTGEASEEKQLRALMRHGARWAVVTSGSKGSVGFDGKNWVRMPAFRVEAIDTTGAGDVYHGAFLRRYLDGVSLGECMRFASGAAALKCGALGGRTGIPTLAVLEAFLKNAQPQLQPYQDNHELSFSMQS

SEQ ID NO: 31342 - protein, 438 aa, Arabidopsis thaliana
MSCSSSSGSEGEEEGFDAYRKGGYHAVRVGDPFSGGRYIAQRKLGWGQFSTVWLAYDTLTSTYVALKIQKSAQQFAQAALHEIEFLSAAADGDLDKTKCVVRLIDHFKHSGPNGQHLCMVLEFLGDSLLRLIRYNQYKGLKLNKVREICRCILTGLDYLHRELGMIHSDLKPENILLCSTIDPAKDPVRSGLTPLLEKPEGNANGGASTMNLIEKKLKRRAKRAVAKISERRVSMVTGEEASSKTEKSLDGIDMRCKVVDFGNACWADKQFAEEIQTRQYRAPEVILKSGYSFSVDMWSFGCTAFELVTGDMLFAPKDGNGYGEDEDHLALMMELLGKMPRKIAIGGAKSKDYFDRHGDLKRIRRLKYWPLDRLLIDKYKLPEAEAKEFAEFLIPTLEFAPEKRPTAQQCLDHPWMNVTTQNDAENVDDQMNNLHIKG

SEQ ID NO: 31343 - protein, 640 aa, Moritella sp. PE36
MEHGVLFNIFIYLAAGVVAVPIAKRLGLGSVLGYLIAGAIVGPYALSLISNQEDVMHVAEFGVVMMLFLVGLELKPALLWQLRMPILGTGGLQLCATTLCIFIILLTCGLAWQTALAIGLIVALSSTAIVLQNLQERELMKTEAGKNAFAVLLFQDIAVIPILSILPLLVIQDTAIVESSTSAWLSALMIAGVIAGIIIGGHFLVVPLLRIIAGSRSREIFIATALALVVGIALAMEAVGLSAALGTFLAGVVLADSEYRHELESDIEPFKSLLLGIFFISVGASIDFTLLLDQPILVALLVTGLIAVKFIVLFITGIVFKIQRSQNWLFSCALAQGGEFAFVLTSFALQRQVFDNEIASLLVLVVTLSMVFTPLLLIINDKIIAPTFKRKVPHADNKATPEHQIPDDTDSSVIIAGFGGFGQVVGRLLHGYHINTTILENDVGQIELLQQFKYKVFYGDAEQLNLLHAAGADNAKLFIIAVESASRTKRILIKVKKHFPHLTVLVRATDRNHAQQLIRLGADHVFRESLDSGISLGVETLKALGMRANQAHRAGQVFRRHDEAVLHEEARQMHEHEPEFVNRSLTERRILKKLLGLDALTYYDNLNDAWSTEAHSNEDKNTVGNLAAAHKHNKSTGEQS

SEQ ID NO: 31344 - protein, 524 aa, Aspergillus nidulans FGSC A4
MPSHTYPQRLYTTGYTVPPLKDKSLFIQKAFVNGEWVDAESGKTFEVHAHIDANGWYLDVLTDPATGKLIGTCPEFSASDTEKAIQAASAAFPKFRATLARERARMLRRWYQLMVDNAEDLATLITWENGKPLADAKGEVNYAASFFEWFSEEAPRTYGDTIPASVPGNRVITVKQPVGVCGLITPWNFPAAMITRKIGPALAAGCTVVTKSPGETPFTANALAELANRAGIPKGVVNIVTAMKNTPEVGEMITTHPDIRKVSFTGSTNVGRLLMKQSSSTIKKVSWELGGNAPFIVFDDVEDLDAAVTGAIASKFRSSGQTCVCANRIYVQKGIYDEFVQKFVEKVRNFKVGAGFEDGVTHGPVIHDRAVDKVDQHVQDAISKGAKLIAGGQRRSDLGPNFYDLTVLANMTKDMKIASEETFGPVAGLFPFETEKEVVELANKAEVGLAGYFFSGNIKRIFRVAEALEVGMVGVNTGLISDVASPFGGVKQSGFGREGSKYGIEEFMTIKSVTFGGMGEPLQS

SEQ ID NO: 31345 - protein, 362 aa, Mycobacterium tuberculosis H37Rv
MSASLPVFPWDTLADAKALAGAHPDGIVDLSVGTPVDPVAPLIQEALAAASAAPGYPATAGTARLRESVVAALARRYGITRLTEAAVLPVIGTKELIAWLPTLLGLGGADLVVVPELAYPTYDVGARLAGTRVLRADALTQLGPQSPALLYLNSPSNPTGRVLGVDHLRKVVEWARGRGVLVVSDECYLGLGWDAEPVSVLHPSVCDGDHTGLLAVHSLSKSSSLAGYRAGFVVGDLEIVAELLAVRKHAGMMVPAPVQAAMVAALDDDAHERQQRERYAQRRAALLPALGSAGFAVDYSDAGLYLWATRGEPCRDSAAWLAQRGILVAPGDFYGPGGAQHVRVALTATDERVAAAVGRLTC

SEQ ID NO: 31346 - protein, 267 aa, Kluyveromyces lactis NRRL Y-1140
MSRPEDLAPPEVFYNDSESKKYSGSTRVQHIQAKMTLRALELLNLPHTSYILDIGCGSGLSGEIITEEGHIWCGLDISPSMLAEALEREVEGDLMLHDIGQGIPFRAGVFDAAISISVIQWLCNADTSYNDPKRRLMRFFNTLFASLKKGGKFVAQFYPKNDDQIDQILGAAKVAGFSGGLVIDDPESKKNKKYYLVLSSGSTEQNEQVNLDGVKMDADLMVKRERKKKLVESSKDYINRKKEVMKKRGRKVALDSKFTGRKRRPRF

SEQ ID NO: 31347 - protein, 332 aa, Burkholderia thailandensis E264
MKVAVLGAGAWGTALAAHLAARHDTLLWARDAALVAELAARRENVRYLDGVALPPALRYEADLTAALSHAQADDALCVIAAPVAGLRALCRAMRDAGRVPAHFVWVCKGFEADTRLLPHQMVAEELPDHASYGVLSGPSFAREVAQGLPVALTVASASAACRGRTLAAFHHGAMRIYTGDDVVGVEVGGAVKNVLAIATGIADGLGLGLNARAALVTRGLAEMSRLGVALGGRAETFTGLTGLGDLILTATGDLSRNRTVGLQLAAGRSLDDILAALGHVAEGVRCARAVLSIARERGVDMPITEAVCAVLFDGVAPRDAVSGLLRRDAKAE

SEQ ID NO: 31348 - protein, 587 aa, Aspergillus nidulans FGSC A4
MTENASMNGAATPLSSRLSNLALTEYSAIPTPTSEKEEYKGPDSPPAWDIPDAFLLPNGYPDVRHVPAAYPNRSTANNRYLQYLKLILTSRVYEITTESPLHHAVNLSNRMECRVLLKREDLLPVFSFKLRGAYNKMAHLTDEQRWKGVIACSAGNHAQGVAYSARKLKIPATIVMPSGTPAIKHLNVARLGGSVVLHGNDFDAAKEEAHRREKQHGLTSIPPFDDPYVIAGQGTIGMEILRQANLDKLEAVFCAVGGGGLISGVGVYIKRIAPHVKVIGVETHDANAMAQSLDEGSRVLLNEVGLFADGAAVKSVGSECWRVAREVVDEIILVSTDETCAAIKDAFEDTRSIIEPAGALAIAGLKKYVAKRPSPNTSRELVAITSGANMDFDRLRFVAERAALGEKKEALLSVKIPEQPGAFAKLVEVVLPHAVTAFNYRYADETTADVLMGISLSASTGQEDLAKIMTELTRNGMDSKDLSDDELAKRHLRFLVGGRSEVKDERLFMFEFPERPGALAKFLRTLRPSQNISLFHYRNYGGDVGKVLAGIQCPECEKEQLEAFLKDLGYPFTEETQSETYKTFLRR

SEQ ID NO: 31349 - protein, 535 aa, Oryza sativa Japonica Group
MDKSFIPRSKHHQDFTIIKEGNEHNKAERITEGTVGLRVNHVKYDGGWLAHWVYRWINPPCNGRLPPGSMGFPIVGETFQFFRTSPSIDMPIYYKRRLERYGPIFKTNIGGQHVVISLDPEVNQFIFQQEGKLFQSWFPETTLNIFGKKTLTTYNRTAHKLIRSFVCKLYGPENVKKSLLPELENSMRESLASWIGKPSVEVNDGVSNMIFGLAAKHLIGLDITNSGELKKNFQEIFQVMVSIPFPIYFPGTSFYRCMQGRRNVWTTLTNVMKKRLSAPGNKFGDLVDLIVEELRSENPTIDESFAIDTLSGLLFASFAPLSCTLTTTFKFLNDNPEVFDKLKEEHEMILKKREGANSGFTWEEYKSLKFSTQVVNEINRITTVIPGGFRKALTDVQVNGYTIPSGWLVMISPMGVHLNPKLFEDPLKFDPWRWTEEKRISMQRNFMPFGGGIRMCPAAEFNKLFITLFLHIVVTEYSHLKDSIVRLSCSSKLWFKGSPDGTLLEHHLLLLQVGFSAISLQHLLAALVYMLELNP

SEQ ID NO: 31350 - protein, 529 aa, Arabidopsis thaliana
  misc_feature (289)..(289): Xaa can be any naturally occurring amino acid
MEAEKWNSDGGEYTSEDEGTEDYRRGGYHAVRIGDSFKTGRYVVQSKLGWGHFSTVWLSWDTQSSRYVALKVQKSAQHYTEAAMDEITILQQIAEGDTDDTKCVVKLLDHFKHSGPNGQHVCMVFEYLGDNLLTLIKYSDYRGLPIPMVKEICYHMLVGLDYLHKQLSIIHTDLKPENVLLPSTIDPSKDPRKSGAPLVLPTDKDNTVVDSNGDFVKNQKTGSHRKAKLSAQGHAENKGNTESDKVRGVGSPVNGKQCAAEKSVEEDCPSTSDAIELDGSEKGKQGGKXGSRSSRRHLVASADLKCKLVDFGNACWTYKQFTSDIQTRQYRCPEVILGSKYSTSADLWSFACICFELVTGDVLFDPHSGDNYDRDEDHLALMMELLGMMPRKIALGGRYSRDFFNRHGDLRHIRRLRFWPMNKVLTEKYEFSEQDANDLSDFLVSILDFVPEKRPTAAQCLLHPWINSGPRSIKPSLKDENSDKLDTEKNKRENEEQEAVEVKMGNVVISSLDSKPGMSQSSSTLKLAI

SEQ ID NO: 31351 - protein, 159 aa, Staphylococcus sciuri
MKITIITVGKLKEKYWKQAVDEYNKRLGAYTKTELIEVADEKAPDNMSDKDIEIVKEKEADRIMSKIKQDSYVITLEIQGKMLTSEELSKEIDNLMTRGNSHITFIIGGSNGLHQKVLQRSNYALSFSKMTFPHQMMKVILMEQVYRAFKIMRGESYHK

SEQ ID NO: 31352 - protein, 528 aa, Issatchenkia orientalis
MSVIKAIAADVQRYVLLAYSHFQTFSLLQQTLLVISIPFLYSALWQLLYSFRKDRVPMVHYWIPWVGSAVVYGMQPYEFFENCRKQHGDVFSFLLLGKVMTVYLGPKGHEFVLNAKLSDVSAEDAYTHLTTPVFGKGVIYDCPNWKLMEQKKFAKVALTKESFIRYVPLIKDEMLKYFNANFRGDSGKTDVLKSQSEMTLFTASRSLFGDALRNRLDASYAEMYSDLDKGFTPLNFVFSYLPLPNYWKRDAAHKNISNTYLDLINTKRAGGEIKNEDLVDALLKNSVYKDGTRMTDEELAHLMIGVLMGGQHTSSATSAWFLLHLGEKPQLQEEIYREIQSVLGENFERELTYDDLQKLDLVNATIKETLRLHMPLHSIFRKVTRDLPVPNTSYIVPKGHYVLISPGYTMLSERYFPNASEFQPHRWDEIKSIDGGISLPAEGENAKETVDYGFGKISKGVASPYLPFGGGRHRCIGEPFAYTQLGTLLVHYIQNFKWTAKVPPIDYTSMVTLPTQPAEIKWERRQKN

SEQ ID NO: 31353 - protein, 348 aa, Deinococcus radiodurans R1
MRALSKQQPGEGIWMIETEVPTPGPNDLLIRIRKGSICGTDVHIYKWDDWASQTVPVPMVVGHEYVGVVAGMGSEVRGFEIGDRVSGEGHVTCGHCRNCRAGRRHLCRNTQGVGVNRPGSFAEYLVLPAFNAFKLPDDIPDDVAAIFDPFGNAVHTALSFDLVGEDVLITGAGPIGCMAAAVARHVGARNVVITDVNDYRLDLARQMGVTRAVNVAREDLWTVATQELDMHEGFDVGMEMSGSGPAFAQMVSVMNNGGKVALLGIPSGEVQIDWNAVIFKMLTIKGIYGREMFETWYKMAALIQSGLDLTPVITHHYGIGDFQQGFDAMLSGQSGKVILDWETEEQSA

SEQ ID NO: 31354 - protein, 353 aa, Issatchenkia orientalis
KLGETYVSCKVSAQITQPYEDRPFEGTFAISTEITAMCSPAFSNSNNTDFSTAAPAIVPATSVNVPSNEESNNNNNSNNGSGSGNQENQLSMGGGAVMGLAADQGATEILLGRLIEKGVRRSNALDLESLCIIAGQKCWAVRADVRFLNYDGNLVDAASIAVITALLHFRKPDVELVGSGEGTELIIYDEKQREMVPLSILHIPICVTFQFFSTESVERNIKGESLDSRSRSRQVKSNNGDEGDDDLMDVDYEANDGPRASNEVVIVDATSEEELLSQGSMTVTLNSNKELCQISKSGGLNVDSKKVLECCQIASKIVDKWTKQIKQVLADDEKKRRNPLIEKTLSTVNDRSS

SEQ ID NO: 31355 - protein, 643 aa, Clostridium acetobutylicum ATCC 824
MIVVSCKNIGKSYGIDKILENITFSINDGEKVGLIGPNGAGKSTLFKILTFQLEHDTGDLFIDKTKKLGYLSQHLDLDSNNTIYEELCTVFNDLLEIENKLKVLEIKMGEPYDPSKDEYHNKVIKDYTTYTELYSAKGGYTYKGLIGRVLTGLGFSNDYFDKKISILSGGQKTRVALCKLLLKNPEILLLDEPTNHLDLDAIEWLEEYLKNYKGTVILISHDRYFLDAITNKTFELINGHVNCFNGNYTKALDLKKKQYEIELKAYTLQQEDIKRQEKIIERFRSFNREKSIKAAESRQKALDKIERVKRPDKETGVTRIEFETLIKSGNDVLHVENLSKHFEDKTLFENLDMDIKKGEKIALIGENGRGKTTFFKILLDKIKSDSGIKVLGKNVFVGYYDQEQSDLHDEKTIIDEVWDDFPELTTTEIRNALAAFLFTGDDVFKIISTLSGGEKCRINLLKLMLSKNNFLLLDEPTNHLDIVSREALEDALLSYDGTVLVISHDRYFLNKVVSKILELKENGISEYLGNYSYYIEKKNNPTRFQEEEENKSLKTKTQINTEKKKKRENEKQKRVRKVELKNTEKEIADLEKELEDLQNKLCLEEVYSNPEKSVEVNNKITETQNTLDSLYEKWDELSSIMED

SEQ ID NO: 31356 - protein, 77 aa, Glycine max
  misc_feature (54)..(54): Xaa can be any naturally occurring amino acid
  misc_feature (64)..(64): Xaa can be any naturally occurring amino acid
MVIPDVSKANGTQLLVNDKSKYKSMLTRAYSSVWMTGGSVLIIYMGHLYITAMXVGIQIFMARXLFNLLTTAHEDRQ

SEQ ID NO: 31357 - protein, 178 aa, Thermoproteus tenax
MLRLPPGRKPPEEIYVFVEIPANSNVKYEYDDELGVIAVDRVLYTALVYPFNYGFIPSTLSEDGDPLDVALLSGAEFAPGVLVRARPIGLLEMEDEEGTDYKVIAVPIEKVDPSYADVKDIMDLTKPTLEKIRHFFERYKELEPGKWVKAKGYLGAEEAKKYIMEAVERFKRSQGSTP

SEQ ID NO: 31358 - protein, 1108 aa, Coprinopsis cinerea okayama7#130
MSALAAPSSFMNSDSLSSQSPPKPSSPIVVSPPYSTNRQPTRPFKNMGSVDLRGQLPFPTGPTISLDPPPGTTFAESLKAWTDNHVARWLSDMKCGMHAEVFRINDIRGDVLLELDQDTLKEMNIVSIGDRIRILNAVKLLRQRAAARTPSPIHVTRPTASHTRTGSENLSLEQGVASGRGHSRKESTRPPPITIHPNANKGDLPDLIREPPPDSASGRSMMAPPPVRPLPVPQNATPTASQVSTPGGSHRPNLPPLPPPPRGQPPPPPTTNRTPNRWNSSASEAPSQPLPPTPQNQGLLTPSNGSTWDSRSKPSRSTSPLPPPRGVRGPVAKASGAGVASPNNSPARRLGGHPYAMPSVQATLHPPTGLQNPNLSPIDEHFAAAGQNSSSTSTPSPPSQPYRSYTPANAYNTPSLDDIRKKIVKFVIPEEGTSYMIDVTNCSSGQEVIEKVLKKIGKGGFRGIDNDGHGDRDDGSLNVDGWAVYLASGEESPSEPLTETQLLNICNAPDHPARERGLAVRRLRRQEDRSGSPLARNLQPPTQPTSKATKRASSISILSGLGVRNPDKVLGDPPSPSNEAPSPPPPPLWQSGAGNAKRPSKLRNFFGQRPPSELITDHLPEFFPMAEKKVLRTARHSILLRSGTLKRQSALSGEKDEGEPIPRMSLSTDDGHSIDLHSDDDDDDIPLSASVAPRLLPPIETGSKRLSFMSELRSKRDRSDTASMMTVDEITAEVESRRVSKMPDMSNANDLEGWTKVENAASFDTAPTVPADEVEVDDDEATLATEDDEDEDEDDSDDDFGIAIPTRTNNKWIKGALIGAGSFGKVYLGMDASNGLLMAVKQVELPQGDGPSQERKKSMLSALEREIELLKVLQHENIVQYLYSSSDDEYLNIFLEYVPGGSVATLLSNYGAFEEPLVRNFVRQILQGLSYLHERDIIHRDIKGANILVDNKGGVKISDFGISKKVDDNLLGGNRLHRPSLQGSVFWMAPEVVKQTGHTKKADIWSVGCLVVEMLTGEHPWAQLTQMQAIFKIGSSARPTIPSDISAEAQDFLQKTFEINHELRPHAAELLQHPWLSKKGKKAAAAAAAAAAAASASAASSTNDSPSS

SEQ ID NO: 31359 - protein, 396 aa, Dechloromonas aromatica RCB
MNPHLAQLQPYPFEKLRALFAGVTPNPQYKEIKLSIGEPQHPTPAFIMDALANGLKGLANYPTTQGIPLLRQTIAKWCRHRYGLELNPETEILPVNGSREALFSFAQTVIDPSRGHVPLIVSPNPFYQIYEGAAYLSGAEPRFLNNLPDNDFAFDYASLSEEEWARVQLFYVCSPGNPTGKVLSLADWKTLFALSDKYGFIIASDECYSEIYFDEANPPIGGLQAAKLLGRTNERLVMFSSLSKRSNVPGMRSGFVAGDEKILKKFLLYRTYHGCAMAPPVQTASIAAWNDESHVLDNRNQYREKFAACTPLIGEVLGTGMPDASFYLWAKTPIADTEFARGLLEHYNVVVLPGSFLAREVRGVNPGANFVRIALVASLDECLEATQRIRQFAQQL

SEQ ID NO: 31360 - protein, 403 aa, Bacteroides fragilis YCH46
MNIHKIREDFPILSRTVYGKPLVYLDNGATTQKPRLVIDSIVDEYYSVNANVHRGVHFLSQQATELHEASRETVRQFINARSTREVIFTRGTTESINLIVSSFGEEFMQEGDEVIVSVMEHHSNIVPWQLLAARKGIAIKVIPMNDKGELLLEEYENLFSERTKIVSVTQVSNVLGTINPVKEMIATAHAHGVPVMIDGAQSIPHMKVDVQDLDADFFVFSGHKIYGPTGIGVLYGKEDWLERLPPYQGGGEMIQSVSFEKTVFGELPFKFEAGTPDYIATTGLAKALDYVTGIGLDPIALHEHELTVYAMQRLKEIPNMRIFGEAEHKSSVISFLVGDIHHLDLGTLLDRLGIAVRTGHHCAEPLMRRLGIEGTVRASFAVYNTKEEVDALVAGIERVSKMF

SEQ ID NO: 31361 - protein, 721 aa, Thermoproteus tenax
MAIIPILGLIIGLLGLLYAVYLARWVLSQDPGNEKMRFISNAIATGARAYLFRQYRTLAALLVVLAVAILAAIDIPRGLPGLTALGFVVGALGSMLAGYLGMYVTTRSASRVAQAAASGGMGKALQVSWRAGAVMGLSLASIALMLISGFYLIFSRITAEWAVPLVALGFGASLVTLFMRVGGGIYTKAADLGADLVGKIEAGIPEDDPRNPGVIADNVGDNVGDVAGMAADVYESYIVTVTASIFLAYILGLPSTYIKGIILFASLALLATFVGINSLRTKGVKNPMGSISTAVYVTIAVSIILFFVGALALGLPFVQAIAMASAVSLGAIIAPLVVKITDYYTSYSYSPVRRIAEQAKISPATVIITGYGVGLMSAVPVLLVIIGVLGISYIIGFYAFSSSITAGFASYGPYLAGIFGTALASVGLLIIAGIIITADSYGPVSDNANGVVEMAGLPDNVREVTDVLDSIGNTTKATTKGYAIASAALAALVLFIALMFEIMRSLSTLLHQPFTSLLGTSISEISIINPNVLIGAFIGVIIVYFFTSRTLGAVGRTAMEIVEEIRRQFKEKPGILEWKETPDYARVVDIATRRALGEFLLPGIVVIVVPLVTAFVLGWQALAGLIMGAVISGVPRALLMANAGGAWDNAKKYIELQGLKKTELHKAVVIGDTVGDPFKDTSGPSLNPLIKVLNTLSVVFAFAIILANTHMGIALSGLLHF

SEQ ID NO: 31362 - protein, 446 aa, Physcomitrella patens subsp. patens
MPPSTVQDDFPSTPGKVKMDKGNYFGRVTSRWHSSALAKLLCITSILLALTVSVFLWMSLPRGSQGYGSLKVQVFQRNHEWERKVIHSGSPNRNDNALTVLVTGAAGFVGTHVSLALKKRGDGVVGLDNFNSYYEVSLKRARQELLNKHGVFVVEGDINDKFLIESLFDVVQFTHVMHLAAQAGVRYAMQNPQSYIHSNIAGLVNIFEVCKATNPQPAIVWASSSSVYGLNTKVPFSEADRTDQPASLYAATKKAGEEIAHTYNHIYGLSITGLRFFTVYGPWGRPDMAYFSFTRDILKGKPISIYSGAGGKDLARDFTYIDDIVKGCVASLDTAEKSTGSGGKKSGPAMLRVFNLGNTSPVTVPTLVDILEKYLKVKAKRETIKMPRNGDVPFTHANISSAELQLHYKPVTNLDTGLKKFVKWYLSYYGDSSNRKLWPGNNEQTL

SEQ ID NO: 31363 - protein, 283 aa, Oryza sativa Indica Group
MQYQPLDSSGTDDDLPPTYQPRGPRVIFNGNGSLPQPNLHSNVDREIRQIEQQAYTGVLRAFKVQSDAITWEKESLITELRKELQISDKEHRVLLKGVTEEEAVCRIRQSRQTGGTQSSSHHSSVVHTPVPAKRQKKSHSVPVTPQAPVITMHAVVGKKLFYEGKGRANQGLLYQGGRQASDRVLKRLPSNNSPMLGSSRRRGRLHPNELIKRYSPLDGFGIPNTGNVVMEVEKVLSNPNMLEIEKAMKLLRDQEQSLLDAIARLDEASDGENEITALKIERR

SEQ ID NO: 31364 - protein, 301 aa, Salmonella bongori
INGFGRIGRIVFRAAQKRSDIEIVAINDLLDAEYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDTYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAMKAASEGAMKGVLGYTEDDVVSTDFNGEVCTSVFDAKAGIALNDNFVK

SEQ ID NO: 31365 - protein, 291 aa, Synechococcus sp. WH 7803
MIELVLSIGLAFIMLSLGLSLQPADFSRALGQPRALFGGALAQLVLLPLVAFSLLRLFGLTGDLALGVMILSCCPGGITSNVMTRLSRGDVALSISYTALASLVTAVTLPVVLSLTAPLLLPSPNLELSILPLSLKVFAISTMPVVIGVWIAQQAPGFCKRNRQKAERLANLLFLLIVAGTLISQWTVFTGNLTTIGPTLLTLNLVMLAIGLSLGHRLKLSTEQTTSLSIEAGFQNGTVGIVVGSLLGPELMQSQLNSFSLPSAVYGVLMTVTIIPFIAWRRSIQPLTTQS

SEQ ID NO: 31366 - protein, 550 aa, Glycine max
MWRPAMGSTSSYVSSSSSSSKWLGFVAAVWIQCISGNNYTFSNYSDALKSLMHLTQLQLNNLSVAKDVGKAFGLLAGLASDRFPTWAILLIGSVEGLIGYGAQWLVVSQRIQPLPYWQLCVFLCMGGNSTTWMNTAVLVTCIRNFRSNRGPVSGILKGFVGLSTAIFTTLCSALFADDPGSFLIMLSVIPFAVCLTGVFFLRETPPDVSAGDDDGEEVKYFGFFNVVAVAVALFLLAYGFIPSPSMLVSRLFVAVLVVMLASPLGIPVYSYLKGRLGGGNDVERQRLKEPLLQIPEKENEGVVAEEEAEIVKRAPEVGEEHTIVEALRSVDFWILFVSFLCGVGTGLAVMNNMGQIGLALGYPDISLFLSLTSIFGFFGRIISGTVSEFTIKKAATPRPLWNAASQLLMAVGYILLAMAMPGSLYIGSILVGMCYGVRLAITVPTASELFGLKYYGLIYNILILNLPLGSFLFSGLLAGILYDMEATTTEGGGNTCVGGHCYRLVFIVMTGACIVGFFLDILLSIRTKNIYTKISTSKKPKKSLGTSNRQ

SEQ ID NO: 31367 - protein, 370 aa, Clostridium acetobutylicum ATCC 824
MNFKKIFIISTVLGISISLANANNNFRVHAQTITTGLSSFVIKADGSLWATGTNEYGCLGDGTYIDKSTWEKVGDNFSDVECSCGYSLGIKKDGTLWACGINWSGELGNNEDRETKVANWKMVGSDFSQIACGAEHSLGIKKDGTLWACGSNQLGELGDGTTTDKYIWEKVGSGFSQVASQGDHSLALKKDGSLWSTGYNQFGELGDGTTTDRSTWEKVGDNFVQISCGKAFSMALKADGTIWAAGFNIYGQLGDGTTTSRSTWEKVGTGFSQISCGAVHSLALKKNGSLWATGNNENGQLGDGTTTDRSTWEKVGDGFCKINARNANTIAIKIDGSVWDCGWGYYGQLGNGNEYQRESLKEVLTGADIH

SEQ ID NO: 31368 - protein, 301 aa, Salmonella choleraesuis
INGFGRIGRIVFRAAQKRSDIEIVAINDLLDAEYMAYMLKYDSTHGRFGGTVEVKDGHLIVNGKKIRVTAERDPANLKWDEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVK

SEQ ID NO: 31369 - protein, 193 aa, Yarrowia lipolytica CLIB122
MGKAAKTRKFAATKRMIKATDPRLKKNKEDIEAQAAKKNKEEELVREVPRVSSALFFQYNEAIKPPYQVLIDTNFINFSIQKKLDIHRAMMDCLYAKANPIVTDCVMAELEKLGPKYRIALKLARDPRIKRLTCTHKGTYADDCLVNRVLQHKCYIVATNDQDLKRRLRKVPGIPLMGVGNKGYVIERLPDVF

SEQ ID NO: 31370 - protein, 238 aa, Oceanobacter sp. RED65
MDLATSEALRSRFEQVQHQINDACAQYKQNTVQLLAVSKRHSIEAIRAIHALGQQSFGENYVQEGVDKINALSDLAIEWHFIGPLQSNKTKDVAEHFAWMHTLERDKIAKRLSQQRPSHLPPLNVLIQINISQQESKSGISLQDLPALAQQVNDYDNLCLRGLMCIPAPQDEASLTQDFCSMFQAFEKLKQQYSTVDTLSMGMSGDLELAIEQGSTMVRVGSAIFGPRDSIISNENNL

SEQ ID NO: 31371 - protein, 106 aa, Synechococcus sp. WH 7803
MVMAVETPSRTPGGAAVLEKAPERVRKQSPRYKVLLHNDPVNSMEYVVSTLRQVVPQLSEQDAMAVMLEAHNTGVGLVIVCDLEPAEFYCETLKGKGLTSTIEPEN

SEQ ID NO: 31372 - protein, 301 aa, Salmonella enterica subsp. indica
INGFGRIGRIVFRAAQKRSDIEIVAINDLLDAEYMAYMLKYDSTHGRFDGTVEVKDGHLIVNGKKIRVTAERDPANLKWNEVGVDVVAEATGIFLTDETARKHITAGAKKVVLTGPSKDNTPMFVKGANFDKYEGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVK

SEQ ID NO: 31373 - protein, 272 aa, Oceanobacter sp. RED65
MTTIAFIGSGNMAGAIMGGLIEDGYQPDNIIASDPSEEKLAELKQRHGIQTTQNNIDAIKRSDVVVLAVKPQVMEQVLEPLKATLEETQPLLISVAAGINQYSLQQWAGDLAIVRCMPNTPSLVGKGASGLLANDKVSDQQKSITEDILGAVGLSVWVNNEQQLDWVTAVSGSGPAYYFLFMECMIQAAKNMGMDEEQAKKLTLQTALGAATMAQKSDVEPDQLRKNVTSPNGTTEQAILSFQNAGLDKIVKDAMEAVVKRSEEMVKELGAK

SEQ ID NO: 31374 - protein, 684 aa, Gibberella zeae PH-1
MLRPGTPLTLLLFAAFALLLLAVISTPIIEAIPLSDFGGVTYGVFGYCQNGKGCSGIGVGYDTAKLAGDNSQAFDLPSGVRNTLSAILIVHPVAALITLVMTIMAAVSHLHGPSHSTRYLLILFIFLFIDFLVCLLAFLIDVLLFVPHLAWGSYLVLAATILVAMSGLVTCAMRRTLVSRKDRQRRIADNAEMSGQNYYNRTAQDKTAAEDGITRQPTLPTQPVGNSVHDNIPAFATFDQKNRSDQISEEVPLTRRATSNRSPGVPHEPVNVGEAAAFNRTPQRQGSQDQFGNPIDNGIDPYAGRRGPSPSMSNRGRGNGGYRGGRGGYGRGGYDNYGAPMRGRGGYGTPGRGGYGPRGGRGGSGPPGRGAYGPGGMRGGPGPSGHSNGPYDRRPSPGQNYASDFQPSEPSNGYSSTNPSMPSLNTYTAYRPESELPRAESPPPLPGTEPATIGGRPVEMDASPAVHGHQGGNYGQLRDSDVDVAGMVGLQQGQIPQRNDTIMSEGSKYSNDEQYAPPRAAWNQGDGRNSPKAPPPLATSHPLGRNTPPVTQQPAVMGNSNYYEDVDPRFAPEASLSNNNLQPPPIEPIYEDVHANNAGARSPAESEHSTFTSISQRGINPRWNPGPPPPMPYQQGPPHRRPVHQQQQQRQDMLLDTPDFQLPSSRSGRGPGMVPGSAYPPGGF

SEQ ID NO: 31375 - protein, 264 aa, Oryza sativa Indica Group
MAAAAVDPMALGLGTSGGGGGGGGESAVGGDGAEPVDLVEHPSGIVPTLQNIVSTVNLDCRLDLKKIALQARNAEYNPKRFAAVIMRIRDPKTTALIFASGKMVCTGAKSEDHSKLAARKERLLFTSCREKLFTDPIFGFCWNWLLMNNFYADYLLAQYARIVQKLGFPAKFKDFKIQNIVGSCDVKFPIRLEGLAYSHGAFSSYEPELFPGLIYRMKQPKIVLLIFVSGKIVLTGAKYRKEIYAAFENMFPVLTEYRKTQQRW

SEQ ID NO: 31376 - protein, 469 aa, Candida glabrata CBS 138
MSALLRALPQVSRTALRGRLVTPMTLRLYASFPPHTVIGMPALSPTMSQGNLAVWSKKEGDSLAPGDVLAEIETDKAQMDFEFQDEGYLAKILVPAGTKDVAVSRPIAVYVEDEADVAAFKDFTVEDAGGSQSSSAPAAEEQKEEPKKEEVKEEKSEKKAAKSNSTPSSVASGDRIIASPLAKTIALEKGIALKSVKGTGPRGRITKADVEKYLESAPKSTSTAAPSATPSTTGGASYEDLEITNMRQIIGDRLLQSRQSIPSYIVSSDISVSKLLKLRKSLNATAKDQYKLSINDILIKAVTVAARRVPDANSYWLQNEGIIRQFKNVDVSVAVATPTGLLTPIVKNAESKGLIEISKEVKELASRAKINKLVPEEFQGGTICISNLGMNPAVSMFTSIINPPQSTILAIGTVKRVAVEDAGAENGIAFDDQVTITGTFDHRTIDGAKGADFMRELKTVIENPLQLLL

SEQ ID NO: 31377 - protein, 535 aa, Ralstonia eutropha JMP134
MATRARPVFLHSPHSQTRRATQARRPAQEIPMTAPYNDSADVIHFVSGELYAGSGTRSQAVFNPATGAVARQLRLGTVEDVDAAVASALAAFPKWADTPPIRRARVMLKFLELMNQHKDELATIITAEHGKVLSDAAGEVSRGIDIIEFACGIPQLLKGDFTDQVSTGMDNWTLRQPLGVVAGITPFNFPCMVPCWMFPVAIAAGNCFVLKPSERDPSASLFMAKLLKRAGLPDGVFNVVQGDKIVVDALLHHSDVKAVSFVGSTPIANYIYETGARLGKRVQALGGAKNHMVVMPDADIDQAVDGLIGAAYGSAGERCMAISVAVLVGDVADKIMPKLEARARELVIRNGMDPAAEMGPVVTGQALERIENYIALGVEEGAKLVVDGRNYKVPGHEQGFFTGGTLFDNVTPDMRIYKEEIFGPVLSCVRVDDFAQAVKLVNDHEFGNGVACYTRDGQVAREFARRIEVGMVGINVPIPVPMAWHGFGGWKRSLFGDMHAYGEEGVRFYTRQKSVMQRWPEDVTRGAEFAMPTAK

SEQ ID NO: 31378 - protein, 378 aa, Cucurbita maxima
MHVVTSTPEARHDGAPLVFDASVLRHQHNIPKQFIWPDEEKPAATCPELEVPLIDLSGFLSGEKDAAAEAVRLVGEACEKHGFFLVVNHGVDRKLIGEAHKYMDEFFELPLSQKQSAQRKAGEHCGYASSFTGRFSSKLPWKETLSFRFAADESLNNLVLHYLNDKLGDQFAKFGRVYQDYCEAMSGLSLGIMELLGKSLGVEEQCFKNFFKDNDSIMRLNFYPPCQKPHLTLGTGPHCDPTSLTILHQDQVGGLQVFVDNQWRLITPNFDAFVVNIGDTFMALSNGRYKSCLHRAVVNSERTRKSLAFFLCPRNDKVVRPPRELVDTQNPRRYPDFTWSMLLRFTQTHYRADMKTLEAFSAWLQQEQQEQQEQQFNI

SEQ ID NO: 31379 - protein, 288 aa, Candida glabrata CBS 138
MLRRQARERREYLYRKAQELQETQLQQKRQIIKQALAQGKPLPKELAEDEQLQKDFRYDQSMADNEDEAGVDDEYSASSGIVEARVIVTTSRDPSSRLAQFAKEIKLLFPNAVRLNRGNYVMADLVSACKKSGTTDLIVLHEHRGVPTSLTVSHFPYGPTAFFSLHNVVLRHDILNRGNQSEVNPHLIFDNFTTPLGNRVVTILKNLFPPGPKKDSSRVITFANRGDFISVRQHVYVRTKDGVEMAEVGPRFEMRLFELRLGTLENKDADVEWQLRRFVRTANRKDYL

SEQ ID NO: 31380 - protein, 159 aa, Staphylococcus sciuri
MKITIITVGKLKEKYWKQAVDEYNKRLGAYTKTELIEVADEKAPDNMSDKDIEIVKEKEADRIMSKIKQDSYVITLEIQGKMLTSEGLSKEIDNLMTRGNSHITFIIGGSNGLHQKVLQRSNYALSFSKMTFPHQMMKVILMEQVYRAFKIMRGEAYHK

SEQ ID NO: 31381 - protein, 91 aa, Coprinopsis cinerea okayama7#130
MYGFGDDRNPSNDTVNVMEEILIEYITDVCQVAGANSRRARLSVEDLRKALSHPADAKKLARLEELIFMQEDIKRARGMFDEAEIQNPKQY

SEQ ID NO: 31382 - protein, 496 aa, Oryza sativa Indica Group
MDAAATRVSTRLRRSTQTHAAYTVHVADRRVIALVTAHPAYARRWVHTTRWLHHRLLRSGRLLVGLGVQWTPLRRPLHRGSPPPPPATLQLCVGHRCLVFHLAHADAIPAALRRFLADPRITFVGSGASNDRRMLSAYYDLHVASARELRAVAAMGNASMEAMADRFLGYPGIAKPTNVSMSAWHAPYLSIEQVEYACVDAYLAFRLAVHLCPAPARQPVLRAPPPPPPAPRAPVYHHPLPLGPRVAVLAAPAPRPARHAPVRARVAPPVYRAVARAEPAAAQTHWALVATAVDDDASESEYSSKITDNVRPRVAASDSDIEEEDDDGLSMIHSSSYASDDHVFSSDDFELVGHGLLSSDDEDGYEDFVLGMGALNIDIDDDDDYNGNTGSIGILTVQSYNEHSSIGILTVENYDMAGTEEMFVRNGVATLEELEEDDIVTGAGTVTVDEGGGGYEAFEGNSQAFDDVEEGGYVEDDWYDEDEEELLDYDTSGGFY

SEQ ID NO: 31383 - protein, 289 aa, Dechloromonas aromatica RCB
MKKVRKAVFPVAGMGTRFLPATKASPKEMLPIVDKPLIQFAVEEAVAAGITDMVFVTGRSKRSIEDHFDKAYELESELQARGKDELLDFVRNMIPKNINCIYIRQAEALGLGHAVLCAKPVIGDEPFAVILADDLLDGKPAVMKQMTDTYDYYRCSVLGVQDVPRADTRSYGIVDARPVAERVEQVNAIVEKPKPEDAPSTLAVVGRYILTPRIFHHLENVKPGAGGEIQLTDGIASLLSEEQVLAYRYHGTRYDCGSKLGYLQATVVFGQRHPEVGPAFDAYLKTLGG

SEQ ID NO: 31384 - protein, 534 aa, Acidovorax sp. JS42
MILESQLNPRSADFQANAAAMRAVVEDLRAQIERVSQGGGEAARAKHVARGKLLPRERVEMLLDPGTPFLEIAPLAALNMYGNDAPGAGLIAGIGSVAGIACMIVCNDATVKGGTYYPMTVKKHLRAQEIAQQNCLPCIYLVDSGGANLPNQDEVFPDRDHFGRIFYNQANMSAQGLAQIAVVMGSCTAGGAYVPAMSDETIIVKNQGTIFLGGPPLVKAATGEVVSSEDLGGGDVHTRLSGVADHLAQNDLHALSLARGVVKNLNRNQPVASADQAPVAPKYAAEELYGVIPVDTRKPFDVREIIARIVDGSAFDEFKARYGNTLVCGFARIEGMAVGIVANNGILFSESAQKGAHFIELCCQRKIPLVFLQNITGFMVGRKYENEGIARHGAKMVTAVATANVPKFTVIIGGSFGAGNYGMCGRAYSPRFLWMWPNARISVMGGEQAASVLATVKRDGIEGKGGSWSMEEEEAFKTPIRRQYEEQGHPYYATARLWDDGIIDPADTRRVLALALAASRHAPIEDMKFGVFRM

SEQ ID NO: 31385 - protein, 232 aa, Zingiber officinale
YHPNIVKLRAAYEDADAVHLVMELCEGGELFDRIVARGHYSERSAAAVLRTVAEVVRMCHANGVMHRDLKPENFLYANKKENSPLKAIDFGLSVFFRPGERFSEIVGSPYYMAPEVLKRNYGPEIDIWSAGVILFILLCGVPPFWAETEQGVVRAILRGMIDFQREPWPPISESAKSLLKQMLNPDPRRRLTAQQVLEHPWLQNAKKASNVPWGDIVRARLKQFSVMNRFKK

SEQ ID NO: 31386 - protein, 301 aa, Escherichia coli
INGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVK

SEQ ID NO: 31387 - protein, 584 aa, Clostridium tetani E88
MQKTKMVFTIGPASDSEEVLSELIKAGMSASRHNFSHGTHEEHKIRIDLIRKLSDKFNKNIAVILDTKGPEIRTGDFKDKTVQLKEGNKFTIYCGEEILGDETKCSITYNDLHNDVKTGDSILIDDGLVGLEVEEVEGSKVHCVVKNSGAVSNHKGVNVPGVDVSLPSLTEKDKSDLEFGCKVGVDFIAASFIRKGSDVLEIRKVLEENGGTDIQIFSKIENQQGVENIDEIIKFSDGIMVARGDMGVELQMEQVPIIQKMIIEKCNKAGKPVITATQMLDSMIRNPRPTRAEVSDVANAIFDGTDAVMLSGETAGGKYPIEAAKAMAKIARTAEETMDYDEIFNRKREARVLSVANAISIATCTTASELNASAILTATQTGYTARAVSKYRPACPIIAITPSKNVARKLALSWGVFPILTTKFTSTDALIENSVDIALTAEYIRKGDLVVIAAGIPVSYSGTTNMLKVHVVGDILVQGRGAGNSAGYGIAKVVNSTEEAERVIESGDILVVKDADIDYVSILNRVSGVITERGGLTSHLAIECITNEIPFICGAGGATDVLKSGYFITMDVKRGIVYNGRITI

SEQ ID NO: 31388 - protein, 580 aa, Burkholderia xenovorans LB400
MRMQIGAFLARRLTEAGVRHLFGVPGDFNLSFLEQIQEADGIEFVGNCNELNAAYAADGYARTSGIAALVTTFGVGDLGAIGGIAGAYAENVPVVHITGTPPLHAVNSRALVHHTLVNGDYDNIGRCMSEFTVAQTRITPANAAFEIDRVLRSCWLERRPVHLQLPSDVTHVVVEVPEAPLMLADPSSDPHQLREATRRIVEALASARFPAIVVDADADRFGVTELVQKLAEKCSIPCASLTPAKSALNETSRHYVGTYVGAASAEPVRSIVENADCLIGVGLRFTDTSTALFSQHFNPEAFIDLRRHDLSLGTTQIPGVTLRDVLARVVDDAQPVVRERATQALAAASDALPASSGNVPLTHAALWPRIRRFLKPRDVILGEAGTSHASLSAMKLPPGATYIAQPIWGAIGYTLPALFGSLVGTPSRRHLLFIGDGSFQLTAQELSSILRRDLKPVIFLLNNSGYTIERLILGEHSAYNDVANWHYAGLPHAFDRRERALSLVVETVADLEAALNRAESAEHLVFIELKLPMMDAPESLKKFADIFADFDYGERGPRNPSKLVASEAPAHGHSLTDETA

SEQ ID NO: 31389 - protein, 727 aa, Nostoc punctiforme PCC 73102
MYLIKRRHFIQFASSTFATLGLSQIDIMQKGNRYAQVLSQSTPRKLALLVGINNYLNNERGDNLRGCITDVDLQEKLLTHRFGFEPNNILKLTSDPADKQPTRKNILEAFEEHLIKQAKPGDVVVFHFSGHGSRLPDPDPIQQCRNDNYNSTLVPSDDGANGVTQDIMGRTLFLLISALKTENVTVVLDSCFSGGGTRGNFIVRAASNDNLQPSPEEIAYQEHWIKQLNIPLEKLISLRCASERKGIVFAAAKREQIAADATFDGFSAGAFTYLMTQYLWQQTGSAGSMISQITSSIKSLSRQEPLIDGDENKPVYFIKNKVFPTDAVVIKSEGKKATLWLGGIDKESLEAFTPGATFTVINNQGQTSATVKLISPRRGLIAEAELVDNRGINSLRPGMLLQESTRVIPADLKLSIGLDPSLAGDTNAAKEFVEAINRIAAITAQNQKPPYPNGVQYIFSRMTDSYRRQLQQQVTENLPVVNSLGLFTAGQELVLQSFGDAREAVKDAVQRLEPKLKSLLATRILKKTLNTNSSELDVEVCLNLVEQPSKIIAKTATSRSQKNRQVSQKIYSHKLPLQQLFQFQVTNNESTSVYISILLFDSSGDLLVIFPYKWSAPEESMQLAPQQTLVVGNPQELKLQAIEKGSGEALIIVSRKPLKNAVKTMRALAAEQKRDAGVVELKGSSTSPDEVIGDLLNDLRDVRGGGIVATPVSNSDMATLSIAFEVN

SEQ ID NO: 31390 - protein, 527 aa, Debaryomyces hansenii CBS767
MSKDHKDKKRKHSDEATEEVEKKTKVSKKEKKDKKEKKEKKDKKEKKDKSEKKDKSEKKEKKEKKESEDVPTKSSAVVSTGYSQSPALTKLPQSEIDSFLQENEVTVEDPHNLGLRPLLGFDQIDLDSRIASVISKFPTPTPIQAVSWPYLLSGKDVIGVAETGSGKTFAFGVPAINNILTHDKKGLKVLCISPTRELALQIYDNLVDLTANTPLKCVAVYGGVSKHEQVSSLRNASVVVATPGRLIDLLNDGALSLDSIEYLVLDEADRMLEKGFEQDIKSVMQQTNHANRQTLMFTATWPKEVRELASTFMNSPVKVSIGDRNELSANKRITQIVEVIEPYDKEKKLLSLLRKYQSGSNKDDKVLIFALYKKEATRIENLLVRNSFKVSAVHGDLSQQQRTSALGAFKAGKTTLLLATDVAARGLDIPNVKVVINLTFPLTVEDYVHRIGRTGRAGQTGIAHTLFTEHEKHLSGALMNVLRGANQPVPDELLKFGGHTKKKAHSAYGAFFKDVDMTKTAKKIKFD

SEQ ID NO: 31391 - protein, 235 aa, Triticum aestivum
  misc_feature (214)..(214): Xaa can be any naturally occurring amino acid
MASPSSSLCSSLGYPRAASLGARRRAGFSSSRKLFQVKASRVDSFSKSDIIVSPSILSANFAKLGEQVKAVEVAGCDWIHVDVMDGRFVPNITIGPLIVDALRPVTDLPLDVHLMIVEPEQRIPDFIKAGADIVSVHCEQTATIHLHRTVDQIKSLGAKAGVVLNPGTPLSAIEYVLESVDLVLIMSVTPGMGVQSSIESQVVNIADLRKLCEXKGVPSWIEVDGGLSPCTPTGH

SEQ ID NO: 31392 - protein, 497 aa, Burkholderia xenovorans LB400
MADIRILSEVETFLARQHRQYIDGQAVAAMDTVATDIINPSNRKVVASVRQATPAQVQHAVASAHEAFTGVWQQTSAARRGELLNRLADLMQAHREELAQIESLSSGKLIGLSRAFEIDYSIAFLRYYAGWATKIHGQTMNLSLPSSNGEQYTGFTLRQPIGVVAGIVPWNFSIMIAVWKFGSALACGCTAVIKPSEFTPLTMLRVAELALEAGIPPGVLNIVNGNGRTVGTALIAHPKVAKVTFTGSVPTGVGVGVAAMQAGLKHVTLELGGKNPAGFLRDFPVERTVDGIIEAAYLHQGEVCASAERFYVHRSRIDDVLEALHHTLATLKIGSALDESAQFGPLANAAHFAKVMAFFEKARAQDGEIVHGGTVAPGDGFFVQPTAIPARSQADTIMTEETFGPVASFLAYDDEEEMLHYMNDTHFGLTASIWTNDLSKALRFVPRVEAGTVWVNMHNYIDPAMPFGGVKSSGIGREFGEAFIEYFTELKSVIVRY

SEQ ID NO: 31393 - protein, 277 aa, Synechococcus sp. WH 7803
MRLAFLGPEGTYGERAAREMLTLEGIPDGELVACTGLRAVVEHVADGRCDGAVVPVENSVEGGVTASLDALWSHRDLSIRRAVVLPIRHALLSSGSLQDIKEVLSHPQALAQCSGWLATHLPGALQLPTSSTAEAARMVRGSRFRAAIADRAVGERLELQQLAFPVNDVAANCTRFLLLQRGKRLREGDVASLAFSLHRNAPGALIEALQAIAGLGLNMSRIESRPSKRELGEYVFFVDVELPKGKASEILDALEAHLQPLCEHLSQFGAYPSSDLT

SEQ ID NO: 31394 - protein, 508 aa, Chromobacterium violaceum ATCC 12472
MSKKQDAPELRRSLQARHLSMIAIGGSIGTGLFLASGATISGAGAGGALLAYALVGLMVYFLMTSLGEMAAFMPVSGSFQAYGSRFVDPAFGFAQGWNYWYNWAITVAVELAAAAIIMNYWYPGIPGVVWSGGFLAIIFALNYFSVKGFGEAEFWCSMLKVATIIAFIVIGFLMILGIMTEPNPSRIAPGLQVMMQGEGPFVGGLAAFVGVAMVVGFSFQGTELIGVAAGESANPGRTIPRAVRQIFWRILMFYMLSILIIGLILPHNDPSLLKNDMKDVGASPFTLVFNRAGLAFAASLMNAVILSAILSAGNSGMYASTRMLYAMAKNGMAPKVFGKLTDNGVPRNALYATTLVACLCFLTSLFQSNAVYMWLLNSSGMTGFIAWLGVAISHYRFRRAYVKQGYSLDDLPYKAKWFPLGPLFAFALCLLIMLGQNYTAFTAAKVDWNGVIATYLGIPLFLALWWGYRVKHNTRMVPLEKVELAEAHRNALMQREENRGGKPAAAQA

SEQ ID NO: 31395 - protein, 223 aa, Picea sitchensis
MSYWKSKVLPKIKKYFDKPSKKKAASEACITFEASKESIEKEIQEKQEELQPKVLEVYKSIDAETKIIVKNPTANAIKKQPKPVQKLLEELVKIGFPGASQANEAASKYGPVLVLGPVTYILQKTSTFIAEDVEAEAPPTEAVAEVNAVEAAAEPIKEAETSVETIVEEVKTDEGVVVEKVKTDEGIVVEKVEKEEETTTEDGKKVVTVEVTETVIEPEPAKA

SEQ ID NO: 31396 - protein, 481 aa, Populus tomentosa
MVKICCIGAGYVGGPTMAVIALKCPSIEVVVVDIWEPRIAAWNSDQLPIYEPGLYDVVKECRGRNLFFSKDVEKHVAEADIVFVSVNTPTKTQGLGAGKAADLTYWESAARTIADVSKSDKIVVGKSTVPVKTAEAIEKILTHNSKGIKFQILSNPEFLAEGTAIGDLFQPDRVLIGGRETPEGQKAIQALKDVYAHWVPEDRILTTNLWSAELSKLAANAFLAQRISSVNAMSALCEATGADVAEVSYAVGKDSRIGPKFLNASVGFGGSCFQKDILNLVYICECNGLPEVAEYWKQVIKINDYQKSRFVNRVVSSMFNTVSQKKIAILGFAFKKDTGDTRETPAIDVCQGLLGDKALLSIYDPQVQKEHIQRDLIMKKFDWDHPLHLQPKSASSAVEQVTVTSDAYEATKEAHGVCILTEWDEFKTLDYKKIYDNMQKPAFVFDGRNVVNADKLREIGFIVYSIGKPLDAWLKDMPAIA

SEQ ID NO: 31397 - protein, 271 aa, Picea sitchensis
MGDCDELSGFLSSAVEVAKRAGEMIATNFYKEKSVEHKGKVDLVTETDKACEELAFQFLKQKYPEHKFIGEETSAVHGTDDLTDAPTWIIDPVDGTTNFVHRFPFVCISIGLTIGKVPTVGVVYNPIIGELFTAIRGRGAFLNGSPISSSSQTELGSALLAAEIGTKRDKETVDITTNRINGLLFKVRSLRMSGSCALNLCGVACGRLDITYELGFGGPWDVAAGVVIIQEAGGCVFDPSGDEVNIMSQRIAASNGYLKEEFLDELKASCV

SEQ ID NO: 31398 - protein, 304 aa, Oceanobacter sp. RED65
MRFAMPLSRDDAFNVARVLSEALPYIQQFVGKTIVVKYGGNAMTEEALKNSFARDMVMLKLIGINPIVVHGGGPQIGDLLEKLKIESHFVNGMRVTNSEAMDVVEMVLGGLVNKDIVNLINQNGGHAMGLTGKDGHLIEARKLKVTQQTPEMQKPEIIDIGHVGEVAHINTSVLSMLTESDIIPVIAPIGVDDKGESYNINADLVAGKVAEAVKAEKLLLLTNIEGLKDKEGHILTGLTTTQVDDLIADGTIYGGMLPKIKCALDAVKAGVNTAHIIDGRVRHCTMLEIFTDEGVGTLITNQDD

SEQ ID NO: 31399 - protein, 483 aa, Oceanobacter sp. RED65
MVMIYPIILAGGMGTRLWPLSREEYPKQCLPLNDEHWSLLQQTLLRTQGLQDCAPITVICHEQHRFLVAEQCLQTGVKHFPILLEPEARNTAAAIASAVAFLLAQDSVKADKDAVFCCLPADHAIEQSDAFITSLNQAVQLAREYSQSLLTLGIEPTSAHTGYGYIQAGEPVSTEEYPKAGFKVQHFKEKPDAQTAQSYLEQGNYYWNAGIFMGTACAWQSAFTVYQPELWQHAKNTLQQAQADLDFLRLSSEQYSLLPCMPFDVAIMEQLSNAFMVSLDAGWSDLGEWQALWQQSKKDEWGNHIHGDGLLLNSSNNYVRSERLVAGVGLENLIVVDTDDALLVADRSQSQHIKKLVDKLSEQGRSEHLHHQREYRPWGYFQSMDVGKGFKVKRLFVKPGHGLSLQSHQHRSEHWVVVSGTATVTRGEQSFTLVANESTYIPSTVTHSLRNEQGHPLEVIEVQTGKYLGEDDIKRFSDRYGRA

SEQ ID NO: 31400 - protein, 218 aa, Physcomitrella patens subsp. patens
MAELLVVRHGETSWNVLGRLQGHAESDLNEAGKKQAQAAAEKLASMGLEFAAIYSSDLKRALDTAQAIADKCQCSNVIVRENLRERCLGDLEGLTRSEARTAAPEALKAFMKNNDFLPIPGGGESLEQLCVRVQNAFEQIASGSLGKRVVVVTHGGVLRTAHILATGLPCSGKVVNASINVFRISDEKDWTITCWGAASHLQDIGFLDTGFGGDKLSG

SEQ ID NO: 31401 - protein, 259 aa, Haemophilus ducreyi 35000HP
MIKDTQSTAENQANETTHFGFKTVAKEEKQQLVANVFHSVAAKYDLMNDLLSFGIHRIWKRFTIDCSGVRKGQKVLDLAGGTGDFSAKFSRIVGETGQVVLADINSSMLEVGRDKLRNLGVVGNINYVQANAEHLPFADNTFDCVVISFGLRNVTDKDKALKSMYRVLKPGGRLLVLEFSKPIFDPISQLYNFYSFNILPKVGGIVVNDAESYRYLAESIRMHPKQDELKTMMEHAGFESVNYYNLSAGIVALHRGYKF

SEQ ID NO: 31402 - protein, 283 aa, Chlamydomonas reinhardtii
MASGLQSPEELQENLRQYKEQLAQVEQLLMMGSDEEMPGQDLQDMYQSLSEVIQLTEELLKDALEQQRAAGAAVAVADQIRKAQVRAALTGQAPAEWAIGAQCQAVYSADGQHYDATVEAISAAGNFIVVFEGYGNKEEVGLTGIRPRPGADEGYKGVAAPKRKRVEDEPVVNEIPKWLAIKETDDEKTKARKKKLLKSMKSKIRFQQKDLAQKQKQDSWQSFLKGKGSKKKTGFLTGSIKKGSIFSVPEGVNAKVGVVGSGRGMTEYGKKSRHEFEEADEEQ

SEQ ID NO: 31403 - protein, 488 aa, Ralstonia eutropha JMP134
MIQTQLYIDGRWQSPLEGSTRDILSPADESVIAQAAEGTRADARIAIAAARRAFDGPWRQTTIRDRARLLNRIAALIDRDAEELARFESLNTGKTLTESRTDMGDIAATFRYFAGLVASESGAVNEAPHHVISRTLREPVGVCGLITPWNYPLLQAAWKIAPALGAGNTVIIKPSNLTPLTTHHFTKLIAELDLPAGVFNLVTGGAEVGAELAESRDVDLVSFTGGAFAGESIMKAATGNFKRIGLELGGKNPNIVFADADLDVAVDYALNAAFFHAGQVCSAGSRLMIEDSIYDAFVAKLAERLPRIAIGNGFHAETQMGPVQSAQQHEKILRMVQAGVAEGARLVYGGKRPEGDVYRKGYWLQPTLLADVTADMNIAKDEIFGPVVTAERFRSEDDALRAANDTPYGLAAAVWTRDLDKANRMSRALRFGTVWVNDYHPYFPEAPWGGYKASGIGRELARIGLDEYTELKHSYINLAPKAMGWFGA

SEQ ID NO: 31404 - protein, 270 aa, Gibberella zeae PH-1
MPKPKNKTTKPGKVEVSALPPQAPPSWPVFKPPLPVVELAPEPHPLTSKVVLIPSFFPRSLCRDYVAFLKTLPLQTTPGRPKRGEAVRVNDRFQVDSQDFATRLWEQTGLKEALLQGDVEEKWGGEPVGLSPNIRIYRYSKGQFFDCHYDDSNNLTLPLDPPMPVKTTWTLLLYLTSTAEGCVGGETVFYPRDRRSLREEIAVPLDTGMLLLHKHGDDCLLVISPLPLSFYHARHGSQNSDHRLTIISSFSMKDEKSLQARNGSSGLIFA

SEQ ID NO: 31405 - protein, 454 aa, Haemophilus ducreyi 35000HP
MTITTPIKAVLASNQHFLDRQDKMESNVRSYPRKLPFAYAKAQGCWVTDVEGNEYLDFLAGAGTLALGHNHPILMQSIKDVLDSGLPLHTLDLTTPLKDAFTEELLSFFPKDEYILQFTGPSGADANEAAIKLAKTYTNRGNIIAFSGGFHGMTHGALSLTGNLGAKNAVQNLMPGVQFMPYPHEYRCPFGIGGEAGAKAVERYFENFIEDIESGVVKPAAVILEAIQGEGGMVPAPISFLQKVREVTQKHGILMIVDEVQAGFCRSGKMFAFEHAGIAPDIVVMSKAIGGSLPLAVLAIKKQFDAWQPAGHTGTFRGNQLAMATGYASLKIMRQENLAQNAQARGEYLTNALRELSKTFACIGNVRGKGLMMGIDIVDERQAQDATGAYPQDCELAIAIQKCCFNNKLLLERGGRGGNVVRVLCPVNINQAECEEFIKRFTQSVADAIKAVRG

SEQ ID NO: 31406 - protein, 459 aa, Kluyveromyces lactis NRRL Y-1140
MNSSGYIPPWTTPYVIGIGGSSGSGKTSVATKLVTRINTPWTVLISLDNFYKPLTVEERKQAFENNYDFDKPDSIDLDLAYQCILSLKEGKKVKIPTYSFTDHDRIPNKFLTIYGASVIVIEGIYALYDQRLLDLMDLKVYVDADLDICLARRLTRDIISRGRDLHGCIRQWEKFVKPNADRFVKPTMKAADAIIPSMSDNSIATEMLLNHIQSKLQLKSQQHLAELQKLESYAVSIDSLNIIHKLRQTNQVKALQTILLDKSVSRDDWVFYFDRLATILLSFALDDIPTKLKTTKVITPTGKQLDNPVFVDFDRVTAINIVRSGDCFMRSLRKTIPSVAVGKLLIQSDSRTGEPQLHSLFIPPMIENYNQVLLMDAQIISGAAIIMAIQVLTDHNVDLKKIKVVVYLATETGIRRIVNATNNQVEIYAGEIISDDKIRTNQCNWARKRFVASNYFGCK

SEQ ID NO: 31407 - protein, 266 aa, Dechloromonas aromatica RCB
MSITIKTPEDIEKMRVAGRLAGEVLDYIEPFVKPGITTGELDKLCHDLMVNEQGCIPAPLNYAPSGYAPYPKSICTSVNQQVCHGVPGERVLKSGDIINLDITTIKDGYHGDTSRMFVVGEGSIQAKRLCEITFDCMWLGISVVKPGAFLGDIGAVIQKYAEKSGYSVVREFCGHGIGKKFHEDPQVLHYGKPGTGPKLEPGMIFTIEPMINAGKAAIREMADGWTIVTKDRSLSAQWEHTVLVTETGYEVLTLSAGCRPKPDWIA

SEQ ID NO: 31408 - protein, 163 aa, Coprinopsis cinerea okayama7#130
MVLLTTSDNEQFNADREVVERSVLIKNMLEDVGESDQAIPLPNVSSAVLKKVLEYCEHHRGEPLPSADAEQNQDETRKRTTDISEWDQKFISVDQEMLFEIILAANYLDIKSLLDVGCKTVANMIKGKTPEEIRKLFNIVNDFTPEEEAQIKKENASEWAEDR

SEQ ID NO: 31409 - protein, 340 aa, Klebsiella pneumoniae subsp. pneumoniae MGH 78578
MPGEGTMSAFYQKHFLKLLDFTPAEITALLELAAKLKADKKNGIEVQKLAGKNIALIFEKDSTRTRCSFEVAAYDQGARVTYLGPSGSQIGHKESIKDTARVLGRMYDGIQYRGHGQEVVETLAQYAGVPVWNGLTNEFHPTQLLADLLTMKEHLPGKAFNQMTLVYAGDARNNMGNSMLEAAALTGLDLRLVAPSACWPEAALVETCTALAKQQGGNITLTEDIAAGVKGADFIYTDVWVSMGEAKEKWAERIALLRDYQVNSAMLALTGNPQVKFLHCLPAFHDDQTTLGKQMAADYGLHGGMEVTDEVFESAASVVFDQAENRMHTIKAVMVATLSK

SEQ ID NO: 31410 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 31411 - protein, 121 aa, Zingiber officinale
LSPMASSSATMVVSCARSSSGMVAPFSGLKSLSGVPFPTKRANAHLSHLPSNGCRVRCMQVWPIEGKKKFETLSYLPTLKDEALLKQIEYLLRSNWIPCLEFCKRGFVWRRTTKVLMAENT

SEQ ID NO: 31412 - protein, 734 aa, Bacteroides fragilis YCH46
MDSILFWLVPFASVLALCFALYFHKQMMKESEGTPQMIKIAAAVRRGAMSYLKQQYKIVGWVFLGLVILFSVMAYGFQVQNAWVPIAFLTGGFFSGLSGFLGMKTATYASARTANAARTSLNAGLRIAFRSGAVMGLVVVGLGLLDISFWYLLLNWAIPADVLTPTHKLCIITTTMLTFGMGASTQALFARVGGGIYTKAADVGADLVGKVEAGIPEDDPRNPATIADNVGDNVGDVAGMGADLYESYCGSILATAALGAAAFIHTGDTVMQFKAVIAPMLIAAIGIILSIIGIFSVRTKENATMKDLLGSLAWGTNLSSALIVAATFFILWLLQLDNWMWISCAVVVGLVVGIVIGRSTEYYTSQSYRPTQKLSESGKTGPATVIISGIGLGMLSTAIPVVAVVIGIIASYLLASGFDFNNVGMGLYGIGIAAVGMLSTLGITLATDAYGPIADNAGGNAEMSSLGKEVRKRTDALDSLGNTTAATGKGFAIGSAALTGLALLASYIEEIRIGLTRLGNLVLTFPNGDTISTANATFVDFMNYYEVNLMNPKVLSGMFLGSMMAFLFCGLTMNAVGRAAGHMVDEVRRQFREMKGILTGETEPDYERCVAISTKGAQREMVVPSLIAIIAPILTGLIFGVPGVLGLLIGGLSSGFVLAIFMANAGGAWDNAKKYVEEGNFGGKGSEVHKATVVGDTVGDPFKDTSGPSLNILIKLMSMVAIVMAGLTVAWSLF

SEQ ID NO: 31413 - protein, 294 aa, Helianthus annuus
MEQYEKVEKIGEGTYGVVYKARDKVTNETIALKKIRLEQEDEGVPSTAIREISLLKEMQHGNIVRLQDVVHSDKRLYLVFEYLDLDLKKHMDSCPEFSKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEETWPGVTSLPDFKSAFPKWSSKDLATVVPNLEKTGLDLLRKMLCLDPSKRITARTALEHEYFKDIGFVP

SEQ ID NO: 31414 - protein, 333 aa, Oryza sativa Indica Group
MAALHHQAAAAPVTTTTDGGELRAMDLYEKLEKVGEGTYGKVYKAREKATGRIVALKKTRLPEDDEGVPPTALREVSLLRMLSQDSHVVRLLDLKQGQNKEGQTILYLVFEYMDTDLKKFIRAHRQNLQKIPVPTVKILMYQLCKGVAFCHGRGVLHRDLKPHNLLMDRKTMALKIADLGLSRSFTVPLKKYTHEILTLWYRAPEVLLGAAHYSTPVDIWSVGCIFGTDSCLDIVDISCALQLSWPLTNLFSLEIPRLLGTPNEQVWPGVSKLPNWHEYPQWNPSKVSDLVHGLDADALDLLEKMLQYEPSKRISAKKAMEHPYFNDVNKELY

SEQ ID NO: 31415 - protein, 504 aa, Bacteroides fragilis YCH46
MSKKALLMILDGWGLGDHGKDDVIFNTATPYWDYLMETYPHSQLQASGENVGLPDGQMGNSEVGHLNIGAGRVVYQDLVKINLSCRDNSILKNPEIVSAFSYAKENGKNVHFMGLTSDGGVHSSLDHLFKLCDIAKEYNIENTFVHCFMDGRDTDPKSGKGFIEQLEAHCAKSAGKVASIIGRYYAMDRDKRWERVKEAYDLLVNGIGKKATDMVQAMQESYDEGVTDEFIKPIVNAGVDGTIKEGDVVIFFNYRNDRAKELTVVLTQQDMPEAGMHTIPGLQYYCMTPYDASFKGVHILFDKENVANTLGEYLAANGKKQLHIAETEKYAHVTFFFNGGRETPYDNEDRILVPSPKVATYDLKPEMSAYEVKDKLVAAINENKYDFIVVNYANGDMVGHTGIYEAIEKAVVAVDACVKDTIEAAKAQGYEAIIIADHGNADHALNEDGTPNTAHSLNPVPCVYVTENKEAKVADGRLADVAPTILHILDMVQPAEMTGCNLIK

SEQ ID NO: 31416 - protein, 243 aa, Clostridium acetobutylicum ATCC 824
MRKLVLLRHGQSEWNKENRFTGWTDVDLSVDGVSEAAQAGRILKKNNYTFDAAYTSVLKRAIRTLQIVLYEMDLLWIPVYKSWKLNERHYGALQGLNKDETRDKYGEDQVHLWRRSVEVRPPALEKSDKRYPGNEKKYASLKEEELPVTENLEDTEKRVLQDWRELIAPNIKGGKNIIISAHGNTLRALVKYLDNIPSDGIANLNIPTGTPLVYELDENLEPITRYYLGMDGKIEDDKFPKKV

SEQ ID NO: 31417 - protein, 642 aa, Nitella axillaris
MQRDRTPGRLGARKDVAMGGISGGGERRQEEEAGAIESMHGNRLEGIGRDRRCRKSRIGRGMLLAVQIGASLISFTIAQAPAPRSSGIVTSGSTNGSGSSDVRTGSGAGAASASGRDGGGGGSDGNVGMIAAVIVGTIIGAGFLLLVLLVVFLCVRRGGGSGRSRKKRDTVKGSRSRLLHTMDPIHMNMHMSKFRDPPPWKVYSFDELTEATINFNELNKLGEGGFGSVYKGVLKDGHQIAVKRLKQFSHQGDREFCVEVETISRVTHKHLATMSGCCTERGERIIVYDFAPNKSLMAHLYGPYSVNNSLSWARRMRIAIGAAEGLRYLHEETQPKIIHRDIKASNILLDADYEALVSDFGLAKLVPAGVTHVTTRVKGTLGYLAPEYARLGQVSEKSDVYSFGVLLLELISGRKPIMRGPQGGSRITLVEWVAPLLEKRRLTDLLDRRLGGTFKEDELFRVVTVASLCVQQHPHSRPAMKVVLSRLIGAPTDVPKPIKKPEGEREQVVVMSDGPLPIAKVDYGSAIYEEDVESGGDGAQANGSSSGPGSAAVVNRVVSSPEAASTQVGSSSPMKRSPSPSRAVKRTPSPGRVVKSTQSIGTATNAAPSIGSLPLSITTKSVDSDNGHVQLLSAHSAVMQDN

SEQ ID NO: 31418 - protein, 396 aa, Shigella flexneri 2a str. 301
MFENITAAPADPILGLADLFRADERPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSEIVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCESIVAVL

SEQ ID NO: 31419 - protein, 446 aa, Zea mays
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFMILPTGASSFKEAMKMGVEVYHNLKSIIKKKYGQDATNVGDEGGFAPNIQENKEGLELLKAAIEKAGYTGKVVIGMDVAASEFFGEKDKTYDLNFKEENNDGSKKISGDSLKDLYKSFVSEYPIESIEDPFDQDDWSTYAKLTDEIGQKVQIVGDDLLVTNPTRVAKAINEKTCNALLLKVNQIGSVTESIEAVRMSKRAGWGVMASHRSGETEDTFIADLSVGLSTGQIKTGAPCRSERLAKYNQLLRIEEELGDAAVYAGAKFRAPVEPY

SEQ ID NO: 31420 - protein, 512 aa, Burkholderia xenovorans LB400
MSFVSAVLYDMRQESFSMTGHLPKLSMYIGGEWVEPASGEYFETVDPFTAKPWALIPRGNAEDADRAIRAADKAFRDGPWRAMHPSERGLVLQRFGQLIGQHADELAGIEVRDNGRLLAEMRHQIRGIPKWYYYYGGLADKIEGAVHPVEQPALSFTRHEPLGVCVGIVPWNAPLLLLSLKAAPALAAGNTIVLKPAEFTSASALKLMELVEQAGFPPGVVNVVTGFGKEVGEPLVAHPLTRHLGFTGSTATGSHLYALAAKDVKRASLELGGKSANLVFNDADLNNAVRGVVGGIFGAVGQTCIAGSRLLVQRRIHDEFVDKLAAFTKTARIGDPRKPETQIGPIANRMQYNKILGYIDIAREEGAELVMGGARPDIAECGEGFFIEPTIYTGIRNDMRIAREEVFGPVLATIPFDDPEEAIAIANDSDFGLGAGVWTSDMRLALRMSERLEAGSVWINTYRDISYTTPFGGYKKSGIGRENGIEGIREYLQTKAVWISTAEEIENPFVIG

SEQ ID NO: 31421 - protein, 276 aa, Aeropyrum pernix K1
MSITPHRLPVAPVIVREAYLSLLRKGWRPGDRDLKTPRNVKIETGIIEKAEGSALVKLGKTQVIAGVKAGVGAPFKDTPNQGVLTVHAEFVPLASPVFEPGPPDENAIELARVVDRSLREVGAVDLESLVIRPGEKVWVLWVDLYIIDHDGNLFDASMLATMAVLLTARLPRYEESETGEIIISKEGEGEELKVKTRVVTVTTAKIDRYIVVDPNIEEEAVSDVRLVTAVDENGRIVGLQKTGMGSLTEADIETMIGYSLEASKVYFKALEEAIKP

SEQ ID NO: 31422 - protein, 246 aa, Aeropyrum pernix K1
MAGPAQAGVELIRDGRRHDGRLPEDLRPVRMQVGILHNADGSALVEFGRTRVLAAVYGPREPHQRFYVLPDRAALRVRYHMAPFSTDERKSPAPSRREIELSKVVREALEPVVLAEEFPRTVIDVFLEVLQADGGTRTAAVTAASLALADAGIPMRALVGGVAVGKIQGVLVVDVDELEDMYGEADMPVAAAPDIGEITLLQLNGVLTGEEFRTALAMALRAIDRVVEMEKEAIRKSYLEVGGGQE

SEQ ID NO: 31423 - protein, 443 aa, Oryza sativa Indica Group
MRSPVGRREVVVSGVFTALLVLSILSLPSLLLTGPAYKSWPFLAAARDDSTTGSGGGAGYYPVSFAYLISASTGDAARAARLLAALYHPANCYLLHLDREAPAEEHRRLAELVSGQPVYARAGNVWIVGRPNLVTYRGPTMLSTTLHAVAMLLRLGRRWDWFVNLSASDYPLVTQDDLMDVFSRLPRDLNFIQHTSHLGWKIKKRARPVILDTALYEADRSELIRPANLTTNRRNLPTAFKLFTGFVMSDGTGSNRDAFDRTVMGDAGSAWTMMSRQFAEYFTVGYDDNLPRTLLLYYTNFVSSPEFYFQTLACNSRRFRNTTVNHDLHFIRWDSPPKQHPLYLGPRDYRRMLLSAAPFARKFREDDPVLDRIDRDILRRDGAAPGRAFAYGGWCSEGGVRLCSNPQEAGRKGMIKAGAGSRRLRAMLNKMMNARNFRRQQCR

SEQ ID NO: 31424 - protein, 380 aa, Clostridium perfringens SM101
MNKNVIGVEISGIRKFYNEVVKFPEAISLTLGQPDFPVPEKVKEAMIRAIEEGKTTYTANAGIVELREEISGLLKNTFDIDFSKDEIIITVGGSEGLYAAMTAILNPGEKVLVPSIAYPAYESISKIIGCEVINYDLNEDFSVNIESLKEGIKQGGKLLVLSYPCNPTGALLSKKSRDELVEIIKENDILVLTDEIYSSLCFEEEYYSVAQCKDIKEKIIYVSGFSKMFSMTGLRIGYVACSKEIYDQIIKVHQYNSSCATSISQWGALEGLKSCMNDVENMKESFKERMNFTYKRLKSMGLEVEKPKGAFYIYPNISKFGLTSEEFCHRLLKEGKVACVPGDAFGKGGEGYIRISYCYSKDELERALDKLEDFIKFLKK

SEQ ID NO: 31425 - protein, 306 aa, Candida glabrata CBS 138
MSEEAIKKEKEILDSFPSVCEPGSPSGTPGNLNDSQKKALAQLKEQLQKDGYKLRLDDATLLRFLRARKFNVAMAKEMYVACEKWRKSAGVDTILEDFHYEEKPLVAKYYPQYYHKIDKDGRPVYFEELGTVNLNEMYKITTHERMIKNLVWEYESFVKYRLPACSRSRGYLIETSCTIMDLKGISISSAYHVLSYVKEASHIGQNYYPERMGKFYLINAPFGFSTAFRLFKPFLDPVTVSKIFILGSSYKKELLKQIPAENLPVKYGGKSEVSSSKGGLALSDIGPWRDPKFIGPEGEAPKSFVM

SEQ ID NO: 31426 - protein, 460 aa, Yersinia pestis CO92
MATGKIIQVIGAVVDVEFPQDAVPKVYNALEVEGTTEKLVLEVQQQLGGGVVRCIAMGSSDGLSRGLKVTNLEHPIEVPVGKATLGRIMNVLGEPIDMKGPIGEEERWAIHREAPSYEELASSQDLLETGIKVMDLICPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLLFIDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVARGVQSILQRYQELKDIIAILGMDELSEDDKLVVSRARKIQRFLSQPFFVAEVFTGSPGKFVSLKDTIRGFKGIMNGDYDHLPEQAFYMVGTIEEAVEKAKKL

SEQ ID NO: 31427 - protein, 584 aa, Bacillus subtilis
MRKTKIVCTIGPASESIEMLTKLMESGMNVARLNFSHGDFQEHGARIKNIREAAEKLGKNVGILLDTKGPEIRTHTMENGSIELNAGSKLVISMTEVIGTPDKISVTYEGLVHDVNKGSTILLDDGLIGLEVLDVDAVKREIKTKVLNNGTLKNKKGVNVPGRKCQSSGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMITSLEKASALITEEGGLTSHAAVVGLSLGIPVIVGLENATSILTDGQDITVDASRGAVYQGRASVL

SEQ ID NO: 31428 - protein, 387 aa, Kluyveromyces lactis NRRL Y-1140
MSNSPVPLGDFSKISTLPGISPITPEQRGESFWSSNPISSYLIDTYNNIHAHRKTLSLVNPGTVENLNKEVSRDVFLTQYFFTGLRADLNKTFAFNPAFQTSHTFSMGSESLPNYAFSALFANDNLFMQGNVDNQMSLSGRLQYGWDKNNVTKVTLQISEGQPTMCQLEQDYQASDFSLNFKTLNPSAASDGSFTGVAVGSILQSITPQLAIGLEAIYSKGQAMSPADAAVSYMTRFVSAKQDWIFSGQLQANGAAVASFWRKVSPNMEAGLETSLQASMLPIMDPVIGQPIGFQPAIEGATTLGCKYEYRQSVFRGSIDSNGKVGCFLERKILPTLSVLFCGEIDHFKNESKLGAGLQFETAGSEELLMMQQGLDINGNPLQAPPA

SEQ ID NO: 31429 - protein, 331 aa, Coccidioides immitis RS
MSASNSIQGLGLAPRSGTTLTVLGCGNLGVAILSGVLASLAEAKKTDSRFFPGCGTATPPEEVSPHQIPSRFFACVRRPESALRIQKTLKQFTHPLTILQNDNIRGVQEADVIILGCKPFMLKEVLDVPGMREALKGKLLISILAGVTAEQIEDTLYGGTDTPDGDRCRVVRAMPNTAAIVRESMTVIGESTPPLPPNWETLVNWIFSRIGRVVTLPASKMDASTSIAGSGPAFAALVLEALADGGVAMGLPRAEAQVMAAQVLRGTASMVQNGDHPALIREKVSTPGGCTIGGLMVLEEAGVRGKISKAVREATAIASGLGQTQKANGTK

SEQ ID NO: 31430 - protein, 636 aa, Oryza sativa Japonica Group
MSKVIATTLLLSVISHGAYPAMGSAWEEEDFARNCPPSWCSDSGPEIRFPHQLESSNSSSSSSCSASCARLACSGPDTILHHPFLGPCKVTAIDYKKAVFQIIPLVDSLSSYPLQKLIIDNLPEPDYHSSRCSLYNAQPGKIVCCSKVLTPSMSPTNDYDGNIADHAVVGPISCLSDPSHFSYLVDAYEDIYSLPLDCKAVSKGIVPISGAVTADGPTFKQLAERILNFAETTVSWSEGGIPDNCVQCEQQGQRCAFSSQRNQTFCMGHKPHGSRVKVIAATSSVAAFVVISLVVATAIYLSLKLSYNEEVHLKVEMFLRTYGTSKPTRYTFSEVKKIARCFKEKVGQGGFGTVYKGKLPNGVPVAVKMLENPTGDGEEFINEVATIGTIHHTNIVRLLGFCSEGTRRALVYELMPNESLEKYIFLRDPNTQELLSPDKMLDIALGIARGMEYLHQGCNQRILHFDIKPHNILLDYNFSPKISDFGLAKLCPRDQSIITLTKARGTMGYIAPELYSRNFGEISYKSDVYSFGMVVLEMVSGRRSWDPSIENQNEVYFPEWIYEKVITEQDFILSREMTEEEKQMVRQLALVALWCIQWNPRNRPSMTKAVNMITGRLQNIQVPPKPFVSYESHPMP

SEQ ID NO: 31431 - protein, 360 aa, Arabidopsis thaliana
MRTISDLPVALVEEILSRVPLTSLSAVRSTCKTWNALSKTQIFGKTRQQFLGFMMIDFGLYSIKFDLQGLNYESDFVEPSIKRVSILDQLDIFKVFHCEGLLLCVFRGNRWPVVWNPYLGGTGWIQPISDFHKYQVSDKFAFGYENKNHFFGFYDIYDLNSSAWKVLDVNPDCDIKCGVSLKGKTYFFAKEIAKAPNVKDFLVCFDFTAERFGPRLPLPFHSCGLFSEHVTLSCVRDEHLAVLYRRYNGVMEIYITTKIEPNEVFWSNFLKVDLTTFPDRFYGSRSHYFFIDEEKKVAVVFKNEPEWTMDCSYQTAYIIGKGGYLKSVKFGETPNDRKHNNAWNINSFMLSSYVPSLVQL

SEQ ID NO: 31432 - protein, 251 aa, Idiomarina loihiensis L2TR
MNDKNEESIDFGYQKVARNQKKNLVADVFQSVAAKYDVMNDLMSFGIHRLWKRYTIDCSGVRRGMKVLDIAGGTGDLTAQFSRRVGAEGEVVLADINDAMLKVGRDKLRDRGIIGNVRYVQADAEELPFDDNTFDVITIAFGLRNVTDKDKALRSMLRVLKPGGRVLILEFSKPVSATLNQVYDFYSFNILPKMGQVVANDSDSYQYLAESIRMHPDQETLKSMMEAAGYEKVDYQNMTGGVVALHRGYKF

SEQ ID NO: 31433 - protein, 356 aa, Solanum lycopersicum
  misc_feature (200)..(200): Xaa can be any naturally occurring amino acid
GLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRXQFNTIPGLMERTAKPDYATCVKIFTDASIKEMIPPGALVMLTPLIVGILFGVETLSGVLAGSLVSGVQIAISASNTGGAWDNAKKYIEAGASEHARTLGPKGSDAHKAAVIGDTVGDPLKDTSGPSLNILIKLMAVESLVFAPFFATHGGLLFKLF

SEQ ID NO: 31434 - protein, 171 aa, Gloeobacter violaceus PCC 7421
MDLKDYIRTVPDFPEPGILFRDITTLLHEPKALRYTIDSLAEQTGSLGADYVVGIESRGFMFGTPLAIKLDCGFVPVRKPGKLPAAVFKEEYTLEYGKNALEIHQDAFAAPSRVLVVDDLLATGGTAVAAAQLVERAGGTVVGFGFIIELTFLNGRAKLPEGPSAVALVSY

SEQ ID NO: 31435 - protein, 140 aa, Solanum pimpinellifolium
ALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNA

SEQ ID NO: 31436 - protein, 192 aa, Vitis vinifera
MEDYVSRKRVRDDSDEFELDSPEVKRLRDDLLCILDDSDPLADKDPATHDLASVMKIFEEQISASPPRPVPVVDLTSDSGESQPDISFLLEASDDELGLPPSWSSSSEELKSEDAKFVQISTESSGLSEFWGFGDEIPSYDSFEFGFGETHTVANNYGEYVALEGLFDHSDISFGSTDFSEFSWRHETLPAL

SEQ ID NO: 31437 - protein, 1296 aa, Gloeobacter violaceus PCC 7421
MSMVRRGTRSDSSSISSASQDKQQDRHHPAHGCLSGGGEMGALMRAKDWSASPLEAPDHWPQSLKTALRILLTSRYAMWMGWGEPLTFFYNDAYRPTLGIKHPWALGHPAQQVWKEIWRDIAPRIETVLKTGEATYDEALLLFLERSGFPEETYHTFSYSPLADEAGEVAGMLCVVTEETERVIGERRMALLRELASDLAATQTQEEVFAAVQRQVGKYSKDLPFTLMYLFDSDAGGRARLAAATGIEAKHPGARPIIDPATYGGPWSAHKLWEGAPPILLNDFEGQLGGNPPSGGWDKPPHQVSVVPIKSQGQERPAGFLVAALNPYRRYDAEYAGFVDLLTGQIAAGLANARAYEAECRRAEALAEIDRAKTVFFSNVSHEFRTPLSLLLGPLEDVLAGDGISAPTREQLTLAQRNGRRLLKLVNTLLDFSRIEAGRIQANFLPTDLASLTAQLVSVFRSAVEKAGLRLVIDCPPLAEAVYVDRDMWEKIVLNLLSNAFKFTLRGQIAVRLRQQTGEVCLELEDTGVGIAAHELPRIFDRFHRVAGVAGRSHEGSGIGLALVAELVEIHGGKVSVQSVSGRGSTFTVRLPTGTAHLPADRIGVAPGLASTAVAADIFADEAAQWTSGWHEEWLPPPPNLAPDAEQRAPDTPRPCVLVVDDNADMRAYIANLLKAHYEVVLAGDGVEALAAVERRMPDLVLTDVMMPRLDGFGLLAALRTDERTRALPVIVLSARAGEEATLAGLERGADDYLSKPFAARELLGRVKANLELSRLRGETARLLHASEERARLAIRVGRLGTWRFVPTSGVATMDERMREIWGEPEDTFQLSLAQAMERIHPADRERVSQAVDAALDPASAGTLEIDYRIVWPNGSERWVSANGQVFFEQTEAGSRRAVDFIGTALDITERKRIEQALAGSEQRYRLLAESIPQLVWTADVGGTLLDVNGRWSQYTGFTLEQVKKSGWESVVHPEDVPGLRRQWTAAIKAVAAYRAEGRMRRTDGTYRWHLHQAMPLMDGEGRILKWFGTATDIEERKQLEAEREQLLERAEQAREAAEAANRTKDEFLAILGHELRTPLNPIIGWTQMLRRGKVGPDKHDQALEIIERNARLQTQLIDDLLDVSRIMRGSLRIAPQPITLAAIVVCALEAVRGLAEQKQVQLFEQLRTTAPLSADPTRLQQVVWNLLTNAVKFTPAGGQVQVRLESGGGMARLTISDTGVGIPAEFLPHLFERFRQADTKSTREQKGLGLGLFIVRHIVEAHGGTVQAESEGEGKGAAFTVVLPLGGEAQRQAKP

SEQ ID NO: 31438 - protein, 274 aa, Glycine max
MASPPHFDDDFDFGGGFSGTQSGNKRPSPDYDEDEYENDPFGHKKAKSKAEEAASGVTTGMILSLRESLQNCKDMLATCQNELEAAKSEIQKWHSSFQNEPFISAGTTPAPKSVINYLQALKSSEESLREQLEKAKKKEAAFIVTFAKREQEIAELKSAVRDLKSQFNSASMQARRLLLDPAVHEEFTRLKNLVEEKDKKVKELQDNIAAVNFTPQSKMGKMLMAKCRTLQEENEEIGNQASEGKMHELAMKLSVQKYQNAELRCQFEGCLLSQ

SEQ ID NO: 31439 - protein, 501 aa, Klebsiella pneumoniae subsp. pneumoniae MGH 78578
MTITGNFIGGKTVISSSNETMPVYDPATGKAVREVTVSTAQEVSEAIQVARDAFDSWSRTTPLRRARVLFNFKMLLEQHVEELAGIIVSEHGKVWSDALGELTRGMEVVEFACGIPHLIKGEYSSDVGTGVDSYSLMQPLGVVAGITPFNFPAMVPMWMFPLALACGNSFVLKPPALAPTAAVRLAELLKEAGLPDGVFNVVHCSNEDAEQLYTDPRIAAVSFVGSSGVAEYIYKTASAHGKRVQAFGAAKNHAIVMPDADLDATVNAIMGGAFGSAGERCMALPVVVAVGDETADKLIARLKPLVEALKVGPGCMRGQEENEMGPVVSDTHQKKVLGYIDKGESEGAKLVVDGRKLRVPGYDAGYYVGGTLFDHVTPEMTIWREEIFGPVLGIVRAADYDSALELVNSHEFGNGSAVFTSNGHTAREFVHDVQAGMVGVNVPVPVPMAFHSFGGWKRSVFGALNVHGPDGVRFYTRMKTATVRWPAGQQTVSEFSMPTLG

SEQ ID NO: 31440 - protein, 281 aa, Clostridium beijerinckii
MDMNERLVRIPVREQDPKVRAANFEEVCIGYNEEEATKEASRCLNCKNPKCVEGCPVSINIPGFISYVKDEKFEEAAKEISKYSSLPAVCGRVCPQEKQCEGRCVLGIKGDSVSIGKLERFTADWAVSHNVDLSATEPKNGIKVAVIGSGPAGLTCAGDLAKKGYEVTIFEALHKAGGVLEYGIPEFRLPKEKVVKNEVENIKKLGVKIETNVIVGRTITIDQLFEDEGFKAVFIGSGAGLPRFMGIPGENANGVCSANEFLTRVNLMKAAVEGYDTPVRS

SEQ ID NO: 31441 - protein, 486 aa, Azoarcus sp. EbN1
MTLALNDPDLFRSRCLVGGTWADADSGATIAIHNPATGEQLGTIPKMGAAETRRAIDAASRAWPAWRALTAGARARVLRKWFDLIVEHQEDLALLMTSEQGKPLGEARGEVLYAASFVEWFAEEAKRIYGDVIPGHQPDKRIVVTKEPVGVCAAITPWNFPLAMITRKAGPALAAGCTMVLKPATQTPYSALALAVLAERAGVPAGVFSVLTGSATEIGGELTANPIVRKLTFTGSTEVGIKLAAQCAPTIKKLSLELGGNAPFIVFDDADLDAAVDGALASKYRNTGQTCVCANRLLVQDSVYDAFAEKLTAAVAKLKVGNGVDEGVTQGPLIDMRAVEKVEEHIADALAKGARVVTGGGRHALGRTFFEPTILADVTPQMKVAREETFGPVAPLFRFKDEAEAIRMANDTEFGLAAYFYSVGMNRVWRVSGALEYGIVGINTGIISTEVAPFGGMKSSGLGREGSKYGIEDYLEIKYLCMGGVQ

SEQ ID NO: 31442 - protein, 83 aa, Physcomitrella patens subsp. patens
MRDVKAYKLPPVNPPDKENPDAVTLRAQWDNAVRLYGRMYSHAWGTAILAGVTLFGIGWYVKGENPLKALDPTGEIKKKETAD

SEQ ID NO: 31443 - protein, 356 aa, Verticillium fungicola
MSRANPPNNASASRKISFNVSEQYDIQDVVGEGAYGVVCSAIHKPSGQKVAIKKITPFDHSMFCLRTLREMKLLRYFNHENIISILDIQKPRGYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 31444 - protein, 340 aa, Triticum aestivum
MPVTGDTFPTHMICILIGNLGASVTEVVSDAVVTEFSRTQRTGVLQSYAFIGLAAGALLGNLSGGYVLLRTQEPKIMFTAFSVLLGLQLALSIGTKETLPSSHGSSRSLLVKSSLSANLRKQFSNLMTAVREERIFYPLAWIMTSFAVVPVLSGTMFCFQTQHLKLDSSIIGLSKVMGQVMVVSLTVLYNRHLKRIPLRRLVGGVQIMYAFAVLSELILVKQVNLMLGIPNEVYVLCFSALAEAIAQFKVLPFSILLSSLCPPGCEGSLFAFFTSGLVFSAILSGVFGVGLSALIGLSSGGYSSLPLGILLQSLAALLPLAWLSFVPENWTADGKIVKQR

SEQ ID NO: 31445 - protein, 351 aa, Zea mays
  misc_feature (185)..(185): Xaa can be any naturally occurring amino acid
  misc_feature (241)..(241): Xaa can be any naturally occurring amino acid
MLMDRLEMQDDSKRSNRPKYSKFTQQELPACKPLLTPAIVISAFLLVGILFVPIGLASLSASQEIVELVDRYDTSCVTVADKVGFIQNTKTDKSCTRTLTIPKHMKSPIQIYYQIGDFYQNHRRYVKSHSDKQLRYKDAAHLTKDCEPEVYSAGGAPIAPCGLHAWSLFNDTYTISVNKKAIVVXKKDIAWQSDKKKKFGSDVYPSNFQNGNLIGGARLNESIPVCERGSVSSALSEQEDXLIVWMRTAALPTFRKLYGRIETDIMENDELTVVIQNNYNTYSFGGSKALVLSTTSWIGGKNNFIGFAYLIVGGFCLFLALVFVVLYMIKPRTLGDPSFLSWNRGTMDYPS

SEQ ID NO: 31446 - protein, 372 aa, Glycine max
MASLMSTILMQRSSSTSLAAGRLFSTTTATIIDSPSLAQRIRDLPKDLPGTNIKKHVSQLIGRTPLVYLNKVTEGCGAYVAVKQEMMQPTASIKDRPAYAMITDAEEKNLITPGKTTLIEPTSGNMGISMAFMAAMKGYKMVLTMPSYTSLERRVTMRVFGAELILTDPAKGMGGTVKKAYELLENTPNAHMLQQFSNPANTQVHFETTGPEIWEDTNGQVDIFVMGIGSGGTVSGVGQYLKSKNPNVKIYGVEPSESNVLNGGRPGPHHITGNGVGFKPDILDMDVMEKVLEVSSEDAVNMARVLALKEGLMVGISSGANTVAALRLAQLPENKGKLIVTVHPSFGERYLSSVLFQELRQEAENMQPVAVD

SEQ ID NO: 31447 - protein, 215 aa, Triticum aestivum
MAAAAAAVTPHLAAVGTGSHHHHQPPHRPPVSISARPRARLVPVAAAAATPATDGVAPVPPHPRRSVVKRHTISVFVGDESGMINRIAGVFARRGYNIESLAVGLNKDKALFTIVVSGTEKILTQVVEQLYKLVNVIQVDDLSKEPQVERELMLIKLNVEPEQRLEVMGLVDIIRAKVVDLSDHTLTVEVTGDPGKSCRLITLSLVCLLLKQNML

SEQ ID NO: 31448 - protein, 222 aa, Picea sitchensis
MGAGEEASPLLPKQEETAQGEAVPEQREAVGWTVDGVPIGHGNVMGSPVSRSQWNSSLLACLGRNDEFCTSDLEVCLLGTLFPCFLYGSNVERLTSTPGTFANHCLPYSSLYLLGRFLFGSNCLAPWFSYPSRTAIRRNFNLEGSCEALSRSCGCCRGYMEDDEQREQCESICDFATHFFCHQCALCQEGRELRRRLPHPGFNGRTVLVMLPPTEQMMEHKV

SEQ ID NO: 31449 - protein, 461 aa, Aeropyrum pernix K1
MLRSEYDIIVIGGGAAGFSAVVAAAEGGASVLLVSEGPLGGTCVNFGCVPSKHVLYNLSTARKAGLKISLSEALEGARKVSETLRKEKYESLLDSLGVDYLRGRARFKAPGIVEADGREVRYRKAAIIAVGARTWRPPIPGLKEAEKAGRILDNERLFGEGPPPDMESVAVIGGRAQGVEAAQIFARSGLKTVLLQRSGRLLPRDEPEAGVYMKRVLEGDGVEVRTSARPLRVESVRGAVRIDYETPQGPASVEASYIYLATGRKPVLDGLGLENVGVRVSSDGFIVVNEKLMASPGVYAAGDCIGGIQLEPVAAREGYVAALNALGGNVEMDYTVIPRAVFTDPEFASVGLTERELARKLGVCACRTVDITQIPRARIMGYETGFVKMVVDPRTKKVAGVHMMAPQAAEAIHEAAFILKAGMTVDDVIDTIHIFPSISEGIKYAALAFYRDVSKMPCCLL

SEQ ID NO: 31450 - protein, 417 aa, Burkholderia pseudomallei
MTGRLTGVTGLLLKASGCRLETGERCVIESADGDRIDAQVVGFNREETFLMPFKKPVGLVAGAQVLSCERQGLLRIGRSWLGRIVNGLGEAIDGRGSLGGDAVLRAHPAPVNPLRKRPVRDVLDVGVRAINGLLTLGRGQRIGLMAGSGVGKSMLLGMITRATQADVVVVGLIGERGREVREFVDHALGEAGLAKSVLVAAPADESPLMRLKAAELCHAIAAHFRDTGANVLLLVDSLTRYAMAQREIALSVGEPPATRGYPPSVFGMLPQLVETAGNGEGAGSMSAIYTVLAEGDDQNDPVVDTARAILDGHIVLTRELAERGHYPAIDVPRSVSRCMSQVAGAEHGALARKVKEMIGRHEQIRDLIALGGYVQGADPATDEAVAKAARIDTFLRQDMLDVARHDATLAALKELIA

SEQ ID NO: 31451 - protein, 170 aa, Trichodesmium erythraeum IMS101
MELKNLIREIPNFPKSGIIFRDITTLLSNTDGLHYTIDILTEKCLEFKPDYVVGIESRGFIFGMPLAYQLNVGFIPVRKPGKLPAEVYSVSYDLEYGQDSLEVHQDAMPAGSRVLVIDDLLATGGTAGATTQLIEKAKCNLVGFAFVIELKELGGREKLPKVPIISLIEY

SEQ ID NO: 31452 - protein, 125 aa, Triticum aestivum
RERERERERERESLVPNSARGLVPNSARGDDPRSSTKTEGSQPLPKNPAMTSCRKKKTDDDVTFLEDVKEHIDEFIHASMDEHKTCFKKTIQKMFGMSKVVAERSAAAKEAEVESALPLQTSVSQ

SEQ ID NO: 31453 - protein, 196 aa, Candida glabrata CBS 138
MEMEEVSVVEECRRELRSALHQYPNFPTQGVLFEDFMTIFQNPSLFKTLINTLKSHLNEEFPNGEIDYIVGIESRGFLFGPTLALAMDVGFVPIRKAGKLPGELVRADCEKEYGSATYELQKEAIPKGSNVVLIDDVLATGGSATAATQLLMSVGSNILEYCFLMELDFLKGKLKLNDAPVFSLLHTQEEGLKRSP

SEQ ID NO: 31454 - protein, 333 aa, Streptococcus mutans
MAILVLGGAGYIGSHMVDRLIEKGEEEVVVVDSLVTGHRAAVHPAAKFYQGDLADREFMSMVFRENPDVDAVIHFAAYSLVAESMKKPLKYFDNNTAGMIKLLEVMSEFGVKYIVFSSTAATYGIPDEIPIKETTPQRPINPYGESKLMMETIMKWSDRAYGIKFVPLRYFNVAGAKPDGSIGEDHSPETHLLPIILQVAQGVREKIMIFGDDYNTPDGTNVRDYVHPFDLADAHLLALNYLRQGNPSTAFNLGSSTGFSNLQILEAARKVTGQKIPAEKAARRSGDPDTLIASSEKAREVLGWKPQFDDIEKIIASAWAWHSSYPKGYDDRD

SEQ ID NO: 31455 - protein, 152 aa, Picea sitchensis
MKEMGRLRAAFMREKSEEEVVICPKPRRLGLVNHPSPELPKHLRWQRSHTPEHNELNAGFEILDIILSKSGCSDSSNLGCSPPYFCGSPPSRVDNPLVHDVQFIHQRVPSSPSAISKPKSCVRQSLGSSPGIRIEGFDCLDRDTRCSIPAMA

SEQ ID NO: 31456 - protein, 220 aa, Oryza sativa Indica Group
MASTTAAAEDRKGKRPLPPEEADEAAAAPPPAAAEEEGEKLLLVSDDGVEVLASVAAARVSKTLRGMIEDECATGAIPIAGVHSDVLALLVEYCERHAPHYDPEASDRDRYPFPPFPVELPPTASSIKPVTFVDPDADPHGLKAFDKKFLDVDNSTLFEIIMAANYLNIEELLDDACTAVADKMRGKKPEEIRDIFEIENDYTPEQEAEVRRENAWAFED

SEQ ID NO: 31457 - protein, 404 aa, Mycobacterium tuberculosis H37Rv
MREVPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRFHIDSGAGATVAGIRVPRENATAFGCIDADDSGRIRSFVEKPLEPPGTPDDPDTTFVSMGNYIFTTKVLIDAIRADADDDHSDHDMGGDIVPRLVADGMAAVYDFSDNEVPGATDRDRAYWRDVGTLDAFYDAHMDLVSVHPVFNLYNKRWPIRGESENLAPAKFVNGGSAQESVVGAGSIISAASVRNSVLSSNVVVDDGAIVEGSVIMPGTRVGRGAVVRHAILDKNVVVGPGEMVGVDLEKDRERFAISAGGVVAVGKGVWI

SEQ ID NO: 31458 - protein, 789 aa, Oryza sativa Indica Group
MGISSAIQWWDEWQLRILALSSLLVQYILLVMAPRRKFPMKFYLRYIIWLAYLSSDALAIYALATLFNRHKKQDYGHAHNTSILEVLWAPIFLIHLAGQESITAYNIEDNELWTRHALTSLSQITIAIYVFCKSWPGGDRRLLQAAILLFVPGVLKCLEKPWALSSASINSLVSSPKNVRRTTNREVKKDPIQDFIDKVNESRLEDGRWEESSSPADFKPSELFVDLASPSSDDRLSKLLSFLQREGDESYILLQKSLYETFDLLYTKEKMFPIILSTLKRHQIYTKEKMFPIILSTLKRHQNDDNTNVDTDEGKKEQQTLKGFCGSMLRLLLTYLSFVAIGLFHQSHRKAYNHTDVKVTYTLLCCTAVLELCGPTLQKNLTSGQARVQKTSFNMNSPKSVGKVNHAKHDVQAKSKAKGKLPVYGIMDDMVSQYSLLGYFVRNRKHSVIMGVAEFLSCKDYLDQRWRMKSCSSSRNITNLVLGHVKRWWNDEITNVSCYRKFNDNRGQWTLESEEFLQQLGWSLEGAFDESVLLWHLATDFCYYHICGSHDCEHATKTCFQGTSDLKSESPTFCEESIHQGRAVHCREMSNYMMYLLVVNPEMLMAGSRRNLFTDAYNQLKGMFNKKSTPLNEGELAGTIISEVQVHVQQPIKEKTIEDKTPAPSNKTGLIDDAWSIAEVLLNLHDEEKMWRVIEGVWVEMLCFSAARCRGYLHAKSLGTGVEFLSYVWLLMHYMGMETLAEKLARAELPIGACSGDSRTTHAEHSSGKEQVAGASSNDGITVVVDKNG

SEQ ID NO: 31459 - protein, 215 aa, Zea mays
  misc_feature (86)..(86): Xaa can be any naturally occurring amino acid
MAASPTLRFSSATHPLHRPLRRRLPSVRCSLAAAAGPGVRAPPELVDSILSKVKGTDRGVLLPKDGHQEVAEVALQLGKYCIDDPXVKSPLIFGEWEVVYCSVPTSPGGLYRTPLGRLVFKTDEMVQAVEAPDVVRNKVSFSVFGLEGAVSLKGKLNVLDSKWIQVVFEAPELKVGSLGFQYGGESEVKLEITYVDEKIRLGRGSRGSLFVFLRR

SEQ ID NO: 31460 - protein, 406 aa, Streptococcus pneumoniae
MKIAVAGTGYVGLSIAVLMAQHHEVVAVDIISEKVNLINNGKSPIKDDYIEEYLATKPLNLVATLDTNLAYQNADFVIIAAPTNYDSEKNFFDTSAVESVIETVLETNPNAVMVIKSTVPVGYTQSIRNKYKTSNILFSPEFLRESKALYDNLYPSRIIVGLDMDDAYLKERAETFAELLQEGAVKEAIEILYMGFTEAEAVKLFANTYLALRVSYFNELDTYAEVKGLDTKAIIEGIGLDPRIGSQYNNPSFGYGGYCLPKDSKQLLANYKDVPQNMITAIVESNRTRKDFIAEQILKLAGVSNNGEIYPKDVIIGLYRLTMKSNSDNFRQSSIQGVMKRLKAEGANVIIYEPTLSDDETFFGSKIVNDLEHFKSISNVIVANRYDDLLKDVSDKVYSRDIFKRD

SEQ ID NO: 31461 - protein, 480 aa, Cinnamomum osmophloeum
MVKICCIGAGYVGGPTMAVIALKCPSIEVVVVDISVARIAAWNSEQLPIYEPGLDDVVKQCRGRNLFFSTDIEKHISEADIIFVSVNTPTKTRGLGAGKAADLTYWESAARMIADVSKSDKIVVEKSTVPVKTAEAIEKILTHNSRGINFQILSNPEFLAEGTAIEDLFKPDRVLIGGRETPEGQKAIKTLKDVYAHWVPEDRILATNLWSAELSKLAANAVLAQRISSINAMSALCEATGADVTEVAYAVGKDSRIGPKFLNASVGFGGSCFQKDILNLVYICECNGLPEVANYWKQVIKINDYQKNRFVNRVVASMFNTVSGKKIAVLGFAFKKDTGDTRETPAIDVCKGLLGDKAKISIYDPQVTEDQIQRDLAMNKFDWDHPIHLQPMSPTTVKQVSVTWDAYEATKDAHGVCILTEWDEFKALDYQKIYDNMQKPAFVFDGRNIVDVEKLRKIGFIVFSIGKPLDPWLKDMPAVA

SEQ ID NO: 31462 - protein, 152 aa, Triticum aestivum
MTPAERVKAKMKLQLAETASKDSTLGTATVSWGRFEFNKDAPLDEDDNDVEVANDDATLVKHIGKSFRLSTVESKNENIVRDAHDEAMFGVPMSSNVDTETSEDELKTNGEGKKAEDVEAQPSSSLIGDEVLAMQKMSWRERMEKLRQNSNT

SEQ ID NO: 31463 - protein, 314 aa, Aeropyrum pernix K1
MSLHRLRGRHLLWLADYTGEEIRHMVELTLEMKRRYYAGERVIPVLRGRSVGLLFEKPSTRTRISLEVAVAQLGGHTVYMTPSETQLGRGETVADTARVLSRYLDAIVARVRSHKTLEEMARHASIPVINGLSDLTHPLQAIADMATILEKKGRLEGVKLAFVGDGADNVLHSLLLAGSKLGLHITVATPPQIRPDERILSIALKAAEESGGSVEIVSDPYEAVRGADVVYTDVWVSMGQESMAEEKVQLLKPYQVNAKLMEATGGRAIFMHCLPAKRGQEVTDEVIDGPWSAVWDQAENRLHAHKAVLSLLVP

SEQ ID NO: 31464 - protein, 791 aa, Dechloromonas aromatica RCB
MEALVIPFEKLRMNDVEQVGGKNSSLGEMISQLADTGVRVPGGFATTAHAYRVFLAQSGLDAKINAVLDALDVEDVNALVKAGAEIRQWILDTPFPMDLTIAVTEQYERLVADSTADMSFAVRSSATAEDLPDASFAGQQETFLNIVGLENIMHAIKEVFASLYNDRAISYRVHKGFIHADVALSAGIQRMVRSDKGSAGVMFTLDTESGYRDAVFVTSSYGLGETVVQGAVNPDEFYVHKPMLAAGKKAVVRRNLGSKMIKMTFAAEKVAGKSTITEDVPEAQRHQFSINDEEVMELARYAMIIEKHYGRPMDIEWGKDGVDGKLYILQARPETVQSQAAAGKQEKFKLKSFSKVLASGRAIGQKIGVGPVRIVKDPKEMDQVKPGDVLVADMTDPNWEPVMKRASAIVTNRGGRTCHAAIIARELGIPAIVGCGDATETLTEGDIVTVSCTEGDTGHVYRGSLDYEVTTRDISAMPDVPVKVMMNVGNPELAFEFAQLPNAGVGLARVEFIINNVIGIHPKAILDVERLPASKREEIKRRARGYASPKDFFVEKLVEGVSTIAAAFWPNPVIVRLSDFKSNEYRKLLGGELYEPEEENPMLGFRGASRYVAQSFRDCFEMECRAMKRVREEMGLTNVQLMVPFVRTVGEGQAVVELLAEHGLKQGEHDLKLIMMCEIPSNALLADDFLKVFDGFSIGSNDLTQLTLGLDRDSGLVANLFDERDPAVKMLLAMAISAANKAGKYIGICGQGPSDHPDLAEWLMDQGISSISLNPDTVVDTWTRLATHKKA

SEQ ID NO: 31465 - protein, 466 aa, Azoarcus sp. EbN1
MSQGTIVQCIGAVVDIQFPREAMPKVYDALKLENAAGSFAEEGLTFEVQQQLGDGVVRTIAMGSSDGLRRGMKVASTGKGISIPVGHGTLGRIMDVLGRPIDEAGPIEADELRPIHAKAPKFDELSPSVDLLETGIKVIDLVCPFAKGGKVGLFGGAGVGKTVNMMELINNIAKQHSGLSVFAGVGERTREGNDFYHEMKDSNVLDKVAMVFGQMNEPPGNRLRVALTGLTMAERFRDEGRDILFFVDNIYRYTLAGTEVSALLGRMPSAVGYQPTLAEEMGRLQERITSTKVGSITSIQAVYVPADDLTDPSPATTFLHLDSTVVLSRDIAALGIYPAVDPLDSTSRQLDPLVVGEEHYNVARQVQVTLQRYKELRDIIAILGMDELSPEDKLAVSRARKIQRFLSQPFHVAEVFTGSPGKYVPLKDTINGFKMIVNGECDHLPEQAFYMVGGIEEAMEKAKKLQ

SEQ ID NO: 31466 - protein, 489 aa, Klebsiella pneumoniae subsp. pneumoniae MGH 78578
MNTLRQDSLAGIVVFLVALPLCLGIAQASGLPPFVGLLTGIIGGLVVTTLSPSRFAVSGPAAGLVTIVVAAIESLGSFSLFLMALVLAGVLQLLFGILRAGRFISLVPASVIKGMLAAIGILLIMQQIPVALGTAEETGLAEVVQGNAAVSVTAFAVAAGGLLVLWLWGSPLIRRVKSLRWIPGPLIAVLLGCVTTLLLTHFAPQQLAALPRITLPAFGSLGDLLGELESPAWSAWRNPSVWVVAVTLALVASLETLLSQEALKKLRPQNPPPSPNREMVAQGVGNLLSGVLGAMPITAVIVRSSVNVSNGAQSKLSIFIHGLLLLICGLWFSGLLTLIPLASLAAVLLYTGYKLATPRLFIEQFRQGAAQYVPFLATIGGIIACGMLAGIGIGLATQMAFSLWRSHRHSLQLARYDDHYVLRIQQNLTFMHNPHLLALLAKIPEKSVVIVEHDSVGYLDPDVRAVLDDFAENAPQRGIRLNQWPLASR

SEQ ID NO: 31467 - protein, 612 aa, Chlamydomonas reinhardtii
MHKYRLVAKKGEGTFSEVLKAQCIKNGKYVAIKCMKNHFDSLDQVNNLREIQALRRLSPHANIIKLLEVLYDQPTGRLALVFELMDMNIYELIRGRRHYVAEERIKNYMYQLMKSMDHMHRNGIFHRDIKPENILIMDDCLKLADFGSCRGIYSKQPYTEYISTRWYRAPECLLTDGYYNYKMDMWGVGCVFFEIVSLFPLFPGTNELDQITKIHNILGTPPPDLLAKMKKRSAHMDFNFPPKEGSGVAKLIPHVNPECVDLIVKLLMYNPDERLSARQALRHPYFRDLREAEKRQKALLAPDVSNHFTAMEADKARQQQTVSSTGSDHEHPTSAGGDGGAGTGAVGTHDGSAAAAAAAAALPSISGARGHAGPEGGHDNDMGGMDASGGGGGGGYGRLPGLAAQSSMASVDGDEASLPPIANLSLGKANMTGSTVGGAAHASTRRSTLNTYYEPGAGGGGGTGGAGGGGGGAGPGPAGYGKVAKAAAVGGAGSVAGGGGVVGGAGVGGGGAVGSGTVGRRQSVGVVVGKYGSVNKQASQGHGGGGPGVAGAAGMAVTGGHAGGGVGGGGGGAVGVGGVGVNKYKANVGKTNSKYISPYSLRQLAGQNAGQG

SEQ ID NO: 31468 - protein, 624 aa, Debaryomyces hansenii CBS767
MDNKSTKESELDFSLRSKELNSREASDISLNKGNGNSENSLDEVKEHNKFVYLGAWNKKLLYVAYAVLIITAFVESFANNSTSSLDSYATSSFNEHALIATVAVVYKITAICAYPILAKIADLLGRAEGFTLSMILYSLAYVLYASCQNVDTYVCAEIFFAIGRNGYRIFQLIFIADTSSLINRGILSQLPNAIGAIPSLYAGSYVQDAFLEHSTWRWGYGSFAIILAAFCFPLGGIMFYLDRRAKQNGQKKVYQILENIPKDAKWYEKAYQILFVELDLIGGVLLLCGFALFFVPFTVTGKSSSYKWHEPKLIVMLVIGFVIFCCFLVWNTKFAKKPFVPTQALKSKTVVIIVVLVALDLCENSSFATYFKTVLQVAGYYSAGAATRIDNSKKVTVDIFNVFGGLLMKYTKRSKIYALIGIPMLVLGHGLLVWFMRRGDGEMASYALLVMAEVFIGFGRGMYQCALQVTIQAIAGIEGIAMSTAFFLAFQSIGSLIGSAISGGIWNTVVLSKLNLYLPEDDKDLAKKIYKSITVAMSYEKGSDIRDGINRAYAETIQIIGWTGLGIIAPMLILMFFIKEVKLSEAKDIYSVSISEEEIKIKEEKEIEIKEEKESLKKNTSRGQ

SEQ ID NO: 31469 - protein, 390 aa, Oryza sativa Japonica Group
MAAAVRRLLRRGLSTATAPPPTPGSILNPSSPSTPLTSRQKSRLAISLLKSTPPPPPDQILSICRAAALSPDSHLDRVALSLAASKLSSAPDSVRDLASSLLTPHHAPHAIALFGQAGLLPDAVSTFKSSPSTRSLNALLFACLVSGNHAEAARVFQTFPDAYSVKPNTDTFNAIIKSFAESGTTRSFYSVLDEMCQKGVKPNATTFTTAIAGFYKEERFDDVGKVIELMKKHGCGESLPVFNVRVQGLCKLGRSGDAKALLNEMVKKGTKPSWLTYNHLIHGFCKEGDLEEAKRLYKEMAKKGLVGDSSFYYMLIYYLCKGGDFDTAVGVYNEIAARNWVPCFSTMKMLVNGLAGSSRVDEAKGIIEKMKEKFPDKAEGWKEVEDALPQ

SEQ ID NO: 31470 - protein, 220 aa, Triticum aestivum
  misc_feature (150)..(150): Xaa can be any naturally occurring amino acid
MTSVWKTKVLPGLNKIFDKDGKKAAAAEFLKSFNKEEIDKEIEDKKTELEPKVVETIEASPPEIKGLMKDKKTSKIKKNSVAVTKFLDDLAKIDFPGAKLVSDAVAKSGTTPLSPAIVFILDKVAPFVPAPKEEPKAEPEDAAPAEETTXREVAVEEKKEEAEPSAAPAEAAALEYPSRGPSLRVPSFLVQSGPYSEAYYKLGHWPVVLPRRGLGKLLTW

SEQ ID NO: 31471 - protein, 245 aa, Azoarcus sp. EbN1
MNEKTTHFGFETVAEGEKHKKVAEVFSSVARRYDVMNDLMSFGLHRLWKAFTIQISGVGRGDRVLDVAGGTADLSLAFAKRVGRDGQVWLTDINHAMLSRGRDRVLDRGFALPVAQCDAEKLPFPDNWFDCVTVAFGLRNMTHKDVALAEMRRVLRPGGRLLVLEFSKVWAPLAPAYDLYSFKILPWMGDKVAHDADSYRYLAESIRMHPSQNELKELMERVGLKRVDYFNLTGGVVALHRGYKL

SEQ ID NO: 31472 - protein, 844 aa, Streptomyces avermitilis MA-4680
MERLPTPAGQQADIPDASPAPACTATATISEQGIVTGWSEGARELLGYTPPQIVGHPAARLLADGTGEQARRETAGRERFSGQVALLHRDGHRLLRNLLAHRRTPQGPQPAEWLVVSAVTAASASPRTPDSQALREWVFSQSPCILAVFDTDLRLVTANTGMESALLLPEEQMRGLRLPEITPGPASEEAETKMRRALETGQTQHMQAYLHPTGVSAQRGWSTTLAPLKDPGGTVRAVCLAAHHRQQEHLARQRMLLLNDAGARIGTTSDIQRTVQELADVAVPRLADFAAVDLLDVPRRGGEPARLPATGPITMHRTALHTTPDNHTSHTSHTSHDGDDGDGGDTHPATPPAAGEKILYPAQSPVAQCLAQGHGALYEADDPALTRWAANDPTAAWTRRQGTHSVMVVPLRAHGTTLGVALFARSHRPEPFEADDLWLAEELTAQTAVHLHNAHRHAREHTTTMTLQRSLLPQKLPDQGALDIATRYLPAGSKAGVGGDWFDVIPLSGARVALVVGDVVGHGIRASATMGRVRTAVRTLADVDLPPDELLTYLDDLVIHLAADEGGGAEGTTETAAGIGTTCLYAVYDPTTRHCTIARAGHPPPAVVTPDGNVRFLNVPAGPPLGLGGLPFETLETQLPEAASSPSTPTDSSKPATTTSTKASTKCSTPSPAPPTTSTPSATESSPPCSPTAPTTTSPSSSPAPAPSTPTKSPPSTSPPTPPSSPKHANTPPPNSPPGTSPTPPSPPNSSSANSSPTPSATATHPSNSASSTTTTPSPPKSPTPATPPPTCAAPAPTTKEDAASSSSANSPNAGAPATPPPAKPSGPNKPSPPTNTEFRFRWV

SEQ ID NO: 31473 - protein, 528 aa, Oryza sativa
  misc_feature (267)..(267): Xaa can be any naturally occurring amino acid
MASLARRRAAEAALLRRAPAAAWASAWRGYAAAAAGEESDVVVIGGGPGGYVAAIKAAQLGLKTTCIEKRGTLGGTCLNVGCIPSKEVMNHFDPFYLAVPSIYYELRSTMGALLHSSHMYHEAKASFAHHGIKFSNLEIDLPAMMSQKDKAVAGLTKGIEGLFKKNKVEYVKGFGKFVSPSEVSVDLLDGGSTTVKGKNIIIATGSDVKSLPGVTIDEKKIVSSTGALALSEIPKKLVVIGAGYIARGMGSVWNRLGSEVTVVEFAXLDIVPSMDGEIRKQFQRMLEKQKMKFMLKTKVVGVDTSGSGVKLTVEPAAGGEQSVLECDIVLVSAGRVPYTSGLGLNALGVETDKGGRILVDKRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGLVKVVAEKETDRILGVHIMAPNAGEIIHEAVLALQYGASSEDIARTCHAHPTVSEALKEACLQTYLKAIHI

SEQ ID NO: 31474 - protein, 376 aa, Aspergillus fumigatus
MTPAVPASLLSPSFTPPATPGGSINTAELLQQTQLAGARQGSTHTKPPRLLSRLPNVECIVRARIPTTTGAEMFLHLYHNDLDNKEHLAIVFGNTIRSRSLDKIRPGETEMDRMIRGAYVGKLRPGRVSSWYDEEKAEEAASPEAGGAVSSPHTLPRSSLKEAPLVRIHSECYTGETAWSARCDCGEQLDEAARLMSLPMETLAEAASPPDGAVPSNAAGGVIVYLRQEGRGIGLGEKLKAYNLQDLGSDTVEANLLLRHPADARSYGLATAILVDLGLGIDSNPHGIRLLTNNPDKIRAVEGPNREVVVKERVPMVPLAWRSGGKMGIKSSEVEGYLRTKVCRQSISCKLAYFLIILKQCLTLSSQISKMGHLLQ

SEQ ID NO: 31475 - protein, 393 aa, Bacillus anthracis str. Ames
MDTLIFEVGTALVLVAFAAILAAKLKFSIIPFLIILGMLVGPHAPDLGLIDLRFIESGEVISFLGRVGVIFLLFYLGLEFSIKKLIKSGKSIAFGGTVHISLNFLLGLLYGYVMGFPLLETLIIAGIITISSSAIVAKVIVDLRRSGNKETELILGIIMFDDIFLAVYLSVVSGLVLGGATSFAGALTSVLIAVGYMLLFFVIARKATPFLNKVLDISSNEIFIIVIFAILFFVAGFSETIHVAEAIGALLLGLVFSETEHSDRIEKLVVPFRDFFGAIFFFSFGLSIDPFSLGGAVWLALGAVFITIIGNFTAGMIAGSKAGLSHKASTNIGLTLVSRGEFSIIVANIGIAGGLMAAIKPFSALYVLILASLGPLLTKESGRIYSLLDKLFK

SEQ ID NO: 31476 - protein, 390 aa, Mycobacterium tuberculosis H37Rv
MPSRLHSAVMSGTRDGDLNAAIRTALGKVIDPELRRPITELGMVKSIDTGPDGSVHVEIYLTIAGCPKKSEITERVTRAVADVPGTSAVRVSLDVMSDEQRTELRKQLRGDTREPVIPFAQPDSLTRVYAVASGKGGVGKSTVTVNLAAAMAVRGLSIGVLDADIHGHSIPRMMGTTDRPTQVESMILPPIAHQVKVISIAQFTQGNTPVVWRGPMLHRALQQFLADVYWGDLDVLLLDLPPGTGDVAISVAQLIPNAELLVVTTPQLAAAEVAERAGSIALQTRQRIVGVVENMSGLTLPDGTTMQVFGEGGGRLVAERLSRAVGADVPLLGQIPLDPALVAAGDSGVPLVLSSPDSAIGKELHSIADGLSTRRRGLAGMSLGLDPTRR

SEQ ID NO: 31477 - protein, 126 aa, Coprinopsis cinerea okayama7#130
MSAEHGKAWPLSDANLTNQILELVQQAGQYKQLKKGANEATKTLNRGIAEFIVLTADTEPLEILLHLPLLCEEKNVPYVFVPSKAALGRACNVSRPVIAASVTTGESRELNSQITTVKNAIEKLIV

SEQ ID NO: 31478 - protein, 334 aa, Pseudomonas fluorescens PfO-1
MSTQPIKQQLQRFNRLDLLGQPTPLEKLERLSTWLGRDVYIKRDDLTPLAMGGNKLRKLEYLAADAIAQGADTLITAGALQSNHVRQTAALAAKLGLGCVALLENPLGTDDSNYTGNGNRLLLDLFDTKVELVDNLDNADEQLAALAVRLRSNGKKPYLVPIGGSNAIGALGYVRAGLELAEQIKDTGLQFSAVVLASGSAGTHSGLALALSEALPQLPVIGVTVSRSEEDQRPKVQGLAERTADLLGVALPDSFKVELWDEYFGPRYGEPNAGTLSAVKLLASQDAVLLDPVYTGKAMAGLLDGIGRGRFDDGPIIFLHTGGAPALFAYKDFL

SEQ ID NO: 31479 - protein, 406 aa, Idiomarina loihiensis L2TR
MSQQLVRSTSLAGAIVLGLGSILGTGAFVSVGIGADIAGGAVLWAILIAAVTALCNGLSSAQLASAHSVSGGTYEYGYRFLTPAYGVTAGSLFVVAKSASAATAALAVGWYVTNVTAIPEYLAQWIAAAVLVLFTLLVLGGVKRTNWVNAAIVTVSIVALLAFIITGHQQTAVVERASVEWWHVLQAAALLFVAYTGYGRIATMGEEVQNPRQVIPLAVILTLAVVTLLYLGVGSALLHFPSIADFQAEHFSLASLLPTGPIQWLVTAGAVVAMGGVILNLILGVSRVVLAMGRRADLPMRFANLNDQQTSAPPATWLTCFVMLVLVAIGDIKTAWSFSAFTVLVYYGITNLAALKVTKSDRFVPKWVSILGLVSCLGLAVFVPWQVLLSGLIFIVVVLLIHQLRR

SEQ ID NO: 31480 - protein, 308 aa, Pseudomonas fluorescens PfO-1
MSERSSHWQLQTIVSQLRTARDQWRAQNGRASGEQGGRELPSRDAMAQILEALCGALFPMRLGPVDLREESEDFYVGHTLDVALNALLTQARLELRYVARHSAQADTEVEAQAIRIIQDFALALPGLRSLLDTDVLAAYHGDPAARSVDEVLLCYPGILAVIHHRLAHHLYRAGLPLLARISSEIAHSATGIDIHPGAQIGRSFFIDHGTGVVIGETAIIGERVRIYQAVTLGAKRFPADEDGQLQKGHPRHPIVEDDVVIYAGATILGRITIGKGSTIGGNVWLTRSVPAGCNLTQANLQHDDGTQK

SEQ ID NO: 31481 - protein, 455 aa, Acidovorax sp. JS42
MAQARARLAPEQPLETRGTLTRLTGLVLEATGIRVPVGSQCQVQMNGQEPVLAEVVGFAGDTAYLMPAGDIHGLSSGASVMPAPAYVPALHLGAAPVEEAGAGVGALLLPMGDGLLGRVVDSQGNPLDHAGPLAQVTAQPMDRRPINAMERDPVREPLDTGVRAINALLTVGRGQRLGLFAGSGVGKSVLLGMMARYTQADVIVVGLIGERGREVKEFVEDILGVQDRGRAVVVAAPADAPPLLRMQGAAYATAIAEHFRDKGQHVLLLMDSLTRYAMAQREIALAIGEPPATKGYPPSCFAKLPALVERSGNGLNGVGSITAFYTVLSEGDDQQDPIADAARAILDGHIVLSRALAESGHYPAIDIEQSASRVMHNVVPRAHFELARGFRAVYSRYQKSRDLIQVGAYMSGSDPQLDEAIRLQPGMTAFLQQSMFEAAPMDDSIAAMGQALEGA

SEQ ID NO: 31482 - protein, 369 aa, Shigella flexneri 2a str. 301
MATLTRLFIHPVKSMRGIGLTHALADVSGLAFDRIFMITEPDGTFITARQFPQMVRFTPSPVHDGLHLTAPDGSSAYVRFADFATQDAPTEVWGTHFTARIAPDAINKWLSGFFSREVQLRWVGPQMTRRVKRHNTVPLSFADGYPYLLANEASLRDLQQRCPASVKMEQFRPNLVVSGASAWEEDSWKVIRIGDVVFDVVKPCSRCIFTTVSPEKGQKHPAGEPLKTLQSFRTAQDNGDVDFGQNLIARNSGVIRVGDEVEILATAPAKIYGAAAADDTANITQQPDANVDIDWQGQAFRGNNQQVLLEQLENQGIRIPYSCRAGICGSCRVQLLEGEVTPLKKSAMGDDGTILCCSCVPKTALKLTR

SEQ ID NO: 31483 - protein, 421 aa, Vibrio fischeri ES114
MNIFKKQESQVRSYSNNFPVVFQKAKGSWLETENGERYLDFLAGAGSLNYGHNNPVLKQALLEYIENDGITHGLDMHSSAKATFLNALSRYILEPRNLEYKVQFTGPTGTNAVEAALKLARKVTNRTNIVAFTNGFHGCTAGALAATGNQHHRQGAGVSLSNITRIPFEGYADIDGLNLFETMLSDNSSGLDKPAAVLLETVQGEGGLNVASNEWLQRLSKICKANDILMIVDDIQAGCGRTGTFFSFESSGIKPDMVTLSKSIGGYGLPMAVVLLKPELDEWKPGEHNGTFRGNNHAFITAAKALEIYWANDNFENHIKQSSSKVSDVILRTIKRHPKLFVQQKGRGMMIGIECKDGIISSDIAKTCFENGMVIETAGPDDEVVKFFCPLTITESELDQGLAIFEDAVDSIAAKHFKKAS

SEQ ID NO: 31484 - protein, 286 aa, Brassica oleracea
MEGKEEDVRVGANKFPERQPIGTSAQSDKDYKEPPPAPLFEPGELASWSFWRAGIAEFIATFLFLYITVLTVMGVKRAPNMCASVGIQGIAWAFGGMIFALVYCTAGISGGHINPAVTFGLFLARKLSLTRAVYYIVMQCLGAICGAGVVKGFQPKQYQALGGGANTVAHGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 31485 - protein, 88 aa, Trichodesmium erythraeum IMS101
MTNDSVPAKVMEIVAKQLEKDQKEVTPESSFANDLGADSLDTVELVMALEEEFGTEIPDEEAEKITTVQAAVDYIQNKMDDGKIKLEK

SEQ ID NO: 31486 - protein, 132 aa, Helicobacter pylori
SNIKYELDKESGALMVDRVLYGAQNYPANYGFVPNTLGSDGDPVDALVLSDVAFQAGSVVKARLVGVLNMEDESGVDEKLLALPIDKIDPTHSYVKDIDDLSKHTLDKIKHFFETYKDLEPNKWVKVKGFEN

SEQ ID NO: 31487 - protein, 132 aa, Helicobacter pylori
SNIKYELDKESGALMVDRVLYGAQNYPTNYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFEN

SEQ ID NO: 31488 - protein, 588 aa, Ustilago maydis 521
MASQEDTDDLYADLYGAATSEAGDEAFPRGEGGDDKAHAGDEQDLTGYEDSNNKNGNSSEKAEEKPTVAASTGSFIPPASSAPAQQSDTGLQIKGSFIPPPVVNSPAAHSQSDVRDLTPASHNDASSNQQSLSHQTQVADDRGEGQNAGTERQGLDNRSAMPHEMPEEGKMFIGGLNWDTTEDSLRRYFSQFGEVGNCAIMRDNMTGRSRGFAFLNFVDPKAVNTVMVREHYLDGKVIDPKRAIPRPQHNQQGGGHHNNYNNGGGGGGGGGSYSASSQKLFVGGLPPSVTPATFRTFFEQFGTLSDCTCMMDRETGKPRGFGFLTYADDSSLNHVLNTRPIVFDGKEVDVKRAQSKNDPQSLQIRRQQRMDNPEMAYGMQQGGAGARFNNYNTGASGGGGGMGGNAWQMNPMMMGMMGQGGDMSQMYQNMGWGNQNWNPQMAWQQMMASMAGNTGGGMDMGAMMNNMGMMGSMGGTMGSMGGMGSMSPPSMKQSMSPTVNAASAVPTGASAGGDDRTERSGSASAPSSSRQQRGGSVHNGASRPPPMGPRHDRERSPGRGGDGGYRRERSPDRRDDNRRYDSGQRNRY

SEQ ID NO: 31489 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFEN

SEQ ID NO: 31490 - protein, 314 aa, Trichodesmium erythraeum IMS101
MATTTLGTTGITVNPICIGTWAWGDKLFWNYGSNYGANEVEAAFKTSLEAGVNFFDTAEVYGNGLSEELLGKFMQETERPVQIATKYGPLPWRLFPDSVADAVTASLKRLIVPKVTLYQVHWPFTFLMSQETLLNALADEVKQGRIEAVGVSNYSEEEMSQAHKILEKRGVILATNQVKYSLLSRKIETKGILNTAKKLGITILAYSPLAQGLLTGKYTLEKSPTGARQFDFRFQKSGLEKIAPVMSLLNQIGEKYNKTPAQVALNWLVFQDSVIPIAGCKNSEQVRQNIGAIGWEMTQEEFNQLEQITRPWLN

SEQ ID NO: 31491 - protein, 132 aa, Helicobacter pylori
SNIKYELDKESGALMVDRVLYGAQNYPANYGFVPNTLGSDGDPVDVLVLSDVAFQAGSVVKARLVGVLNMEDESGMDEKLIALPIDKIDPTHSYVKDIDDLSKHTLDKIKHFFETYKDLEPNKWVKVKGFEN

SEQ ID NO: 31492 - protein, 495 aa, Sinorhizobium meliloti 1021
MKTTITSYKREWFSNIRGDVLSGIVVALALIPEAIGFSVIAGVDPKVGLFASFAIACVSAFAGGRPGMISAATAATAVLMVTLVKEHGLEYLFAATLLMGLFQIAAGFLKLGRVMRFVSRSVITGFVNALAILIFMAQLPELIGVPHLTYAMIAAGLGIIYLFPYVTKAVPSPLVAIAVLTAVDFWTGMDVRTVGDLGALPSSLPIFALPQVPLTFETLQIIFPYSVALAAVGLLESLLTAQIVDDMTDTTSSKSQECIGQGASNIASGLIGGMGGCAMIGQSVINVTSGGRGRLSTFVAGAFLLFLILVLDDLVRIIPMAALVAVMIMVSVGTFSWRSILDLRRNPLPSSVVMLATVVTTVGTHDLAKGVLVGVLLSGVFFAGKVARLFHVRSMLEESGKVRTYHVDGQIFFASTEGFIGAFDFAEPLEKVVIDVGEAHLWDITAVGALDKVVLKYRRHGVTVEVIGLNAASAHMLDRFAVHDKSEGASLTVTH

SEQ ID NO: 31493 - protein, 401 aa, Glycine max
MYKNQLQELAQRSCFNLPSYTCIREGPDHAPRFKATVNFNGEIFESPHYCSTLRQAEHSASEVALNSLSNRAPSHSLAARILDETGVYKNLLQEIAQRVGAPLPQYFTFRSGLGHLPVFTGTVELAGIMFTGEPAKNKKQAEKNAAMAAWSSLKQLAKETARSSTEPENNDELEQITIARALLNYRLKEKISMSNSNAPVPFPKKFQIQNPRPTSPQPPPAATSKILPLICQKAAPRSRHLVGASPARASCDNSAMPQLSATPESRGIRRPKFPAAGAAPYVPIRQMRPCQGMAPPVTIRTAIPVFSPPPAAAAVSHQVLRAPHVRVAPPVTIRQAVPVFATPPPPIRKDEPVPIPKDEPPTISAPSPEDKLPAKTPEAETKTENIPPKPDMVKSLEQLKI

SEQ ID NO: 31494 - protein, 174 aa, Triticum aestivum
  misc_feature (166)..(166): Xaa can be any naturally occurring amino acid
MSNPESSPQAAASSTSPPSHAGHIHTPLCRSCGAPAAAPAPAPWTGDSPPPAYRPIRMPAINAPTNTAAIVLSPVPQPLPVPPALPPFAFQAPAKRIASPDDIARFKDSTHGRHFLGFVASLSASVHGRKLPDPLPSPPSPAVSALLDLISALSAFVASTPPFPHXLRYGNPAF

SEQ ID NO: 31495 - protein, 170 aa, Bacillus anthracis str. Ames
MIYPYKEKNPKIASSAFIADYVTITGDVSIGEESSIWFNTVIRGDVSPTIIGDRVNVQDQCTLHQSPQYPLILEDDVTIGHQVILHSCHIKKDALIGMGSIILDGAEIGEGAFIGAGSLVSQGKKIPPNTLAFGRPAKVVRELTEEDRKDMERIRTQYVEKGQYYKSLQK

SEQ ID NO: 31496 - protein, 574 aa, Coprinopsis cinerea okayama7#130
MRAVVQRVTSASVTVDGEMVSQIGRGLMVLVGIGVDDNDTDIATLTKKILSLRVFEDQKDTSKMWKSSVKDINGEILCVSQFTLFANTHKGNKPDFHRAMSSDGSKAMYARFLEQLGKQYDAGRIKDGRFGAMMNVSLTNEGPVTFTLDSRKFDTSVDVETLTYTRWANNEPKHTTIPAHGSSVVTALLLSYGQIIAASDDNSISVHSLEGGKLEYKLVGHNGGVWALAATKDLIISGSTDQTVRVWDRKTGQCKHIFGGHASTVRCLTLVKPEVIDVEGDDGVTRKERWPKRDLIVTGSRDHSLRIWTLPRPEDPGYKTKFNEDGDISDDNVSNPYLRHHLEGHEHAVREISARGRIAVSGSYDCTVRVWDIINGVCKWTLQGHTQKVYSVVLDLARNQAYSGSMDGTVRVWNLQTGACQHTLTGHTSLVGLVGLSSSHLVSAAADSTIRVWNPETGDLQHTLAAHTGAITCFQHDEFKVLSGSDGNFKMWNIRDGTVVRDLLTGITGVWQVVFEGSWCVAAVNRQGATSIDIWDFGEVENEHVDCADEDPTEGEDDDEETNKLIRDFANKWC

SEQ ID NO: 31497 - protein, 788 aa, Coprinopsis cinerea okayama7#130
MVKKDEQDTSSVVGLAEAVERFGKKRAHNSDMMDIELTTESGVTVPPPRKKARATPLPPISTVNAAAPPSPLPSPHGSPPPETIWPSAPPSGAGSPAPLQPDLSLTALLALPNLVNHFANLPPQLQSHFLLTLMRHSPLSVLRTLQSVLTPTLARDFITLLPPELVSHILSFLPFSTLARASRVSKAWRAIIDSDAVLWRDLLQSTKIWFGGESEQAFANSIFARRRRLQQQQPNLPKSLPLPHPYKILFKSRHLTWTRWVNNQDPKHISVPAHGSSVVTCLIFSHGRIISASDDHSIHVYSPETGELIRELKGHDGGVWALAATKDTLVSGSTDRTVRIWDLNTGKCTHIFGGHTSTVRCLAIVKPELVNIEGKDGVIRREKWPKRPLIVTGSRDHSLRVWTLPRPEDPEYRSSSAEDHDGDAGEHHLEDTRRNPYHRVLLEGHDHAVRALAARGRTLVSGSYDCTVRVWDIIDGVCKWTLQGHTQKVYSVVLDLARNQACSGSMDGIVRVWNLQTGACQHTLTGHTSLVGLLGLSSSHLVSAAADSTLRVWNPETGDLQHTLAAHTGAITCFQHDEFKVLSGSDGNLKMWNIRDGTVVRDLLTGITGVWQVVFEGRWCVAASNRQDTTVIDIWDFGKDEDEDWIGEPPHGNYDDEDFIDDGDDDDEANERIRRFVTMQDDDEEQADIDAMDQDLVPSESESLEILEDVDEEMRLDSQGRDDLDDEQPPADSDTEAPQSEASEAVQRWNIGKLKSFTDIEESTTSTSPRATAHGTLDIHYYRYITAA

SEQ ID NO: 31498 - protein, 934 aa, Debaryomyces hansenii CBS767
MLSSKNDHSVDENSDLLELSDSISPSDISNHSFYGNFKRSSSLPIQSNLPTLFNNLRANDRKELSNSGTSPGRSWLRKLMSPSNKLNDLGSMENTKPGWAGKNANSKSLGDNTNSEEDSYDISLDNERETSAYPFKDIDQVKIPPVFFKEGLSLLKVSHKSKKRTFFQIGEKDFQFSLKNAYASASTTASSGLYRLLTPTSSYQPKNKSYEFSIDDIKAISYQKDASNYRKELHVSKEFESQWLTIIYFDKKKKKLKTIHVIADTEHDLKKLLSVLSGLKKLRNNLAKNYLLDLNDIDETQRNMFIGRSQEENEKEIRKFLSFNDILKYSKRLNINMNPTYLRTIFNFVCADSSVDRGLDFDQFKQFVSILKTRHDITHIWNSTCGENKSMTFDIFKNFMTDVQKESFTEEYLRKIFRKFCIEDKNYWIPENFNNFLLSKYSTSMYNAATNESYFDHPLNEYFISSSHNTYLMGRQVAGDSSIEGYIKALQRGCRCVEVDIWDGYIDGMDDNDKTNNEPIVSHGRTFTSSISLNNVFKTIKKYAFITSPFPLIISLEINCSIDNQLKVVRTLKEVLGDTLITQPIDDKFTLPTPLQLKHKILLKVKKTSPFSDLIASENGNYVSSTTTTTTSFSEDNGSGGVKRRSSFSIRRRKARKITDTLSDLGIYLQGVKFRNFSLPESKTFNHCFSLSEKSINTMLKDDIKCTSIDKHNRKYFMRVYPSNIRLKSSNFLPMKYWSHGVQMVATNWQTYDLGQQINESLFESTNRRGYVLKPEDLRKPLLKSSNRSIVAKRTIKTKFDIEIISAHQLPKPKGSVSAINPFINFDITGASDIVWDRGSAPLRTSIIPENGFNPIWNEKFSGTITTFDDFVFVRFLINASSSISEVEEIQPIGILVCKLFDLKKGYRYLPINDLLGEELIYSTLFVKINYYEL

SEQ ID NO: 31499 - protein, 387 aa, Zea mays
MSETESAAAAPVAAAESKPRRLRGHKKGAVTCCVASSARPGVVASSGEDGCLCWFDLRTKDVLLTMEAANKPISSICFKPGNEDFVYISAGNEILSFDVRMGTQTKPLETYNYNRDEINQIAVSSKGFLAAADDSGDVKIVNTIQKCLYKRLREAHTSICSSVQFIPWRPWTAITGGLDSKLAAWDFSKGRTLFSIDYGSPELQNGSSSGSAGQCFNPAFVHSVAVSEEGILGGLYKVCAVARGDGAVDVVDLEYELAPAKSKGPPRAAILTTRSKGAELGDGSCNQSRAKRIHLDYTMGGHTAAVSCVAFSAFGEKGKFLISGGNDASVKLWDWSKGFYSETNSKVDLVLDIDVKKKVNWLCTAPTDSDNLIVCDTSKVVKVYSFR

SEQ ID NO: 31500 - protein, 368 aa, Burkholderia sp. 383
MKTKAAIAWKAGAPLTIEEVDLEGPRAGEVLIEVKATGICHTDYYTLSGADPEGIFPAILGHEGAGVVVDVGPGVGTLRKGDHVIPLYTPECRECKFCLSRKTNLCQKIRATQGKGLMPDATSRFSLDGKPLFHYMGTSTFSNYIVVPEIAVAKVREDAPFDKICYIGCGVTTGVGAVVYSAKVEAGANVVVFGLGGIGLNVIQGAKMVGADKIIGVDINPKRVELAKKFGMTHFINPNEVENVVDHIVQLTDGGADYSFECVGNVKLMRQALECTHKGWGQSFIIGVAAAGEEISTRPFQLVTGREWKGSAFGGARGRTDVPKIVDWYMEGKINIDDLITHTLPLERINEGFDLMKAGESIRSVVLY

SEQ ID NO: 31501 - protein, 459 aa, Acidobacteria bacterium Ellin345
MSRHFDAIIIGTGQAGPSLAARFSDAGMSVAIIERNKFGGTCVNTGCIPTKTLVASAYAAHVACRGADYGFTTGGAVQVDMKRIKARKDAVSGKSNKGVEEWLRGLKNCTVIQGHARFRSARTVSVNDELLDADRIFINVGGRASVPELPGIHDVPFLNNSSMMDVDFLPKHLVVVGGSYVGLEFGQIYRRFGSEVTVIEMGPRLVGREDEDVSQSVREILEAEGIKIRTDAKCISLSKHEGGIAVGVDCEDGEPEVIGTHVLLAVGRTPNTQDLGLDQAGVATDARGYITVDDHLQTSVPGIWALGDCNGRGAFTHTSYNDYEIVADNLLNGDHRRVSDRIQTYALYTDPPLGRCGMTENEVRKSGRKALVAKYPMSRVSRAVEKGETQGLIKLLVDAETKQFLGAAILGTGGDEVVHVLLDMMYAKAPYTVVQRAMHIHPTVSEYLPTILGKLEPLK

SEQ ID NO: 31502 - protein, 499 aa, Physcomitrella patens subsp. patens
MATVPPLKFTVRDPNGLSLLTGPPFSGEPAATFEKIPCSASKFSNDGSKLAVTTPNALVIYDTDSGKELIQIPAAGVASAVFSPLGTYLQTFQKPQGQQKNLVLWDSKTGSIVLQQFQKAISKTSWPVIQFSDDESVACRLVTNEVHIFDGHDFSKGIIDRLRLPGIDGVQLAHSPASHIAAYVPEIKGAPANVRIFELANVSQAQSVARRSFFKSNTAQLSWNKGSTGLLVLAQSDVDKTNQNYYGESRLHYLTSDGRHEGAVPLSKEGPIYDVQWSPNGKEFLVVYGFMPAKVTLFNVQCKPLFEFGQGPYNYLRWNPQGSFICLAGFGNLPGDVAFWDRESLKCFHTLKAPVTVTAEWSPDGRYFMTATTAPRLQVDNGFKVFKYDGTPHYEKKYDKLYQAEWRPASSDVYPDRPPSPGARKLESKVEAPKTVQPRTGTKPGAYRPPHAGQAASVKAQLLGLDETSKASTGSSAGLSKSALKNQKRRQKKKEGADS

SEQ ID NO: 31503 - protein, 227 aa, Arabidopsis thaliana
MGDNGESIKWPKIKLKSNLNVSYLKNHDLFTVENCLTSDESRAFVKIAESLGFTHQGSRGPAYGEAYRDNHRISVNDPVLADTLWQSGLSNLFTDIKIRRKVAVGLNPNIRFYRYSAGQHFGRHIDESADLEDGNRTYYTLLIYLSGNSTKSKSKSSSSKTNDSSSAEPLVGGETVFYGSRNSIVAEVAPVEGMALFHIHGDKCMLHEGRNVSKGVKYVFRSDVVFA

SEQ ID NO: 31504 - protein, 504 aa, Salvia miltiorrhiza
MDLLLLEKALIGLFSAIVVAAVVSKLRGKKFKLPPGPIPVPIFGNWLQVGDDLNHRNLTDYAKRFGDIFLLRMGQRNLAVVSSPELAKEVLHTQGVEFGSRTRNVVFDIFTGKGQDMVFTVYGEHWRKMRRIMTVPFFTNKVVQQYRHGWEAEAAAVVEDVKKNPESATNGIVLRRRLQLMMYNNMYRIMFDRRFESEDDPLFVKLKALNGERSRLAQSFEYNYGDFIPILRPFLRGYLKLCQQVKERRLQLFKDYFVDERKKLVSTKGGDNGLKCAIDHMLEAQQKGEINEDNVLYIVENINVAAIETTLWSIEWGIAELVNHPEIQNKLRHELDTVLGPGVQITEPDTTKLPYLQAVVKETLRLRMAIPLLVPHMNLHDAKLGGFDIPAESKILVNAWWLANNPDHWKKPEEFRPERFLEEEAKVDANGNDFRYLPFGVGRRSCPGIILALPILGIAIGRLVQNFELLPPPGQSKIDTSEKGGQFSLHILKHSTIVLKPRSF

SEQ ID NO: 31505 - protein, 132 aa, Helicobacter pylori
SNIKYELDKESGALMVDRVLYGAQNYPANYGFVPNTLGSDGDPVDVLVLSDVAFQAGSVVKARLVGVLNMEDESGMDEKLLALPIDKIDPTHSYVKDIDDLSKHTLDKIKHFFETYKDLEPNKWVKVKGFEN

SEQ ID NO: 31506 - protein, 418 aa, Zea mays
MVSDQEIASCVESVLRGSAGGPGEVSLAAVLQQAAATLGVDLSHKAGFIRDQMDLFFGPRLQPQPPSKPQPAPSPPQAVVAPAAAVPQPHVLPQVQAHAQAQQMQPQQLAPLQPQLIFQTIPQLSAMAPVPAVSAPPAVPAMAFYPPPPLAFRYTTGLAGAATGGTVSFQQPTPGAGGTASPTAAPQVAGDNKESASKRKRGGPGGLNKICAISPELQTIVGETAMSRTQIVKQLWAYIRQNNLQDPDDKRKIICNDELRVVFETDPPDMFKMNKLLAKHITPLDPKDQLHEVKRMRAPTVAPQPPPPINQPSVVISDALAKFIGTDGTFPQDDALKYLWDYIKANQLENNHTMCSGFLLQVCSEYHHLKCKFTVPFLEDVINGSILCDSKLQELFGCESIPMSGLSEMLGHHFIKKT

SEQ ID NO: 31507 - protein, 598 aa, Neurospora crassa
MDNTNRPHLNLGTNDTRMAPNDRTYPTTPSTFPQPVFPGQQAGGSQQYNQAYAQSGNYYQQNHNDPNTGLAHQFAHQNIGSAGRASPYGSRGPSPAQRPRTSGNSGQQQTYGNYLSAPMPSNTQTEFAPAPERNPDKYGPNANNNQKKCSQLASDFFKDSVKRARERNQRQSEMEQKLGETNDARRRESIWSTAGRKEGQYLRFLRTKDKPENYQTIKIIGKGAFGEVKLVQKKADGKVYAMKSLIKTEMFKKDQLAHVRAERDILAESDSPWVVKLYTTFQDANFLYMLMEFLPGGDLMTMLIKYEIFSEDITRFYIAEIVLAIDAVHKLGFIHRDIKPDNILLDRGGHVKLTDFGLSTGFHKLHDNNYYTQLLQGKSNKPRDNRNSVAIDQINLTVSNRAQINDWRRSRRLMAYSTVGTPDYIAPEIFTGHGYSFDCDWWSLGTIMFECLVGWPPFCAEDSHDTYRKIVNWRHSLYFPDDITLGVDAENLIRSLICNTENRLGRGGAHEIKSHAFFRGVEFDSLRRIRAPFEPRLTSAIDTTYFPTDEIDQTDNATLLKAQQAARGAAAPAQQEESPELSLPFIGYTFKRFDNNFR

SEQ ID NO: 31508 - protein, 276 aa, Oryza sativa Japonica Group
MAASHGNAIFVLLLCTLFLPSLACDSGGVKFGYTGSIGPDFWGNLSADFTRCSNGKQQSPIDIDTNNLVHELNMEPLHRNYTAANATLVDNIFNVALRYEEAAGVLSINGVKYTLKQMHWHSPSEHTINGFRFPLELHMVHTNENGNITVLAFLYRFGRPDPFFEQDKLAALNAEGCKAEKGSPVPAGSVSLLTMRQHVHIYYRYVGSLTTPPCAENVIWNIPAMPREMTPQQAADLMAPLDEGYRRNSRPTQQMNGRTVQLYHRFWGKKKRRSSP

SEQ ID NO: 31509 - protein, 259 aa, Bordetella petrii
MFAPDILQGRVAMITGGAGGIGLDIAKTYGRLGARVVLASRNQDRLDHAAAQLSEEGIDVLAVRADVRNYDEVKAAVESAVTHFGALDILVNNAAGNFYCPTAELSPNGWRTVIDIDLNGTFYGCHAAYKHLKQSPFGGCIISIVTMLGLSGWPGAAHAGAAKAGILSLSRTLAVEWGADNIRVNTISPGPIGDTEGVRRLYQETGREELERKKTALGRFGRKTDIANAATYLASDMAAYITGENMIVDGGRWLKYVAA

SEQ ID NO: 31510 - protein, 430 aa, Oryza sativa Japonica Group
MAAGAVSALFLLDIKGRVLVWRDYRGDVSALQAERFFTKLLDKESDAEVLSPVVHDDAGVSYMFIQHNNVFLLTASRQNCNAASILLFLHRVVDVFKHYFEELEEESLRDNFVVVYELLDEMMDFGYPQYTEAMILSEFIKTDAYRMEVTQRPPMAVTNAVSWRSEGIRYKKNEVFLDVVESVNILVNSNGQIVRSDVIGELKMRTFLSGMPECKLGLNDRVLLEAQGRTTKGKAIDLDDIKFHQCVRLARFENDRTISFIPPDGSFDLMTYRLSTQVKPLIWVEAQVEKHSRSRIQITVKTRSQFKERSTATNVEIEVPVPEDSTNPNIRTSMGSAAYAPERDAMVWKIKSFPGGKEYMCRAEFSLPSITSEDGMPEKKAPIRVKFEIPYFTVSGIQVRYLKIIEKSGYQALPWVRYITMAGEYELRLI

SEQ ID NO: 31511 - protein, 121 aa, Glycine max
  misc_feature (85)..(85): Xaa can be any naturally occurring amino acid
  misc_feature (89)..(89): Xaa can be any naturally occurring amino acid
MGKKFFVGGNWKCNGTTEEVKNIVTTVYDANVPGEDVVEVVVSPPFVFLPVGERLLPPDFHVSAQNCWIPKGGAYTGEDSAELLXVNLXNSSSLTRHSKRKHLLHESDEPVRDNTNNALQG

SEQ ID NO: 31512 - protein, 136 aa, Trichodesmium erythraeum IMS101
MVKYNQANLAPKLSIPSNLQGFTPTERPWGSFTILEEGNRYKIKRIEVKPGHRLSLQMHYHRSEHWVVVSGTAKVTCGNKEEILENNQSTYVPQCTPHRLENPGVIPLVLIEVQNGEYLGEDDIIRFQDDYARTNS

SEQ ID NO: 31513 - protein, 316 aa, Listeria monocytogenes str. 4b H7858
MTMYAKNNTAGKDMLSLLEWNKEELTDIIKLAVAMKTNPAHYSHILSGKILGMIFDKPSTRTRVSFEAGILQLGGQAIVMSSKELQIGRGEPIKDTAHVMSEYIDAIMIRTFSHEKVEELAYHAEIPIINGLTDLHHPCQALADLMTIYEWKDQLEGVKLAYIGDGNNVCHSLLLAGAMVGIDIRLAMPKGYEVDETILAKAENLAKQSGGKIFVTEDPKLAVTDADFIYTDVWTSMGQEDENAKRLADFGEKYQVNAELVSGAKPDYHFLHCLPAHREEEVTAEIIDGNHSVIYQQAGNRLHAQKALLAAILEAK

SEQ ID NO: 31514 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPIDKIDPTHSYVKDINDLSKHTLDKIKHFFETYKDLEPNKWVKVKGFEN

SEQ ID NO: 31515 - protein, 451 aa, Aspergillus fumigatus
MMACSPKCRAKSRPIHILQNQIVLDVNIYMMPSHATMSSPPAGTKLDLSKKLSELRASRRSHSGPSPREPTPVTPPLPSPPDLSTHTYTRPVRRILSRKDHETFLASSTYTLVVSFTFSLSDSVRGRAVTDNKDQPASPNISRILSVIDTIRQLVDKHPSIDQGGSRFGNPAFRDLFDDVAAQNATWHREIIGLQNADAIEEVSSYLVHSLGSRDRLDYGSGHELNFMMWLLCLRQMQMISTADFPMIVFRVYLEYMRLMRQVQMTYYLEPAGSHGVWGLDDYHFLPFLFGAAQLVDHPYITPLAIHNTAVLDEEGDKYIYLDQVRWVDSVKTVKGLRWHSPMLDDISGAKNWLKIEGGMKKMFIKEVLGKLPIMQHFLFGSLLPADPSMGERSDDAQEDDLHDHGNGNPHARHTDHFGDCCGIKVPSTVAAGAEMRKRIGGTGLRPIPFD

SEQ ID NO: 31516 - protein, 320 aa, Oryza sativa Japonica Group
MAATLSQLDDGIVRGMAIGAVFTDYAGKINCLDFHRKEDLLVTSSEDDSIRLYNITSATLLKTTYHRKHGADRVCFTHHPSSILCSSRYNLESAESLRYLSLYDNRCLRYFKGHKDRVVSLCMSPVNDSFMSGSLDHSVRIWDLRVNACQGILRLRGRPSVAYDQQGLVFAVAMEGGAIKLFDSRSYDKGPFDTFLVGGDTAEVSDIKFSNDGKSMLLTTTNNHIYVLDAYGGDKRCGFSLESSPNVATEAAFTPDGQYVISGSGDGTLHAWNINTIQEIACWNSHIGPITALKWAPRRAMFATASTALTFWIPNNSSSN

SEQ ID NO: 31517 - protein, 495 aa, Glycine max
MESAALSRIGLAGLAVMGQNLALNIAEKGFPISVYNRTASKVDETVDRARNEGSLPLTGQYTPRDFVLSLQRPRSVIILVKAGAPVDQTIAALSDHLDPGDCIIDGGNEWYENTERRMSLVADKGLLYLGMGVSGGEDGARHGPSLMPGGSHQAYSNVQDILHKIAAQVEDGPCVTYIGEGGSGNFVKMVHNGIEYGDMQLISEAYDVLKHVGGLSNSELADIFAEWNRGELESFLIEITADIFKVKDEDGEGFLVDKILDKTGMKGTGKWTVQQAAELSIAAPTIAASLDCRYLSGLKEERESAAAVLKEAGLSDELGRVSVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARKSGTGVGALN

SEQ ID NO: 31518 - protein, 411 aa, Sinorhizobium meliloti 1021
MKGRAARPVLFFFFQRSTRSSDVKALTWHGKGDIRCESVPDPKIEDDRDAVIKVTACAICGSDVHIFHGLIPSMENGDILGHETMGEVVEVGKGARGLEVGDRVVVPFTIACGECFFCRKGFYSACERTNPDREKAAKLWGNSPAGLFGYSHLLGGYSGGQAEYLRVPHADVGPIKVPDELTDEQALFLSDIFPTGYMAAEFCNIEPGQTIAIWGCGPVGQMAIRSAFLLGAERVIAIDSIPERLRLAESAGAMTLDYMAEDIYDRIMEITHGRGADACIDAVGTEADSRASLDSLVDRVKVATFMGTDRPHVLRQAIHCCRNFGTVSVVGVYGGYLDKVPLGSAINRGLTLRMAQTPVQRYLPSLLDRIRKGEIDPSFVVTHRGGLDDGPELYKTFAERKDGCIKVVLRP

SEQ ID NO: 31519 - protein, 327 aa, Streptococcus agalactiae A909
MNKEKIIIDCDPGIDDTLALMYAIQHPKLEVVAITITAGNSPVELGLKNTFVTLELLNRHDIPVYVGDNLPLQREFVSAQDTHGMDGLGENNFTLAQPIIFQEESADCFLANYFEHKNDTSIIALGPLTNISRALQTNPKLGKHCKRFISMGGSFKSHGNCSPVAEYNYWCDPHAAQYVFENLDKKIEMVGLDITRHIVLTPNHLSYMERINPDVSSFIQKITKFYFDFHWQYEHIIGCVINDPLAIAYFVNENIATGFDSYTDVACHGIAMGQTIVDQYHFYKKDANSKILTSVNTNLFWNDFMTVLLHAQNSVIIEDLEMLGLNK

SEQ ID NO: 31520 - protein, 331 aa, Clostridium perfringens SM101
MSKVAFLGAGSFGTSLGILLGNKGVTVSLWDRDENVINDINVNRKNDKYIKDLTIPTNVTAYKDLDEALNGAEYVVLAVPSHVIRTACKNLKGKINDDVIIINIAKGIEEGTNLRLSQVINQELPNNKVVVLSGPSHAEEVSKGIPTTLVASSECMECAEKVQDLFMDKNFRIYTNDDIIGVEIGGAVKNIIALAAGVCDGIGYGDNSKAALMTRGMAEIARIGIKMGGKAETFFGLTGMGDLIVTCTSMHSRNRRAGILIGQGKTAEEAIKEVGMVVEGIKACKAFYELKEKEGVTMPITDIAYKVLFEGAKAENAVSLLMERDKKKEEI

SEQ ID NO: 31521 - protein, 211 aa, Solanum tuberosum
MSNENDDLSPQRRAPRLNERILSSISRRSVAAHPWHDLEIGPEAPSVFNVVIEISKGSKVKYELDKKTGLIKVDRILYSSVVYPQNYGFIPRTLCEDNDPMDVLVLMQEPVLPGCFLRARAIGLMPMIDQGEKDDKIIAVCADDPEYRHYTDIKQLPPHRLVEIRRFFEDYKKNENKDVAVDDFLPPSSAVNAIQYSMDLYAEYILHSLRK

SEQ ID NO: 31522 - protein, 550 aa, Prochlorococcus marinus str. MIT 9312
MQIINGFHLKNVRGDILGGITAAVVALPLALAFGNAALGPGGAIYGLYGAVVVGFLAALFGGTPAQVSGPTGPMSVTVAGVVAGLAAVGVPRDLSAGQILPLVMAAVVIGGLLQILFGILKLGKYITLVPYSVVSGFMSGIGVIIIALQIGPLLGISTRGGVVESLSTVFSNFQPNGAAIGVAIMTLGIVFLTPRKISQWVPSPLLALLIVTPISILIFGDGAIDRIGEIPRGVPSLNFPSFNQYFPIIFKAGLVLAVLGAIDSLLTSLVADNISQTKHNSDRELIGQGIGNAVAGLFSGLPGAGATMRTVINVKSGGSTPISGMVHSVVLLIVLVGAGPLAEQIPTALLAGILIKVGLDIIDWGFLRRAHKLSLKTSVVMYGVLLMTVFWDLIWAVLVGVFIANMLTIDSITETQLEGMDEDNPLSKDDQAKNALPADEKALLDRCSGEVMLFRLKGPLSFGAAKGISERMMLVRNYKILILDITDVPRLGVTATLAIEDMMQEAKNNSRKAFVAGANQKVKDRLAKFGVEGIIETRKEALETALNELG

SEQ ID NO: 31523 - protein, 476 aa, Magnaporthe grisea 70-15
MSGPVPQARSLADIYPEAALDVQRTRWQNLVSRFESLYGHPPAFIARSPGRVNIIGEHIDYSLYSVLPMAITADCLIAVSPTAAAGSDTYKVRLANVLPEKFAAKDLDLPVKGDVEIDSTVHEWTNYFKCGLKGATELLRKKHGEGFVPTGMEVLLDGSVPAGGGLSSSAAFTSTTALAVMVANGEKNIDKKELTELAIVSERGVGVNSGGMDQSASVFSQRGSALFVSFTPTLTAKPVSFPTTNPELCFVIAQSFVTADKFVTGPIHYNLRVVECSLAAAYLNAVLNAPGHTLPTDSSPLGSPLHGFHETYFALREADGQKVPIAVPEQLALLLALTRATLTKDEGYTRDEVAAALGITVDELNARFTSRFPVRAERFKLRQRAEHVFSEALRVLEFMSLLQQEPAAGSADDTAVYNALLGAKLNETQDSCRDLYECSCPEIDTICATARSAGSVLSLSVGLVAEVPSLSSVRVV

SEQ ID NO: 31524 - protein, 446 aa, Opitutaceae bacterium TAV2
MSKPHTSALPGGGATTASTPATTPAMHPVTPALKLKANAKARVLAGHPWVFANEVEALLPAELDGEVVECRDRAGRTLGTGIYNSRSQIIWRRLSRRRVTLDRDWLRGALQRALVRRQPLPEHARLVWSESDELPGVVVDRFGATLVLQVQTVAMEKRLDTLLSLLDELLAPEEIIVRNDAPIRRLEGLPLHVTTRSGRPWTPRWERIDGLDYWLDLQAGQKTGFYLDQREQHAAVAKYCEGKRVLDAFCNQGPFALHAARAGATEVLGLDSAEDAIAQARRNVERNHLAADGRVRFEVANVFDWFNANSASSMRPSPPPPSPARSTTAPASAATAATATAGLWDVIVLDPPPFAKSKSALPGALRGYKEINLRALQRLAPGGVLATYTCSHHMQDADLRGVLAAAAVDARRDVRILECCHQPADHPVLVTMPESEYLRGFIVRAE

SEQ ID NO: 31525 - protein, 379 aa, Pseudomonas putida GB-1
MLCIGTAAHPKDDQTVVLGTAVHAQSTRRHSLETLGHVLHQYLHALRQPWLPSRPVTLSGCLWQLPGVTGRTRAVVQHLGILCSLCAENRQEHTDSKQPFRHAERPSGLGAALRSVARAIVRHPMPVLLRWENEHTKTGALYTSAIQTETTPLARLGPTESGNTHIGYPMQVKNPILGLCQKATFALSAAKVEQCPDDQGYEVAFAGRSNAGKSSALNTLTHASLARTSKTPGRTQLLNFFSLDDERRLVDLPGYGYAKVPIPLKQHWQKHLEAYLGSRECLRGVILMMDVRHPMTDFDKMMLDWAKASGMPMHILLTKADKLTHGAGKNTLLKVQSEIRKGWGDGVTIQLFSAPKRLGVEDAYRVLAGWMELEDKPVA

SEQ ID NO: 31526 - protein, 506 aa, Porphyromonas gingivalis W83
MLSTEHFLLFASIVLFAGIMAGKVGYRFGIPTLLIFLFTGMLFGVDGFGFQFSNADVAQSVGIIALSIILFTGGMDTRIRKVRPVIAQGLTLSTLGVLLTALLSGFFIFWLSGSDFGPYPFALSTSLLLAATMASTDSASVFAILRSQKMQLKENLAPTLEMESGSNDPMAYMLTIALIDFITTGQSGIGSIVLTFILQFVVGGTLGFLMGRLAVFILNRMNIHNDTLYPITLLCMVFFTFSVTSLLQGNGYLAVYIAGIVVGNNRVIHKKSINTFLDGITWLVQIILFILLGLLVNPREMLDVAPFSLVVGAFMILIARPLAVYFCLIPFRKISFRGKTFLSWVGLRGAVPIIFATYPMIDNIPGADQLFNVVFFITILSLLVQGSTISQVARWLGLDIPSPPIGSLFGVEIPEETGTKLEERVVDASMLSHGDLLMNLSLRDEELVILVRRGEGYRVPKGRMHLQVGDVLLIVSEKNLSQTLTSGDPENHPGLLQRLKHRLLRR

SEQ ID NO: 31527 - protein, 402 aa, Zea mays
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFNEALDTTKTVIWNGPMGVFEFEKFAAGTEAIAKKLAELTTTKGVTTIIGGGDSVAAVEKAGLADKMSHISTGGGASLELLEGKTLPGVLALDDA

SEQ ID NO: 31528 - protein, 384 aa, Mycobacterium sp. JLS
MEVSATLLLELGVILAALTVLGTIARRFALSPIPLYLLAGLAVGEGGLAPVPAAGDFVETGATIGVVLLLLTLGLEFSIGEFATSLRRHLPSAGVDLVLNAAPGAIAGWLIGLDGVGILALAGVTWISSSGVIARLLSDLRRLGNRETPAVLSILVLEDFAMAAYLPLLAVLATGGTFLQALLGMAIAVSALGFAFVVSYRWGHHVGRLVVHPDNEQLLLRILGLTLIVAALAEFIHASAAVGAFLVGLTLTGEAAERARTVLTPLRDLFAAIFFLAIGVSVDPAALIPMLPVATALAVATAATKVLTGQFAARRDGVGRPGQLRAGTALIARGEFSLVIIGLVGASVEALEAVATPYVLILAMVGPVLARFTGGRAPARRRPG

SEQ ID NO: 31529 - protein, 369 aa, Oryza sativa
  misc_feature (281)..(281): Xaa can be any naturally occurring amino acid
  misc_feature (297)..(297): Xaa can be any naturally occurring amino acid
MASLADSFLADLDELSDNEAYPEEENAEAVGMDEDGGEDMLDLESLNYDDLDSVSKLQKTQCYNDIMQKVEDALQKGTDFSNQGSILEEDPEYQLIVDFNALSVDIENEIIIIHNFIRDKYRLKFPELESLVHHPIDYARVVQKIGNEIDLTLVDLEGLLPSAIIMVISVTASTTSGKPLSEENLVKTIEACERALTLDAAKKKVLEFVESRMGYIAPNLSAIVGSAVASKLMGTAGGLGALAKMPACNVQLLGAKRKNLAGFSTATSQFRVGYFEQTDVXFQSTAPALRTRACNLXCKSTLAARIDSIKGDPTGKAGRYLREDIRQKIGKGQEPLLESFQTSFCFRFEANERKGGVGSKIDDRFCSCY

SEQ ID NO: 31530 - protein, 498 aa, Debaryomyces hansenii CBS767
MVALERKRKISGSEQPNGTKKFKSATSSFVLHSYSKLPDLNSIPLAKTQPLDVFVWGTGSMCELGLGPSAKTKEVKRPRLNPFLTSEHLGDSKIVDFAAGGMHTLALDSDNRVWSWGGNDSGVLGRDTSKVKEVLKDMDADDSEDDDDGDLNEAESTPGLVENLPKLKGAKIVQLAATDNLSAVLYDNGDVYAWGCFRCNEGLLGFLRDEIKLQKTPLKIKQLKNVVQLARGKDHLLALDSKGIVYAWGNGQQFQLGRRVLERHRYNGLEPKQFGLYNIKYIASGDFHCFAIDHDDQVYAWGLNQFGQCALTDSDGKLEDGSLITSPTIIPELSKKGITHLCAGEHHSMALTGDGLVLSWGRYDMKEVGIPKDKLPESTFKDAHGNARSVPTPTKLQFGLKSDNGVKCKTIACGSHHSFAVTDDGFVYAWGFGDTYAPGLGPLEEDVEKPTRIVNTATKYHDIQQINAGGQFSISGGVKIDDEDKAEDRIEKYEEIDG

SEQ ID NO: 31531 - protein, 492 aa, Oryza sativa Japonica Group
MPASTMGGGGGGGRGGGDHHSPTSGKTPRGDYSALATSTPTKQSPRWPSPSAAASSVLPSGAAALLESRWALPAAFGVFLFLAVTLAVATSSLSVAASLPAFFPAAKQPLPLPPPSPPPGAGVARLAYLVSGSKGDLDRLWRTLHALYHPRNLYVVHLDREAAVSERLELAARVANSSMFRRVGNVEVIRRSNMVTYRGPTMVANTLHACAVLLRRSRDWDWFINLSASDYPLMTQDDILHVLSSIPRNTNFIEHTGYLGWKDFVLTNEAGWQCRGQRARPVIVDPGLYMARKQDIFYVEQRRELPTAFKLFTGSAWVALSRDFAEYVVWGWDNLPRTLLMYYANFVSSPEGYFQTVLCNAPRFVPTAANHDLHHIQWDTPPRQHPHPLALADRPAMERSGAPFARKFPRDDPVLDAIDADLLGGRGRANGNGTAGAEGDMFVRGGWCVGAGGGCDEVGDDWVLRPGPGAARLDKLMDRIVRSEAFVNSQCK

SEQ ID NO: 31532 - protein, 314 aa, Prochlorococcus marinus str. MIT 9312
MQNKYLIKASKKFWFWFWMQLMNGFAPSDIQGNYKRPLGITINSEYDINNENGEICLLVGNSCPWCQRTLLVHKIKQLSKEVKVVFLKADVEHGEWIFNKNFKGCTRLSDLYKKANKKIIFRATLPLLISFVKDKVNIISNESSQIIRLLNSIESKSKDNILTIKDCNQKILDLIHNNINDGVYKCGFARNQSAYEKASKNLFAALNEIEDTMSRNKGDWIFGEELTYADIYLFPTLIRWELIYSKLFKCTEQELSYFEEIIEWRLKFFKISNVDKTCFDNEWKKDYYKALFPLNPNQIIPVLPSLREIIRSES

SEQ ID NO: 31533 - protein, 454 aa, Staphylococcus sciuri
MKKFDVVFIGSGHAAWHAALTLKHAGKSVAIIEKDTIAGTCTNYGCNAKILLEGPYEVLEEASHYPQIIESDQLHVNWENLMQYKKAVINPLSNTLKSMFEQQGIEVIMGAGKLVDAHTIDVEGTPIQADNIVIATGQHSNKLDIEGSALTHDSRDFLSLDKMPNNITFIGAGIISIEFASIAIKSGAEVHVIHHTDKPLEGFNEKHIAKLIHKLESEGVQFHFNENVQSVQQAGNSYNVTTESGLSIDTEYVLDATGRKPNVQNIGLDELGIEYSEKGIRVDDHLRTNIHNIYASGDVLDKTIPKLTPTATFESNYIASHILGINPNPIQYPAIPSVLYSLPRLSQIGVTVKEAEDNEAYTIKDIPFGKQMVFEYKNEIEAEMTIILNADKQLVGAEIYADDAANLINLLTFIVNQKLTAKDLNQLIFAFPGSSSGVLDLLKSCYDVIYKKQR

SEQ ID NO: 31534 - protein, 563 aa, Oryza sativa Japonica Group
MERENSWLRRTKFSHTVYTRLDHQRAPIAPLGRDVEQKLQRFISMGKSVSMPVNRDEDAVAAFKHSVSLPTARSSLQIDKEKANKQKADFDIPSSPPVNSVNSKGLKARSLVKSPSSAMLLSYLNKAHPNRDSNLKKTDRPQHKLRSKSPLPNVAPSDVFREARASSRRFTSPPPKRRGSERSIYGKSFDRQLSDMSQSPDLCSTPVSSDKHKSLKDSSWTRRYFDNGGRRRVSAVDATEVRRNRGVSMAQAVQTTVDWTLDPSKLLVGHKFASGAYSRLYKGLYDDKPVAIKFIRQPDDDDNGKMAAKLEKQYNSEVNALSHLYHKNVIKLVAAYKCPPVFYIITEFLPGGSLRSYLNSTEHHPIPLEKIISIALDVACGLEYIHSQGVVHRDIKPENILFDENFCVKIADFGIACEESMCDVLVEDEGTYRWMAPEMIKRKAYNRKVDVYSFGLLLWEMISGRIPFDDLTPLQAAYAVATRHARPVIPPECPMALRPLIEQCCSLQPEKRPDFWQIVKILEEFHSVLSQGGCLDSLKSSNSQDQKKRLLHWIQKLKPSHST

SEQ ID NO: 31535 - protein, 155 aa, Triticum aestivum
MAHMRVVHRDEEGHKVAEKLPVPETRRPDTARHVERKLEEQGLHRLERHPANAPRGVGIGAPPPKSGRGGKYTWEGPEGLVDSELDPAPAAIDRNDPNYDEEVRWRTRTHGRPRQRCAPRKKKHTLPPASARRGPAPLPGVRSTASLYIVLLSSS

SEQ ID NO: 31536 - protein, 175 aa, Triticum aestivum
MAPTVMAASVTSVAPFQGLKSTAGLPVSRRSSSAGLGSVSNGGRIRCMQVWPIEGIKNFETLCDLPPLSTEALLNQVEYLIRSKWVPCLEFSKVGFVFREHNSSPGYYDGRYWTMWKLPMCGCTDTTQVLKEVEEVKKEYPDAYVRVIGFDNLRQVQCVSFIAFRPPGCEESDKV

SEQ ID NO: 31537 - protein, 2500 aa, Sinorhizobium fredii
MTVEIIGRACLAPGAQSPQALFKILRQGMCTVSSVPGDRWDLARFWHPVMGTPGKTYSFAAGVLDTIYDFDPAVFGMSQREAMYMDPQQRVLLQLAWRALEDANISVASLHGENVGVYIGASSLDHANLTVEDPAAAGPYFMTGNTLSIVSNRISHVFGLSGPSMTVDTACSSSLVALDQAMRALNAGEIDTAIVGGVNILAHPLPFVGFAQARMLSPEGLCRAYDNDGAGYVRAEGGVVFVLRRSDRARRERDRSYARIVASGTNSAGRTNGISLPSREAQANLLKAIYEGNGIDANQVAFVEGHGTGTKVGDPAEVWSIGTVIGARRRAPVPIGSIKSNIGHTEPASGLFGMMKAVLALEHNYLPASLHFDTPNEHIDFEGLNVRVTANPIELLKGKRARLAGINSFGFGGANAHVVISDPDPVQQEKASAASSGHVFLASAHTQSSLENLLKDYKGSFANASKEETRAIIAASGANRTHMRHRFAARSDHPEDIVRAIASHLDNPGSDIGEVGEAPVKNAQVAFVFSGNGSQWAGMGADAFRENLHFRQSFTSVSALFKFHSDIDLKDLLTDPELDKKLADTKIAQPLLFAIQAALSDSLVAMGVKPAAVFGHSVGEIAAAYAAGALTLVDAVSIVAKRSLHQDLLAGQGTMAAVMLGEEAAAAFAEARGLDEVCVAAVNAHNSVTISGPAHEVTAFRDAARKAKIPVQILDINYPFHHPIIDQAKEAFLADIPDIAPRRTELTYLSTVTGSALDGTELDPDYWWKNVREPVRFQAATDAALALGCRLFIEISPRPILASYVKETIKQAAAPATVVATLLRDAAEKGQDPISASMARAVAHGAAVDRPRAYGKRDAFIELPSLPFEPVELRPQATTDATDLFGRSSKPYRLTGWRGDPNSGSWKNHVDAHLFPDLAEHVVDGKAILPGSGFIEIAVSAAQQYYGSDEVEITNLEIVRPLELSDSRIMELSTILSPETGDIEIRSRERLSEDDWTVHAVARSRKPIAGANARHPSISGLAKTGIVTPAKAYDTAKQFGLDYGPHFQLLAKAVAYGDRLIEVELKAPTGSGHPLVTYALHPISVDATFHGLVALFDRFTGEKGGAPYIPVRFGSVRVVNAGRPIARATIEIERVSANSIKARFHFYDAAGEPIAHFDDCRFRRTYLRKHKTLDGLSFHYETVLSDVILPGAKLAGTVPAKLSEPADAGTGVDNATLLFNAAIYRACHEIALKLARGKSTIQGNGLPGDFAFQCFLTNCLYALEDAGLCEHQNGNWKVAPEFTLPTVAEILGELYGERPDRAVEAVLINNAHAEALSRLATLLAGTADGEAAAFNAGFISEATLDHQAVHSVSSRSRMDQVLGMVERALAAQVRGARLRIVELGSVSAGFTRRLADLAARHGTTLSVVEPRDNAQRNLEIAFEEEAHVRILKKSEFAAIGPFDLAVSASDNLYQLVEEEAGIRTALRSTLRENGALVAAVSAPSIFSDFALGLSEGWFERSQTAEFPIGKRAAVSHWQKCLADLELSDVSVSDCECPHGNAILIEARGTAGAARPPASHAGGIPYLLIETDVRRSSAPAGAIPVAASGDLAADIAVLGTAIDGLGEKPVRAVFVSATADHIGDDDSALLQTHVLALSAFAEALKQRAGNAELVGEARPRLVLVAPGGGPVSESASSGVNSGLWTFVRVLQNEYEFLDVHSLDLADRTASYEEMLASALPLLAIEGSNREWLLDRATGLVSEIRAVSGPAAKSEGKISAFSAATIRQRVSSQVSSITWEETDVPRAGPGEIVVSVAATGLNFRDVMWAMGLLPEEALEDGFAGATIGMELSGHVVEVGEGVDDLAVGDAVMAIASAAFSTHAVVSRAGVAKLPQTISPVAAATLPVAFLTAYYAMVELGRIRSGETILIHGAAGGVGLAALQVAKLKGAKVIATAGTREKRRFLTMLGADHVFDSRSLGFVNDVRAVTGGEGVDLVLNSLFAEAMEQSLALVKPFGRFLELGKRDYYADSKIGLRPFRRNVSYFGIDADQLLVNQPELTKRIFMEIGELFDQGRLTPLPYRAFDFDEIGNAFRLMQNAGHIGKIVVLPPVAGQHEIAAKPRRGMKVDPDGMHLVVGGIGGFGLVAANWLVEKGARNIALCSRRGQPDAATSAMVDRWKKAGVAASLHACDVTDAAAVEALLASLRAQAPLRSIVHAAMVLDDALISNLTHERNRPVIDVKAKGAAILDRLTRQDALDNFILFSSATTLVGNPGQANYVAANGYLEGLARARRAAGLAGLAVGFGAIADAGYLTQNADVNDLLAKRIGKTALKAHVALDMVESHIAADPGGVDAAVVMISEIDWGAARNLPVARNALFEVILRSADQHASGTEGTKMDLVAMIEGKSPQEAEDILFDLVAGEIAAILRVAKDTVTRSKILKEIGLDSLMAVELGISFQQNTGFDMPLSGVADNTTVGDVARKLYEKVSKRDQSDDGEAGDDKLVTELTQRHVGAAKEKALSQ

SEQ ID NO: 31538 - protein, 627 aa, Staphylococcus aureus subsp. aureus NCTC 8325
MGMEAYKIEHLNKSYADKTIFDNLDLSISEGEKIGLVGINGTGKSTLLKVIGGIDDDFTANVMHPNQYRIRYSSQKQDLNEDMTVFDAVLSSDTTTLRIIKQYEQAVQAYADDQSDKLFKRMMDAQDAMDQHDAWDYNAEIKTILSKLGIHDTTKYIKELSGGQQKRVVLAKTLIEQPDLLLLDEPTNHLDFESISWLINYVKQYPHTVLFVTHDRYFLNEVSTRIIELNRGKLASYPGNYESYIEMRAEREVTLQKQQQKQRALYKEELAWMRAGAKARTTKQQARINRFNDLENEVNQQYKDDKGELNLAYSRLGKQVFELEDLSKAINDKVLFEHLTEIIQKGERIGVVGPNGAGKTTLLNILSGEDQQFEGKLKTGQTVKVAYFKQTDETLDRDIRMIDYLREESEIAKEKDGTSVSITQLLERFLFPSATHGKKVYKLSGGEQKRLYLLRLLVHQPNVLLLDEPTNDLDTETLTILEDYIHTFGGTVITVSHDRYFLNKVAQSYWFIHDGQMEKIIGTFEDYESYKKSLDKNKSTLKQQSKSSTTVRKKNGLSYKEKLEYEQLMKRIEQAEVRMEEIDVLMIEASADYGKIKELNEEKEQLEIQYDLDITRWSELEEIKEQQ

SEQ ID NO: 31539 - protein, 247 aa, Brassica napus
  misc_feature (174)..(175): Xaa can be any naturally occurring amino acid
  misc_feature (233)..(233): Xaa can be any naturally occurring amino acid
  misc_feature (244)..(245): Xaa can be any naturally occurring amino acid
MGERPIANKYREVKMKRTLKRESKSASLRSAFAQRSSLSSSSRRSFAVKAQTDDLPLVGNKAPDFEAEAVFDQEFIKVKLSEYIGKKYVILFFYPLDFTFVCPTEITAFSDRYAEFEKLNTEVLGVSVDSVFSHLAWVQTDRQSGGLGDLNYPLVSDVTKSISKSFGVLIHDQXXRGLFIIDKEGVIQHSTINNLGIGRSVDETMRTLQALQYIQENPDEVCPAGWQPGEKSXKPDPKLSKEYXXAI

SEQ ID NO: 31540 - protein, 194 aa, Triticum aestivum
MRSPVPAMLTAPSAAAAVAKPLPAARSNTTAAALHATAASSRRDVIAGTGVGAALLLALWPQRARAASDDEYLAETTEVIGKVRSTISMDKTDPKVADAVTELREMSNSWVAKYRREKALLGRQSFRDMYSALNAVSGHYISFGPTAPIPKKRRIRILEEMDAVEKSLKRGRSRVSLEGPKLTRTQLSCTKCPL

SEQ ID NO: 31541 - protein, 557 aa, Oceanicola granulosus HTCC2516
MYTYSEFDEAFVRERVAQFRGQVERRVDGSLTEDEFKPLRLMNGLYLQLHAYMLRVAIPYGTLNPDQMRQLAMIAERWDRGYGHFTTRQNIQYNWPKLADVPDMLDALADVGMHAIQTSGNTIRNVTADHFAGAAADELLDPRPVAELLRQWSTDHPEFQFLPRKFKIAVTGAPNDRAVVKSHDIGLQMVERDGETGVQVIVGGGLGRTPMIGKVVREFLPLEDLLPYCEAIVSVWNLIGRRDNKYKARIKITVHEHGIDEIRRMVEERFAEIRPGFTGVDQQLLAELTGAFAPPAFKTAPTDAYEAARAADPVFRAWADTNLAAHKAEGYAIVTVSLKAHGATPGDASAEQMRLLADLAERFGHQELRISHEQNVILPHVHKADLPELHAALKSAGLATANIGLVSDIIACPGMDYCALATARSIPIAQEIATRIDELKIEHEVGHMKIKISGCINACGHHHVGHIGILGLDRAGVENYQITLGGDGTETASIGERAGPGFPAEGVVPAIERLIFAYLDVRESADETFLQAYRRLGPDPFKAALYPADDKGRANAA

SEQ ID NO: 31542 - protein, 156 aa, Saccharomyces cerevisiae
MFARLANPAHFKPLTGSHITRAAKRLYHPKVIDHYTNPRNVGSMDKSLANVGTGIVGAPACGDVIKLQIQVNDKSGIIENVKFKTFGCGSAIASSSYMTELVRGMSLDEAVKIKNTEIAKELSLPPVKLHCSMLAEDAIKAAIKDYKTKRNPSVLH

SEQ ID NO: 31543 - protein, 440 aa, Photobacterium profundum SS9
MSSPLANRLSQYQTKGIACRPIASGRLVRVVGLTLEAIGCRAPVGSLCIVETLNGDLEAEVVGFSGEILFLMPSEQLLGVMPGAKVTPVLHDNGLPVGPELLGRVIDGVGNPLDGLGDIFTEKRASFTSPAINPLLRKPIKEPLDVGIKAINGLLSVGKGQRIGLFAGSGVGKSVTLGMMTRGTTAQVVVVGLIGERGREVKEFIDEILGEEGRKRAVVIAAPADTSPLMRLKGCQTALTIAEYFRDQGLDVLLLMDSLTRFAQAQREIALSVGEPPATKGYPPSVFAKLPALVERAGNGSGDQGSITAFFTVLTEGDDLQDPIADASRAILDGHIVLSREMADAGHYPAIDVERSVSRVMPAIVDDEHMLMSKAVRQILSICRKNQDLVSIGAYKPGTDPTIDQAFSFKPKLDAYLQQEMKESVPYAMCVNMLRSTLSG

SEQ ID NO: 31544 - protein, 508 aa, Saccharomyces cerevisiae
MASLFRPPESAKCNPNSPRLKLPLLRNNQVDENNIYLTSNGSSTTAYSSHTPEPLTSSTSTLFSQTRLHPSDSSMTLNTMKKRPAPPSLPSLSINSQSKCKTLPELVPIADVSDGKHDLGLKQRVIAENELSGNSDLTPSSMASPFSHTNTSSPYLRNDLSNSVGSDFSNLISAYEQSSSPIKSSSQPKSSSESYIDLNSVRDVDQLDENGWKYANLKDRIETLGILGEGAGGSVSKCKLKNGSKIFALKVINTLNTDPEYQKQIFRELQFNRSFQSEYIVRYYGMFTDDENSSIYIAMEYMGGRSLDAIYKNLLERGGRISEKVLGKIAEAVLRGLSYLHEKKVIHRDIKPQNILLNENGQVKLCDFGVSGEAVNSLATTFTGTSFYMAPERIQGQPYSVTSDVWSLGLTILEVANGKFPCSSEKMAANIAPFELLMWILTFTPELKDEPESNIIWSPSFKSFIDYCLKKDSRERPSPRQMINHPWIKGQMKKNVNMEKFVRKCWKD

SEQ ID NO: 31545 - protein, 192 aa, Triticum aestivum
VAFRVVERIKSVSHRATQGTLTDMEEDTHIYVCDINPNMLEVGKKRAAEKGYNEEQCLSWVQGDAEALSFEDGSMDGYTIAFGIRNVTHIEKALSEAYRVLKKGGRFLCLELSHVDVPVFKDIYDIYSFSVIPAVGELVAGDRQSYQYLVESIRRFPKQEKFAQMIQEAGFEAVEYENLVGGVVAIHSGVKL

SEQ ID NO: 31546 - protein, 482 aa, Synechococcus sp. WH 7803
MLEVQAHQQLKHLLRADAGQWEHQLTLSRLVGRSLRRRDQTRIQLSAGSNERWWLALLVPLCLQSRHTVLVLDAAQRQRFLSLERPRLLESDLRLGCWSSIHPPTGDQLWLLTPSQLITAYRLGHLRDDDHLVIPEAEHLAARLREAMAVQLEARHWEELRTAFPATGQGLLDLHERLSRQLFARGSSQGRQLSMPDSALTSVRDLLQLTGQAPEPWNHLATMGVDTWASWARLDHEHLQWQWTLQPLEPLEVIRDLFKHRPWTLIHGDGGFRRASSSAPADRDDPVVRIDLREPPRSEPIPIYAPRRQPLPNTEIYASHLLDQCRRLILGRSGLTVVLADDTALLQRLASELAAEFGSRVTLDRACDKPNGVICTTWSWWMTHQPTLPEPDQLITALLPIASLEDPLTAARVKVLKKQGRDWFRDLLLPEALAILIPAIAPLRRSGGRLAILDGRVRSRSWGEQVFQALEPWSSLQRLRPD

SEQ ID NO: 31547 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLIALPIDKIDPTHSYVKDIDDLSKHTLDKIKHFFETYKDLEPNKWVKVKGFEN

SEQ ID NO: 31548 - protein, 296 aa, Trichodesmium erythraeum IMS101
MTISIAHLGPAGTYTETAAVAFSEKLGQHGQKSILCPYPSIAQTLSAVSQEQVNLAVVPVENSIEGSVTVTLDTLWKLDILEIQTALVLPISHGLISLATSFEEIKIVYSHPQALAQCQGWLEKFLPQVKQVPANSTTEALEHLEKERSAGAIASHRAAKIYKLPVLAYPINDYSDNCTRFLVLKKGCTEMENSAFKLIINTRDKPENLVFTSLGFTVPANEPGALVKPLQVFAKREINMSRIESRPTKLSLGDYLFFIDIEANINHNSVKVAIEELKTYTQTLKIFGSYILMSIN

SEQ ID NO: 31549 - protein, 800 aa, Saccharomyces cerevisiae
MASVPKRHTYGGNVVTDRDRHSLQRNNEILHPIHKNQRKHATFGPYIIGSTLGEGEFGKVKLGWTKASSSNEVPKQVAIKLIRRDTIKKDADKEIKIYREINALKHLTHPNIIYLEEVLQNSKYIGIVLEFVSGGEFYKYIQRKRRLKESSACRLFAQLISGVNYMHYKGLVHRDLKLENLLLDKHENLVITDFGFVNEFFEDNELMKTSCGSPCYAAPELVVSTKAYEARKADVWSCGVILYAMLAGYLPWDDDHENPTGDDIARLYKYITQTPLKFPEYITPIPRDLLRRILVPNPRRRINLQTIKRHVWLKPHEAFLSIQPNYWDEHLQKERPKPPNKGDVGRHSTYSSSASSYSKSRDRNSLIIESTLEQHRMSPQLATSRPASPTFSTGSKVVLNDTKNDMKESNINGERTSASCRYTRDSKGNGQTQIEQVSARHSSRGNKHTSVAGLVTIPGSPTTARTRNAPSSKLTEHVKDSSQTSFTQEEFHRIGNYHVPRSRPRPTSYYPGLSRNTADNSLADIPVNKLGSNGRLTDAKDPVPLNAIHDTNKATISNNSIMLLSEGPAAKTSPVDYHYAIGDLNHGDKPITEVIDKINKDLTHKAAENGFPRESIDPESTSTILVTKEPTNSTDEDHVESQLENVGHSSNKSDASSDKDSKKIYEKKRFSFMSLYSSLNGSRSTVESRTSKGNAPPVSSRNPSGQSNRSNIKITQQQPRNLSDRVPNPDKKINDNRIRDNAPSYAESENPGRSVRASVMVSTLREENRSELSNEGNNVEAQTSTARKVLNFFKRRSMRV

SEQ ID NO: 31550 - protein, 155 aa, Streptococcus pneumoniae TIGR4
MLTAKLQNRSGVLNRFTGVLSRRQVNIESISVGATEDPNVSRITIIIDVASHDEVEQIIKQLNRQIDVIRIRDITDKPHLEREVILVKMSAPAEKRAEILAIIQPFRATVVDVAPSSITIQMTGNAEKSEALLRVIRPYGIRNIARTGATGFTRD

SEQ ID NO: 31551 - protein, 132 aa, Helicobacter pylori
SNIKYELDKESGALMVDRVLYGAQNYPANYGFVPNTLGSDGDPIDALVLSDVVFQAGSVVKARLVGVLNMEDESGMDEKLIALPIDKIDPTHSYVKDIDDLSKHTLDKIKHFFETYKDLEPNKWVKVKGFEN

SEQ ID NO: 31552 - protein, 251 aa, Zea mays
  misc_feature (224)..(224): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTLSEYTVIHVGCLAKINPEAPLDKVCVLSCGISTGLGATLNVAKPKKGSTVAIFGLGAVGLAAMEGAKMAGAAGIIXVVDLNPAKYEQAKKFGCTDFVNPRDHQ

SEQ ID NO: 31553 - protein, 489 aa, Clostridium perfringens SM101
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNVPAIVWSALFLVIILTLNLLSAKAYGESEFWFAAVKVATVIIFLIVGVLMIFGILGGDNVGFKNFYENGGLFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMNRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 31554 - protein, 470 aa, Synechococcus elongatus PCC 7942
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRTIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELILDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLRWRRVIAIRQNEEFRFRFQCFPGLLRQLPARSLPQNLTQAQRDYFGAHTYERTDRSGSFHAQWF

SEQ ID NO: 31555 - protein, 155 aa, Triticum aestivum
MPFPSSGESMENALRACCKGIKIGKILIHREGDDGKQLIYHNLPKDIAKRHVLLLDPILGTGNSAVQAISLLLEKRVQEANIIFLNLISAPQGVHVVSKRFPRVKIVTSEIELGLNDDFRVIPGMGEFGDRYFGTDDYQSSTPFFADDKNRVGLL

SEQ ID NO: 31556 - protein, 417 aa, Geobacillus thermocatenulatus
MMKGCRVMVVLLGLWFVFGLSVPGGRTEAASPRANDAPIVLLHGFTGWGREEMLGFKYWGGVRGDIEQWLNDNGYRTYTLAVGPLSSNWDRACEAYAQLVGGTVDYGAAHAAKHGHARFGRTYPGLLPELKRGGRVHIIAHSQGGQTARMLVSLLENGSQEEREYAKAHNVSLSPLFEGGHHFVLSVTTIATPHDGTTLVNMVDFTDRFFDLQKAVLKAAAVASNVPYTSQVYDFKLDQWGLRRQPGESFDHYFERLKRSPVWTSTDTARYDLSIPGAEKLNQWVQASPNTYYLSFSTERTHRGALTGNYYPELGMNAFSAVVCAPFLGSYRNEALGIDDRWLENDGIVNTVSMNGPKRGSSDRIVPYDGTLKKGVWNDMGTCNVDHLEVIGVDPNPSFDIRAFYLRLAEQLASLRP

SEQ ID NO: 31557 - protein, 331 aa, Streptococcus agalactiae A909
MAVLILGGAGYIGSHMVDQLITQGKEKVIVVDNLVTGHRQAVHSDAIFYEGDLSDKTFMRQVFRENPDVDAVIHFAAFSLVAESMENPLKYFDNNTAGMIKLLEVMNECDIKNIVFSSTAATYGIPEQVPILETAPQNPINPYGESKLMMETIMKWADQAYGIKFVALRYFNVAGDKPDGSIGEDHKPETHLLPIILQVAQGVRDKIMIFGDDYNTPDGTNVRDYVHPFDLADAHILAVDYLRQGNESNVFNLGSSTGFSNLQMLEAARRITGKEIPAQKAARRPGDPDTLIASSEKARQMLGWEPKFDNIDKIISSAWAWHSSHPNGYED

SEQ ID NO: 31558 - protein, 287 aa, Sinorhizobium fredii
MRRALDIVAASCPRRQAGYCMTHVIITGGSSGIGLALASLYAGRGARLSLIARSRDLLELAAQTLASKYGARESDIHIEAADVANEAEIGSAIGRCIEALGPCDILVTSAGIVEPAPFLDASSAAFRRQMETNFSGTVHAVRAVYPDMVQRRSGHIVMISSGSGLIGIYGYTAYCASKFALRGFAEALRSEARCHGVGVSIGFPPDTETPQFEREIAERPREASVVMGVVRPWSAEAVARKIVDGIDRKRFEVYFGLTLFLLGRFGPAVRPLINWWFDRAIARSRGR

SEQ ID NO: 31559 - protein, 734 aa, Magnaporthe grisea 70-15
MSSGPAGLGHETARGLDAHGGVSVRSTRGHHHAPSLDAIATQNTEIEDSRSSSSTNSPVPNENEESDFFLGANDSQSSLGVPNLQDMQVTDDYDCLAAVNKLPNEILISIFSRLSSTADLRNCMLTCKRWARNTVDQLWHRPSCTSWDKHAMICRTLTIEYPYFSYKHFVKRLNLAQLAEKVNDGSVMPLAVCNRVERLTLPNCKGLTDSGLTALVTNNDHLLALDMSGVEQATDASVLAIAEHCKRLQGLNVSGCTRISSEAMAVLAQSCRYIKRLKLNECRQLGDEAVLAFAENCPNLLEIDLLQCRLVGNASITALLSKGQSLRELRLVFCELIDDGAFLSLPRNRTYEHLRILDLTSCIQLTDRAVERIIEVAPRLRNLVLSKCRAITDTAVYAISKLGKNLHYVHLGHCQNITDEAVKRLVHCCTRIRYIDLGCCIHLTDESVTKLATLPKLKRIGLVKCSGITDESILALAKANQKHRQRRDHQGNPIHGSFHSQSSLEQFTENQRNVFCVFSGQGVVSLRRYLNTNLFDDFHDRPARRHSVPGGGVHTHPPGQVADLHATLDASFDDQEPDTVEDDAAYDADMTMDGAIPPPPPPPPPAPGAPNTHYQSVFPGYPAPDATVTLEGGLAGPSHAIQQEGSNAGAGGFNAPRADMFPGGSNQSLNHDRARGVPSLPQVTMRQDQGFPSGSGLEAGLAGPMPSASMGSRHNVGEDISPVSSNGNTPEPPA

SEQ ID NO: 31560 - protein, 454 aa, Mycoplasma fermentans
MSAIYKIHSREILDSRGNPTVQVEVWTEAGGYGLANVPSGASTGSKEALELRDQGTKYEKNWFGGKGVMTAVDHVNKDIAPKLLGMEVTDQRAIDMKMIKLDGTATKSKFGANAILGVSLAVARAAADELQLPLYRYIGGTNAHVLPLPMLNVMNGGAHASNTVDFQEFMIMPVGAKSIREALQMANKVFHNLAKLLKAAGHGTQVGDEGGFAPDCKSHEEVLDYLVQAIKAAGYKPATSGKDAVAIAMDAASSEIYDEKSKKYVFKKLKKAIEAKHPGFEKLTNVKLEYTTDEMIEYYGTLIAKYPIISIEDGLAEDDWAGFTKMTTKYGHQIQIVGDDLTVTNPKLLARAIKEKAMNAILIKLNQIGSLTETIDAINMAQKAGMACVVSHRSGETEDTTLADVAVALNTGQIKTGSMSRTDRIAKYNRLLAIEEELDGADEFEGREAFYNIK

SEQ ID NO: 31561 - protein, 472 aa, Arabidopsis thaliana
MKNKAFGQIMDDAENPGFFKILRSADLSSEIMRGIPLNFIKSISEEELSAKMLLKVSWGSSWPIKICRNPSFYFMEKKGWDQFLSDNGLGNDEFLTFTHQGNMCFTVDIYQIDGKELLTPRRSATIASSSGRNKREQRNNIYKDVKEEEDIESWSESSYPGHKTAESTGRRQRLSLSNKKAKETEKSKKKKMKVESISYDSQDDSLSLVPEFTLTIKKSYLIFLGIPKMFEELHMPTEATMFKIHDPEGKRSWDVMYKFSNNQTRFCAGWIRLAKELGLEIGDVCTFTLIKPTEMLKSSHQLLPNTKLMEAPRGNLRAVALIAGDNNVRGCLQFVQDISGTTHVTGKISGLSPGFHGFHIHSFGDTTNGCISTGPHFNPLNRVHGPPNEEERHAGDLGNILAGSNGVAEILIKDKHIPLSGQYSILGRAVVVHADPDDLGKGGHKLSKSTGNAGSRVGCGIIGLQSSADAKL

SEQ ID NO: 31562 - protein, 172 aa, Brassica napus
MAFPKVFFDMTVDGKPAGRIVMELYTDKTPKTAENFRALCTGEKGVGSKGKPLHFKGSSFHRVIPNFMCQGGDFTAGNGTGGESIYGEKFADENFERKHTGPGILSMANAGPNTNGSQFFICTVKTDWLDGKHVVFGQVVEGLDVVKAIEKVGSASGKPSKPVVVADCGQLS

SEQ ID NO: 31563 - protein, 303 aa, Synechococcus sp. WH 7803
MLAAAFRCLWMRDQLEQILSKERDLLRGRCLTSVEPVGGGEVGACWRADLSDGSAWFLKVSDPASLEAEQRGLRSLRQWSDADLVEVVDVLAWLPLEPQGILVLPWWEMGTGDQFNLGRGLARLHRRSSLNGPSRFGWDHDGFIGLGPQPAGWSEDWGEAFVALRLKPQLRLAEAWALHENDWSSLVAPLAQWLGDHAPDPCLVHGDLWAGNAGVLADGRGLLIDPASWRADREVDLAMTQLFGGFSRRFYEGYSREWPLPEGFEQRVDALNLYHLLNHANLFGGGYRDRCRQVIKRLQKTLL

SEQ ID NO: 31564 - protein, 595 aa, Oryza sativa
  misc_feature (131)..(131): Xaa can be any naturally occurring amino acid
  misc_feature (387)..(387): Xaa can be any naturally occurring amino acid
MYKNQLQELAQRSCFNLPSYACIREGPDHAPRFKATVNFNGETFESPAFCSTLRLAEHAAAEVALNELSKRGPSSSLAAKVLDETGIYKNLLQETAHRAGLKLPVYTTIRSGPGHTPVFTCTVELAGMTFXTGNPGKTKKQAQKNAAMAAWSELKQLPRVGEPSSSSCPPDHDDDDQEQIIVARTLASLNQTNGGKTPQQKEKQQSSNRPSSRRPSYPKSNASFYGRLHLQKHAYPSVPPEQAMYHMWHQVQATQQKPHFPMVPTMGSTGLPPPPTVLHMYPPPRGQFTMPSSQDGLGLIPCYPEASPVLPRYFSPYPACFVPRRPLPVNVHKIHEKRLVGADMVELPDAAVFSRYTGPDFSGTSENAVQDNKKEEYTESSPGSEQXESKSHTASSSATRSPSQQLESNQDIEIMGGLRLESKKPAEQPPESSPSRVNPVLLCETGQRHHYSSVRHGDPVHRNSPQISVATSPSPIRRGDPAHINIPQISVATPPECRSPRAQAPPRFGTRMPVNLPSSLYQQRPPWLAASVTIRTTIPVCSARPNVVNSSAGAAQPAVQILSASPRKEEPEARTNTSDTSNAATASSELNKLHI

SEQ ID NO: 31565 - protein, 364 aa, Glycine max
MGSISQPQLVPFPLLMNGNYTASTIPWRLPSDDPSIPTPIELSWLNLFLNTIPTFKKHAESDTSVPDAANKAEEFAQRFARIIEDFKKDPASQGVPLDVLLPCRLREQVLKELGFRDIFKKIKDVENANAISLFENVVHLNDAIEDEGKRLENLVRGIFAGNIFDLGASQLAEVFSRDGMSFSATCQNLVPRPWVIDDLETFKMKWSKKSWKKVIIFVDNSGADVILGILPFARELLRRGSQVILAANDLPSINDVTYSDLIEIIPKLKDEEGRLTGVSTSNLIIANSGNDLPVIDLTRVSQELAYLANDVDLVILEGMGRGIETNLYAQFKCDSLKIGMVKHPEVAEFLGSRLYDCVIKYDEV

SEQ ID NO: 31566 - protein, 478 aa, Burkholderia sp. 383
MQRATKIVATIGPASSSPEILLQMMQAGLDVVRLNFSHGTADDHRQRAEMVREAARKVGREIAIMADLQGPKIRVGKFENGKTTLEPGQAFILDAGCELGNDERVGLDYKELPRDLRTGDLLLLNDGLIVLTVERVLGDEIHTIVKVGGELSNNKGINRQGGGLSAPALTAKDMEDIRTAMSLGADLVAVSFPKNATDMEMARQLANIAGAPYGIKPKMIAKIERAEAIPALQSILDASDGIMVARGDLAVEVGNAAVPALQKRMIRMARESNKLVITATQMMESMIHAPVPTRAEVSDVANAVLDGTDAVMLSAETAAGKYPVVTIETMAAVCVEAEKSEHVELDKDFLDRTFTRIDQSIAMGALFTAYHLGAKAIIALTESGATALWMSRHYTHVPIFALTPRVGSERTMALYRNVTPLHVDFNSDRDSALQAALEIVVKQGYVQHGDMVVLTVGEPMGQAGGTNTLKIVRVGEHY

SEQ ID NO: 31567 - protein, 398 aa, Burkholderia sp. 383
MSQVKRLTDLIAAGQLAGKRVFIRADLNVPQDDQGNITEDTRVRASVPAIQAALDAGAAVMVTSHLGRPTEGEFKPEDSLAPVAKRLAELLGRDVPLVSNWVENGVNVAPGQVVLLENCRVNKGEKKNSDELAQKMAKLCDVYVNDAFGTAHRAEATTHGIAKYAPVACAGPLLAAELDALGKALGNPARPLVAIVAGSKVSTKLTILKSLAGKVDQLIVGGGIANTFMLAAGLSIGKSLAEADLVNEAKAIIDEARERGASVPIPTDVVTAKEFSPTAVATVKQVADIEADDMILDIGPDTAKALASQLEKAGTIVWNGPVGVFEFDQFGNGTKTLAEAIAKSSAFSIAGGGDTLAAIAKYGIHDQVSYISTGGGAFLEFLEGKKLPAVEVLETRAA

SEQ ID NO: 31568 - protein, 288 aa, Zea mays
MAKDIEASGPEAGEFSAKDYTDPPPAPLVDADELTKWSLYRAVIAEFIATLLFLYITVATVIGYKHQTDAAASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAPEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 31569 - protein, 453 aa, Triticum aestivum
RPPPTIPGAPVVGGLLRFLRGPIPLIRAEYARLGPVFTVPILTRRITFLIGPDVSAHFFKSNESDMSQQEVYRFNVPTFGPGVVFDVDYQVRQEQFRFFTEALRANKLRSYVDQMVAEAEEYFSKWGESGTVDLKYELEHLIILTASRCLLGREVREKLFDDVSALFHDLDNGMLPISVIFPYLPIPAHRRRDQARTRLAEIFATIIKSRKASGQSEEDMLQCFIDSKYKNGRQTTESEVTGLLIAALFAGQHTSSITSTWTGAYLLKFQQYFAEAVEEQKEVMKRHGDKIDHDILAEMDVLYRCIKEALRLHPPLIMLLRQSHSDFSVTTREGKEFDIPKGHIVATSPAFANRLPHIFKNPDSYDPDRFAAGREEDKVAGAFSYISFGGGRHGCLGEPFAYLQIKAIWTHLLRNFEFELVSPFPENDWNAMVVGIKGEVMVNYKRRKLIVDN

SEQ ID NO: 31570 - protein, 391 aa, Trichodesmium erythraeum IMS101
MEFAKKLEKISPYPLTEINRKKNELIDRGVDIINFGAGDPDQPTPNHIVQAMHEAIKDSTNHHYPPIKGLKEYRQAAADWMKRRFGIEDLNSETEVISSIGSKESIHNLFLAFVNPGDYAIIPDPGYPVYRTSTIFTLGQPYSMQLRAENGFLPILSNIPQEVAEKAKLLWINYPNNPTGATASLEFFEELVGFCKHYDILLCHDNAYSEIAYDNYKPPSILQVPNAKDIAIEFHSLSKTYNMSGWRIGFVAGNSLGIKGLSQVKSNIDSGVFQAIQKAATEAFVSTTEKHLQSLVAVYQKRRDILIKGLQSLGYPIKANLASLYAWVPVPKNYTSQEFATLLLEKCGIIVVPGNAYGTSGEGFIRIALTVEDKRISQALQRIKDSGLNYI

SEQ ID NO: 31571 - protein, 394 aa, Synechococcus sp. WH 5701
MKAMILAAGKGTRVQPITHTIPKPMIPILQKPVMEFLLELLRQHGFTEVMVNVSHLAAEIENYFRDGQRFGVEIAYSFEGRIEDGELIGAALGSAGGLKKIQTFQPFFDDTFVVLCGDALIDLDLTEAVRLHKEKGAMASLVTKRVPKDQVSSYGVVVTDQDSRVLSFQEKPSVAEAASDMINTGIYIFEPEVLDHIPAGVPFDIGADLFPRLVAAGAPFYALPMDFEWVDIGKVPDYWQAIRSVLEGKVRQVSVPGREVRPGIFTGLNVAADWDKINVTGPIYVGGMSRIDPGVTIVGPAMIGPSCHICEGATIDNSIIFDYSRIGAGVRLVEKLVFGRYCVDRNGDHFDLQEASLDWLITDVRRQDVVQPSPQQKAMADLLGTDLALSAGEN

SEQ ID NO: 31572 - protein, 416 aa, Ostreococcus tauri
  misc_feature (416)..(416): Xaa can be any naturally occurring amino acid
METTFWGAVVPAGRTLRVDVSPDEEYVHVSQVALGPNARDDGRRTTLTLRVIDDGDERVGDQRGDAHALCALTPGTCEQVSMDVALDATFELRAEGPNDAHVSGWRTLMDDIDEEEEALVMEELASGLASESESESDAEDEEDEADEEASSDDDDDDDDDDDDDDDDDDDDDDDDDDDDDDDDDDDDDEFETPYDMENLPSDGDLFSDSDDDSEDDKAFAEAMGANSESDDDDDEDDETAVPEKEAVVEVEAPSTTTSEDESESEEEPALKKTPTPAKKSPASAKKTPASAKKAQEESESESESSGSESESSSDEPAPKSTPASAQKSQGSAKKTPASAKKAQEESESESESSGSESESSSDEPAPKSTPASAQKSQRSAKETQGDDDSESESDSSESDSDSSESDEEEDRDDSDX

SEQ ID NO: 31573 - protein, 316 aa, Ustilago maydis 521
MAGRIREVWAENLEVEMALLRDTIEKYPYVAMDTEFPGIVARPIGTFKGSSDYHYQTLRCNVDLLKLIQLGITLCDENGNLPPDVCTWQFNFRFSINDDMCAPDSLDLLTKAGLDFDRHERMGIDVEHFGELLITSGLALFDDVKWVSFHSGYDFGYLLKVVTCSPLPAQESDFFALLRVWFPCIYDIKFLMRSCKTLKGGLQDVADDLQVSRIGQQHQAGSDSLLTATTFFKMRQKYFDGSIDDSKYLGCLYGFSSSSSHVNGMVHYSQGRPVSVQSFHDASAVPRSVSGGYAAGGYGSNFGSPFKSTLSASTER

SEQ ID NO: 31574 - protein, 416 aa, Streptococcus pyogenes MGAS10394
MVYNMEYEVYETMKIIEKSSKLEHVAYDIRGPVLDEANRMIASGEKILRLNTGNPAAFGFEAPDEVIRDLIVNARLSEGYSDSKGIFSARKAIMQYCQLKGFPDVDIEDIYLGNGVSELISMSLQALLDNGDEVLVPMPDYPLWTACVSLGGGKAVHYLCDEEAGWYPDIADIKSKITSRTKAIVVINPNNPTGALYPKEILEDIVALAREHQLIIFADEIYDRLVMDGKEHIAIASLAPDVFCVSMNGLSKSHRIAGFRVGWMVLSGPKDHVKGYIEGLNMLANMRLCSNVLAQQVVQTSLGGHQSVDALLLPGGRIFEQRNFIYEAINAIPGLSAVKPEAGLYLFPKIDRQMYRIDDDEEFVLQLLKQEKVMLVHGRGFNWKDPDHFRIVYLPSVEELEDVQEKITRVLYQYRR

SEQ ID NO: 31575 - protein, 125 aa, Porphyromonas gingivalis W83
MADIKAIAEQLVNLTVKEVSELATILKEEYGIEPAAAAVAVAAAPGAAGAAAEEEKTSFDVVLKSAGAAKLQVVKAVKEQCGLGLKEAKDLVDAAPSTVKEGVDKATAEALKKALEEAGAEVELK

SEQ ID NO: 31576 - protein, 299 aa, Solanum lycopersicum
MAHSCIATTSSLSKYNSAIFPSDYCNISPISLQFKRLSLRKVKAVGKVKSRGNSTVKAVYSGGDWDLAKASRSSGIWSIRDDVQIPSSPYFPTYAAQGQGPPPMVQERFQSVISQLFQYRIIRCGGAVDDDMANVIVAQLLYLDAVDPTKDIVMYVNSPGGSVTAGMAVFDTMRHIRPDVSTVCVGLAASMGAFLLSAGTKGKRYSLPNSRIMIHQPLGGAQGGQSDIEIQANEMLHHKANLNGYLAYQTGQSLDRINQDTDRDFFMSAKEAKEYGLIDGVIMNPMKALQPLAAAAEQS

SEQ ID NO: 31577 - protein, 448 aa, Opitutaceae bacterium TAV2
MSDQSLDSFLARIRQRDPIQPEFHQAVEEFFRSLWPFLAKNPKYAKAGILDRIVEPERVIMFRVPWVDDAGNVRVNRGYRIQMSSAIGPYKGGIRFHPSVNLGILKFLAFEQVFKNSLTTLPMGGGKGGSDFDPKGKTEQEVMRFCQSFMTELYRHIGADCDVPAGDIGVGGREVGYMFGQYKRITNQFTSVLTGKGLAFGGSLIRPEATGYGCVYFAQEMMQLAKIGGFEGKRVTISGSGNVAQYAAEKVIEFGGRVVSFSDSNGTVEIPDGMTDEQLKEVMDLKNNRRGRIQSFAEHYKLPYHADKRPWAIKCDIALPCATQNEVDVEDAKSLVQNGCRCVAEGANMPSTLEAADVFIANKVLYGPGKAANAGGVATSGLEMSQNAMRLSWNRGEVDDRLHAIMQNIHHVCVEHGSEKDGFVNYINGSNIGGFVKVADAMIAQGIV

SEQ ID NO: 31578 - protein, 775 aa, Brucella melitensis 16M
MCLPTIAARGLAAAGANYGARFGLFAPGRRSDCLVGRAFFPKTVSHFSECAQWELAFMQMGMAVLVLVIACGVLSVLFAIWAIRSVLAADQGTQRMQEIAEAIREGASAYLTRQYSTIAIVGIVVFLLAWYLLSLNAAMGFLIGAVLSGVTGFIGMHVSVRANVRTAQAASLSLAGGLELAFKSGAITGLLVAGLALLGVSVYYFVLTVWLGYAPADRTVIDSLVSLGFGASLISIFARLGGGIFTKGADVGGDLVGKVEAGIPEDDPRNPATIADNVGDNVGDCAGMAADLFETYAVTVVATMVLGAIFFHGSDALTNVMLYPLMICGACVITSIAGTFFVKLGVNGSIMGALYKGLIATGLLSIVGLGVANTLTVGWGEIGTVAGKSITGTNLFVCGLIGLIVTGLIVVITEYYTGTNKRPVNSIAQASVTGHGTNVIQGLAVSLESTALPAIVIVGGIISTYQLAGLFGTAIAVTAMLGIAGMIVALDAFGPVTDNAGGIAEMAGLDPEVRKATDALDAVGNTTKAVTKGYAIGSAGLGALVLFAAYSNDLAYFAANGQIYPYFADMGPVSFDLSNPYVVAGLIFGGLIPYLFGGMAMTAVGRAGGAVVQEVRRQFREKPGIMTGKERPDYARAVDLLTKAAIREMIIPSLLPVLAPIVVYFGVLLISGSKAAAFAALGASLLGVIINGLFVAISMTSGGGAWDNAKKSFEDGFTDADGVKHMKGSEAHKASVTGDTVGDPYKDTAGPAVNPAIKITNIVALLLLAVLAHMA

SEQ ID NO: 31579 - protein, 544 aa, Arabidopsis thaliana
MEGVGLRAVGSHCSLSEMDDLDLTRALDKPRLKIERKRSFDERSMSELSTGYSRHDGIHDSPRGRSVLDTPLSSARNSFEPHPMMAEAWEALRRSMVFFRGQPVGTLAAVDNTTDEVLNYDQVFVRDFVPSALAFLMNGEPDIVKHFLLKTLQLQGWEKRVDRFKLGEGVMPASFKVLHDPIRETDNIVADFGESAIGRVAPVDSGFWWIILLRAYTKSTGDLTLSETPECQKGMKLILSLCLAEGFDTFPTLLCADGCSMIDRRMGVYGYPIEIQALFFMALRSALSMLKPDGDGREVIERIVKRLHALSFHMRNYFWLDHQNLNDIYRFKTEEYSHTAVNKFNVMPDSIPEWVFDFMPLRGGYFVGNVGPAHMDFRWFALGNCVSILSSLATPDQSMAIMDLLEHRWAELVGEMPLKICYPCLEGHEWRIVTGCDPKNTRWSYHNGGSWPAACIKTGRPQIARRAVDLIESRLHRDCWPEYYDGKLGRYVGKQARKYQTWSIAGYLVAKMLLEDPSHIGMISLEEDKLMKPVIKRSASWPQL

SEQ ID NO: 31580 - protein, 448 aa, Fulvimarina pelagi HTCC2506
MTQTFDLIIVGTGTAARVAAMRAHAASWSVAVIDSKPFGGTCALRGCDPKKMLVGGVSAIDHAKRMQDKGVVGTLNIDWPELVAFKRSFTDPVPDKHEASYADKGIAAFHGQARFTGPNSVQVDGTELEGAHILIATGAKPVTLGIPGEKYLIDNEGFLALEDLPKRIVMVGGGYIASEFSQIAALAGSQVTVLQRGERMLTHFEPELVGWLIESFKAVGIDVRTSTEVTAVEKAGTEYRVTASSNGQSETIEADLVVHAAGRIPNLSDLDLDIAGVAVSDGRLQLNEYLQSTSNPAVYAAGDAAQAGPPLTPVSSHDAKVVVGNLLDGNTHKPDYRGVPSVAFSLPPITAVGLSEADARMQGLKFNIKSQKASNWFTSRQAAEPVYGFKVMVEEGSDRVLGAHLVGPHADEVINLFALAIRHNLTATALKQTMFAYPTGASDIGYML

SEQ ID NO: 31581 - protein, 453 aa, Debaryomyces hansenii CBS767
MFVRLLKSNRKFNIRTKTTMSNFDPATLHNPYFNQKLGQKDIWTLINETAAEAQKESGKSIVNLGQGFFSYNPPDFAIEAVNKATSQPQFNQYASARGNPNLLNELSSLYTKEFNRKVGTDEIQITTGANEGMFSIFFGYLTPGDEVIVFQPFFDQYIPNIEMCGGKVKYVQLKFPEKFNGESVSGDDWEVDWEGLTNAITDKTKLIVINTPHNPIGKVFTEEELYKIGKIAIGNNLILVSDEVYENLYYSKSFTRPATLSSLPELAERTLTIGSAGKSFAATGWRVGWVHGPASLIKYVTAAHTRICFSTPAPLQQAVADGLKQAASNKYFEITRQEYVKKYELFTKVFDELNLPYTSAQGGYFLLVNLLKVKIPNDFEYPADISDKGTNDFKLAYWLIKEIGVVGIPPTEFLYPADRQGNGLENCLRFAVCKDNSILEEAVEKLRLLKEYL

SEQ ID NO: 31582 - protein, 350 aa, Mycobacterium sp. JLS
MIPAALRCVPAGQVDVTAPVTIDGLSYIAPDDPAMPMYRVIANNRQPVALRDLMIQPVRSGYIGDGHQPDPALVPPTGAQAVPDVDVDQVYLPVRDGVARCQLYRPRAAPADEQLPVIVYYHGGGFTVGVSEDCDFLARKLAFTNSALVVSANYRSAPEFMFPTPLDDAFDVYRWVTVNAELVGGDATRVAVAGDSAGSNFAAALALRARDEHARVPDAVVMLGAMPDFHFERWDSFRAQAPRGIVYDMAFAGFIRGAYVGPTPWDHPWVSPIEGDLTGYPLTVITAGTHDPIVDSARAFGERIRAAGGQTVEYFPAGMPHGYYFFPGVHAEEDVAYEIVAEALAKPFRR

SEQ ID NO: 31583 - protein, 181 aa, Prochlorococcus marinus str. MIT 9312
MQSDSREPQLNANLNLIVVLLIVFVIVSLVLFRNLFFQSTYLLKSFGELSVEPEIAFKNKKPTFLEFYAEWCEVCKEMAPKVSALKDEYEKDINFVFLNVDNQKWENYIRKFEVNGIPQVNLFDREGNLKSTFIGKQEEITIRESLASLKGETKSHEEIHSAEFSVIKQKKNYQGNPRSHG

SEQ ID NO: 31584 - protein, 511 aa, Oryza sativa
  misc_feature (16)..(16): Xaa can be any naturally occurring amino acid
  misc_feature (494)..(494): Xaa can be any naturally occurring amino acid
MESMLVAGAGAAVVVXVGGLVAAGALADKLVAVPPPRKNRANPPPAVPGLPIIGNLHQLKEKKGHQTFAKWSETYGPIYTIKTGASPVVVLNSTEVAKEAMIDKFSSISTRKLPKAMSVLTRKSMVAISDYGDYQKMAKRNIMIGMLGFNAQKQFRGTRERMISNVLSTLHKLVSLDPHSPLNFRDVYINELFSLSLIQSLGEDVSSVYVEEFGREIPKDEIFDVLVHEMMMCAVEADWRDYFPYLSWLPNKSFDTIVSTTEFRRDAIMNALIKKQKERIARGEARASYIDFLLEAERSAQLTDDQLMLLLSESILAAADTVLVTTEWTMYEIAKNPDKQELLYQEIREACGGEAVTEDDLPRLPYLNAVFHETLRLHSPVPVLPPRFVHDDTTLAGYDIAAGTQMMINVYACHMDEKVWESPGEWSPERFLGEGFEVADRYKTMAFGAGRRTCAGSLQAMNIACVAVARLVQELEWRLREGDGDKEDTMQFTXALKLDPLHVHLKPRGRM

SEQ ID NO: 31585 - protein, 357 aa, Azoarcus sp. EbN1
MTTMKAAVFKAPGRIELVDKPLPQVGPNDALVRITTTTICGTDVHILKGEYPVATGLTIGHEPVGVIEQLGSNVQGYVEGQRVIAGAICPSFTSYGCQDGVPSQDGGHVGHGYKPMGGWRFGNTIDGTQADYVLVPDAIANLAPVPDGLTDEQVLMCPDIMSTGFAGAEAANIRIGDIVAVFAQGPIGLCATAGAKLRGASLIIAVDGVDERLRISRNMGADVTLNFREVDVVSEILRITGGRGVDAAVEALGLQSTFESALRVLKPGGTLSSLGVYSSDLTIPLGAFHAGLGDNKIVTSLCPGGKERMRRLMNVVASGRDDFGALVTHTYKLDDIVAAYDLFANQRDGVLKIAIKP

SEQ ID NO: 31586 - protein, 217 aa, Azoarcus sp. EbN1
MHTADTRNAGPVASTDETDQRNTRLVASCRLPTPWAIFRMHGFEEPATGREHVALTLGAVADGKPVLTRVHSECLTGDALFSRRCDCGPQLEAALAAIAAEGRGVLLYLRQEGRGIGLLNKVRAYALQDEGADTVEANHLLGFDADTRDYAVAASMLGELGIASLRLMTNNPRKVAALEQYGITVAERVPHIIEPNPHNANYLRTKAQRLGHLLAGH

SEQ ID NO: 31587 - protein, 330 aa, Saccharomyces cerevisiae
MLDPRILPYYDPAVERKIAVVTGGNTGIGWYTVLHLYLHGFVVYICGRNSHKISKAIQEILAEAKKRCHEDDDGSSPGAGPGPSIQRLGSLHYIHLDLTDLKCVERAALKILKLEDHIDVLVNNAGIMAVPLEMTKDGFEVQLQTNYISHFIFTMRLLPLLRHCRGRIISLSSIGHHLEFMYWKLSKTWDYKPNMLFTWFRYAMSKTALIQCTKMLAIKYPDVLCLSVHPGLVMNTNLFSYWTRLPIVGIFFWLLFQVVGFFFGVSNEQGSLASLKCALDPNLSVEKDNGKYFTTGGKESKSSYVSNNVDEAASTWIWTVHQLRDRGFDI

SEQ ID NO: 31588 - protein, 591 aa, Ostreococcus tauri
  misc_feature (590)..(591): Xaa can be any naturally occurring amino acid
MSGGGALIVLPAIAGLFFAFWLFTKKLKPISLGSEIGRSASDYSQSTSRNGSASSLSAMEHTGEDSLMRGMESGDRAAMEETLAKVRRIHHDVRDGARAFLNAEYRMCVAFLAAFGVAIAVLTSNGRLGFDAKSGFATAAAFAVGGVTSMASGYVGMMVATYTNARCAMMATLKPEHLAWKESFNAAFRGGGVMGFALSGLGLLMMYFLMLVYSAFFSFETHAMELFECIAGFGLGGSAIAMFGRVGGGIYTKAADVGADLAGKVVAGIPEDDPRNPATIADNVGDNVGDVAGMGSDLFGLRVLKTQLTLSTIAMTICIYPICYVFMPQDLYLGSSSFSTACLGTTSSRCISNGPRSAFACIAAGLWGGLIIGFVTEYYTSHSYAPVREVARSTETGAATNIIYGLALGYKSTIVPVTVLAFGVWLSFSLMDMYGVALCALGMLGTLSTCLAIDVYGPICDNAGGIAEMAGMPDDVRDKTDALDAAGNTTAAIGKGFAIGSAALVSLALTAAFVTRTGALENGVNLLNPSVFAFLLIGSMLPYWFSAMTMKSVGVAAMEMVKEVKRQFDTIPGLLEGTPGHAPPNHARCXX

SEQ ID NO: 31589 - protein, 479 aa, Sarcolaena sp. Chase 903
  misc_feature (2)..(2): Xaa can be any naturally occurring amino acid
  misc_feature (116)..(116): Xaa can be any naturally occurring amino acid
  misc_feature (366)..(366): Xaa can be any naturally occurring amino acid
  misc_feature (414)..(414): Xaa can be any naturally occurring amino acid
  misc_feature (463)..(463): Xaa can be any naturally occurring amino acid
VXTLEKENRGRISQIIGPVLDVTFPPGKMPNIYNALVVKGQDTLGQQINVTCEVQQLLGNNRVRAVAMSATDGLMRGMEVINTGTPLSVPVGGVTLGRIFNVLGEPIDELGPVDTXTTSPIHKPAPAFIQLETKLSIFETGIKVVDLLAPYRRGGKIGLFGGAGVGKTVLIMELINNIAKAHGGVSVFAGVGERTREGNDLYMEMKESGVINEQNLAESKVALVYGQMNEPPGARMRVGLTALTMAEYFRDVNKQDVLLFIDNIFRFVQAGSEVSALLGRIPSAVGYQPTLSTEMGSLQERITSTKKGSITSIQAVYVPADDLTDPAPATTFAHLDATTVLSRGLAAKGIYPAVDPLDSTSTMLQXRIVGAEHYETAQRVKQTLQRYKELQDIIAVLGLDELSEEDRLTVARAXKIERFLSQPFFVAEVFTGSPGKYVGLAETIRGFKLILSGELDSLPGQAXYLVGNIDEATEKGTKL

SEQ ID NO: 31590 - protein, 492 aa, Delftia tsuruhatensis
MSGKFIEKHGIWSDTQKAAAADVLNKIEKAGLQMVRLSWPDQYGLLRGKMLSVAALRSAFASGSEITMAPFFFDTASAIVFNPFSADGGLGSAELAGSPNVVMVPDPTTFRILPWADRTGWMLADLYMTSGRPFALSPRAILKKALAEMQDLGYDYQAGLEVEWYLTRIVDPCLEPETLGGPGTPAAPPKVMPVAKGYSYLLENHLDEVEPIMAEVRQHLLALGMPLRSIEDEWAPSQMETTFDVMPGLDVADTMVLFRNAVKQVCRRRGYLASFMCKPAIQGFLASGWHLHQSLTARDSGANAFIPQPGEALSALGRSYVGGLLEHACAASSFTTPTINGYRRRRPYSLAPDRVTWAKDNRAAMARVISAPGDPASRVENRIGEPAANPYLYLASQVFSGIDGIRRQLDPGPLQETPYAADVTILPHNLSEALEVLETSKFFREAFGEEFIRYWMHLRRSEWKRFVDAEGQVDFSGDPVTNWEHREYFELF

SEQ ID NO: 31591 - protein, 488 aa, Theobroma cacao
SGVSTLEKRNLGRISQIIGPVLDVAFPPGKMPNIYNALVVKGRDTVGQQINVTCEVQQLLGNNRVRAVAMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESKLK

SEQ ID NO: 31592 - protein, 483 aa, Thomasia solanacea
  misc_feature (1)..(1): Xaa can be any naturally occurring amino acid
  misc_feature (7)..(7): Xaa can be any naturally occurring amino acid
XTLEKEXLGRISQIIGPVLDVAFPPGKMPNIYNALVVKGRDTVGQQINVTCEVQQLLGNNRVRAVAMSATDGLMRGMEVINTGAPLSVPVGGSTLGRIFNVLGEPIDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESK

SEQ ID NO: 31593 - protein, 302 aa, Methanocaldococcus jannaschii DSM 2661
MGGKMEKITCVGHTALDYIFNVEKFPEPNTSIQIPSARKYYGGAAANTAVGIKKLGVNSELLSCVGYDFKNSGYERYLKNLDINISKLYYSEEEETPKAWIFTDKDNNQITFFLWGAAKHYKELNPPNFNTEIVHIATGDPEFNLKCAKKAYGNNLVSFDPGQDLPQYSKEMLLEIIEHTNFLFMNKHEFERASNLLNFEIDDYLERVDALIVTKGSKGSVIYTKDKKIEIPCIKAGKVIDPTGAGDSYRAGFLSAYVKGYDLEKCGLIGAATASFVVEAKGCQTNLPTWDKVVERLEKHRI

SEQ ID NO: 31594 - protein, 129 aa, Synechocystis sp. PCC 6803
MHDSPEASSPAPTPHPETTRTPPWGMVTMLEEGPRYRINRIVVKPGQHMSTQMHYHRSEHWVVVSGTAKVICNGEEKLLNQKESTYVPMNTPHRVENPGVIDLVMIEVQNGEYLGDDDIVRFPEELPKS

SEQ ID NO: 31595 - protein, 383 aa, Gloeobacter violaceus PCC 7421
MRLEPPKKPRRRRGNALWILAVLVVALIGGGVYLWLVPSPIRAVAWNPPPRPPVVGPLAQNGRLMGADLIGRFAGPAAVAFDRAGRLYTGTEDGKIYRIALAAAGGRTVEVFADTGGRPWGLAFDGAGNLVVADARQGLLAIDAGGKVRVLAKRDGTRALGWLTAVAVAADGRVYFSEASEQPYGRDLYLEVLEARPTGRLLVYDPATNRVQVLATRLALPGGLALASGSTAVLVSEAARYRVMRYRLDGPGTGTGEPWIENLPGYPGGMARDGERFWLTIGEPRIDNIDRVHPNAELKNWLAKLPASWVRGNEKGYGLVLLLDKNGRILESLQDPTGRVNRLSNVEHFGADLYLATSIENGIARVRLAAGRAQSGNGLDRSR

SEQ ID NO: 31596 - protein, 462 aa, Vitis vinifera
MKETSTAGETSISVDERYTQWKSLVPTDGSVPNTLVIANCEVVKPRVAAAEHIAQFNEEARSPFVKKFKTIIHPGEVNRIRELPQNSKIVATHTDSPDVLIWDVETQPNRHAVLGTPESRPDLFWFTFSLAVNLHDAWSPPNKSGERFSGTFEPRITGSAYLETTEGKVLFLILTGHKDNAEFALAMCPTEPLVLSGGKDKSVVLWSIQDHISTLAADPGSAKSTSKAGGGNDKPVESPSIGARGIYQGHDDTVEDVQFCPLSAQEFCSVGDDSCLILWDARSGTTPAIKVEKAHNADLHCVDWNPHDINLILTGSADNTVRMFDRRKLTSGGIGSPIHTFEGHTAAVLCVQWSPDKASIFGSSAEDGILNLWNHEKIDKKQAPNAPPGLFFRHAGHRDKVVDFHWNASDPWTIVSVSDDGESTGGGGTLQIWRMIDLIYRNEDEVLAELDNFKAHLATCSP

SEQ ID NO: 31597 - protein, 263 aa, Magnetospirillum magnetotacticum MS-1
MTKILLVGCGKMGSAMLAGWLERGTSPGDVVVVEPSCPDLGSVRVVASHAAIPEGFVPHVVIFAVKPQVMADVVPPYARFGTSLFLSIAAGKTIAFFRSLLGPDAVIVRAMPNTPAAVRRGITVCCAEASVPAQARDLCGSLLEAVGEVGWVDDEALMDVVTAVSGSGPAYIFLLAEAMEAAGLAQGLPPALAERLARATVAGAGELLRLSSETTQQLRQNVTSPGGTTAAALAVLMAEKNGIPGLMSEAVAAATRRGRELAG

SEQ ID NO: 31598 - protein, 157 aa, Brassica napus
  misc_feature (147)..(147): Xaa can be any naturally occurring amino acid
MEEESNVSSSPSTRLRHRKQQRSSSAEAVVDGNPSPLLVNDQNKYKSFMVRTYSTIWMIGGFVMVVYMGHLYITAMVLVIQIFMAKELFNLLRKAPEDKCLPGIKHLNWHFFFTAMLFVYGRILSQRLANTVTADQFLYRLVSGLIXYHMAICYCCI

SEQ ID NO: 31599 - protein, 771 aa, Emericella nidulans
MPQLDHLYSGCSTCPPLATPPPRLIVVHATMSRTVHNFCTSHKAVSGKPYKHSVVVRIFFPSHFQIPHDKYIRTVTADPSILAHLLGEELYRKLGEYLSRHLEWVHGESMGHTDEALLSFYIREWQRYTTAAKYINHLFRYLNRHWVKREIDEGKKNVYDVYTQHLVKWKEDFFLKVHEKVMGAVLKLVEKQRNGETIEQSRIKSIVDSFVSLGLDETDPTKSTLEIYRYYFQRPFLEATRIYYEDESRQLCGQQRCGDMKKAEIRLEEEKARVGLYLNNDISKDLTSTCLDVLVTAHSELLRDEFQPLLDNERQDDLARMYRLLSRIKDGLDPLRTKFEAHVRRAGLSAVEKVAAEGDSFEPKMYVDALLSVHTRYHSLVKEAFNGESEFVRSLDNACREFVNRNKISKSGSTKTPELLAKYTDSLRKRGSKAAEESELEEMLVQIMTVFKYIEDKDVFQKFYSKMLAKRLVHVSSVSDDAETSMISKLKEACGFEYTNKLQRMFQDIQISKDLNSSYKDWLEKSFMDDDDRKKLVDSHFQILGTGFWPLTAPSTSFLAPPEIVKTSERFQKFYCDKHNRRKLTWLWQLCKGELKANYIKNTKVPYTFLVSTYQMGILLLFNESDTLTYSDIQKATTLTPEILDPNLSIFLKAKVLNISPEGSKPGPDSTFSLNYNFKNKKIKVNLNIQIKSEQKVETDDPHKTIEEDRKLLLQSAIVRIMKSRKKMKHVQLVQEVIHQVKSRFPPQVPDIKKNIEALMEKDYIERLDGD

SEQ ID NO: 31600 - protein, 387 aa, Clostridium perfringens SM101
MELNTLKSTFINNFGKEPNSLFFSPGRINLIGEHIDYNGGFVFPCPITLGTFAAATLRDDRICRAYSLNFESLGVIEFSLDDLSYKKEDNWTNYLKGVLKVLIEKGYKIDKGIDLVINGNLPNGAGLSSSASLEMLIVKILDTFFSLNISKVDAALIGKEVENTYIGVNSGIMDQFAISLGEKDKAILLDCNSLYYEYVPLNLGDNSIIIMNTNKRRELADSKYNERRKECDDSLDTLKKYTNISSLCELTSLEFETYKDKIEDSNKLRRCVHAISENERVKDAVKALKENNLELFGQLMNQSHISLRDDYEVTGKELDTLAENAWKQPGVLGARMTGAGFGGCAIAIVNNNHVDEFIKNVGQAYKDAIGYEASFYVASIGNGPTEL

SEQ ID NO: 31601 - protein, 334 aa, Gloeobacter violaceus PCC 7421
MWSCTTRQSAMILVTGGAGYIGSHVVLALQAAGFEILVYDNLVYGHAEFVPAPMLIRGDLEDRVGLARLFAAHPIEAVIHMAAYAYVGESVTKPAVYYRNNVHGTLCLLEAMVEADVKQIVFSSTCATYGEPEQIPITETHPQRPINPYGFTKLVVERMLRDFDRAYGLRSVVFRYFNAAGADPDARVGEDHDPETHIIPLVLDVAIGRRPHITVFGSDYETPDGTCVRDYIHVSDLADAHVLGLKYLKSGGPTEVFNLGNGSGFSVQQVIDTAGQVAGREIAVQMGARRPGDPATLVGSAERARAILGWQPRFADLQTIVSTAWTWHQKRFGG

SEQ ID NO: 31602 - protein, 525 aa, Zea mays
MDDAQSRSHELATGWPLLPQLLVVPLLLLLCLLSSGRRSREQGAAERRRAPPGPPKQLPVLGNLLQIGSRPHRYFQAVARRYGPIVEVQLGRVRTVVVSSPDAAKEVLRTNDLHCCSRPNSPGPRMLSYDFLDVAFSPYSDYWREMRKLFILELLSMRRVQSFAYARAAEVDRLVSSLASTPPGAAVDLSEKLYALSDGVVGTVAFGKMYGSAQFERSSFQRVMDETLRVLGSFTFEDFFPASRLARFADVLTGAAGRRSRIFRQIDRFFDSVIDKHLEPERLQAGVQEDMVDALVKMWREEQADGYEAPHGLTRDHIKGILMNTFAGGIDTCAVTMIWIMAELMRNPRVMQKAQAEVRTLVGNKPRVDEEDVKSLSYLKMVVKENFRIHPPGTLLIPRETMRSCVIGGYDVLPGTRIFVNVWAMGRDPSIWDRPEEFSPERFEGSHVDFRGSSFELLPFGSGRRSCPAIAMGVANVELVLANLLHCFDWQLPEGMVEEDIDMEETGQLAFRKMVPLCLVPIKRV

SEQ ID NO: 31603 - protein, 388 aa, Triticum aestivum
  misc_feature (201)..(201): Xaa can be any naturally occurring amino acid
  misc_feature (219)..(219): Xaa can be any naturally occurring amino acid
MASGTDEKAKMESLTSPAAFVEGGVQDACDDACSICLEAFCESDPSTLTGCKHEFHLQCILEWCQRSSQCPMCWQPVSMKDPTSQELLEAVERERNIRTNQTRNTTIFHHPALGDFEVRHLPVVANDAEIEERILQHLAAAAAMGRSHQHGRREGQRNRSGSHGSPQFLVFSAHPNTPAGSVSSSSAQGEGADDLRILVPXVGDSPPHANPMEKAAKKXPGSLTTMLTRCCVSSGNSTPVSIPRFFNRRHSSGQSTPVGNDRAGPSDVQSFSDSLKSRLNAVSLKYKESITKSTRGWKERLFSRNSSVSDLGSEVRREVNNGIASVSRMMERLETRGSGRPSYSPTTSTSEVCLTTEPSNERVTESNSNTTASTSNTSTPCVTTSGSN

SEQ ID NO: 31604 - protein, 260 aa, Debaryomyces hansenii CBS767
MLSLFSLEGQVALITGGTNGIGLGMAKGLADANIDQIILTYRSEKPLENTIKVLQEVNPKVKISSIEADFGTGNEDDLVAKIATEAFKKSVSGKIDILINNAGINNRFPFDEFPQDKFDEVLRVNLNIPVKLTKAIGCKMLETKTKGKIVFTASLCSFQGGVDSTAYAITKGGIKQFTAALSNDWSLKGIRVNSIAPGYISTNLTEQIDPKRRETLISRIPIGRWGNMDDFQGPAVFLCSEASRYVTGETLVVDGGWLGY

SEQ ID NO: 31605 - protein, 388 aa, Burkholderia sp. 383
MKIHEYQGKEILRKFGVAVPRGKPAFSVDEAVKVAEELGGPVWVVKAQIHAGGRGKGGGVKVAKSIEQVREYANQILGMQLVTHQTGPEGQKVNRLMVEEGADIKQELYVSLVVDRVTQKIVLMGSSEGGMDIEEVAEKHPELIHKVIVEPSTGLLDAQADDLAAKIGVPAASIPQARAILQGLYKAFWETDASLAEINPLNVSSDGKVIALDAKFNFDSNALFRHPEIVAYRDLDEEDPAEIEASKFDLAYISLDGNIGCLVNGAGLAMATMDTIKLFGGEPANFLDVGGGATTEKVTEAFKLMLKNPDLKAILVNIFGGIMRCDVIAEGVIAGSKAVNLNVPLVVRMKGTNEDLGKKMLADSGLPIISADSMEEAAQKVVAAAAGK

SEQ ID NO: 31606 - protein, 454 aa, Pseudomonas fluorescens Pf-5
MTHKNPQTREWQTLSSDHHLAPFSDFKQLKEKGPRIITHAKGVYLWDSEGNQILDGMAGLWCVAIGYGRDELAEAASKQMRELPYYNLFFQTAHPPVLELSKAIADIAPEGMNHVFFTGSGSEGNDTMLRMVRHYWAIKGQPNKKTIISRVNGYHGSTVAGASLGGMTYMHEQGDLPIPGIVHIPQPYWFAEGGDMSPEEFGIWAANQLEEKILELGVDNVGAFIAEPIQGAGGVIVPPDSYWPRIKEILAKYDILFVADEVICGFGRTGEWFGSDFYDLKPDMMTIAKGLTSGYIPMGGLIVRDEVVAVLNEGGDFNHGFTYSGHPVAAAVALENIRIMREEKIIQRAHEKAAPYLQKRLRELSDHPLVGEVRGVGLLGAIELVKDKATRARYEGRGVGMICRQFCFDNGLIMRAVGDTMIIAPPLVISEAEIDELVAKARKCLDLTLSVLEG

SEQ ID NO: 31607 - protein, 147 aa, Phytophthora infestans
MALKRINKELQDLGRDPPANCSAGPVGDDLFHWQATIMGPEDSPYAGGVYFLNIYFPADYPFKPPKVNFTTRIYHCNINANGGICLDILKDQWSPALTISKVLLSICSLLTDANPDDPLVPEIAQIYRTDRARHDATAREWTAKYAT

SEQ ID NO: 31608 - protein, 679 aa, Ostreococcus tauri
MRDDTVEKEGTWEELDDLRRRARDEDWLIDVEASCSFERSLGKGSSGEAFLARWRGARVVVKRIEALKTTLAKRAFARECAIMARVRHPNVLAFYGAALSESRCDVVVEHAAGGTLKAWLHESGRQKRSLSERLDVGMDVARAFAYLESRTPSVMHRDLKPSNVFVAADGRAMVADFGLSRFVAANGEELTGETGTYIYMAPEVIRSEHYDNRADVFSYGVLLHELVTGIEPYQPHNSTAIQIATAVADQGLRPNIPEDTHAGLAAIIEMCWQQNASDRPSFAVILESMETMVPDILKEQEAKAAARRENPSVQAKAFQNLSHTFATWSSKMAELGGVWNPHVWSTSCEHSPHYTSSSRDHVHFDDAVRIRCRVLSERSVRAGRPRPRGHTACWRTQSAGGSLSRRFRKCCSSNHRRTRGNEYFRCGGTLITDTHVLSAAHCFFDDAGVSNVDDYSAVHVRLGAQEDVYAGVTSYVTQINGHPQFDGSSFDNDVAVLTLASPVDVQMYVPVTLSWDPSDVVAEGQIMGKIVGWGTREDGRLSSQLIEGDVPIVSRAQCTSAGSYNPADILPSHICAGYVEGGIDSCQGDSGGPLSVNSKQVGIVSWGDGCALARKYGVYFHVAASEGFIGLATDSRVYEWSPTDGSIPSPPPTPSPPSTPPPLGLFPFPMLSLFSLFSF

SEQ ID NO: 31609 - protein, 485 aa, Trochetiopsis erythroxylon
  misc_feature (8)..(9): Xaa can be any naturally occurring amino acid
SGVSTLEXXNLGRISQIIGPVLDVAFPPGKMPNIYNALVVKGRDTVGQQINVTCEVQQLLGNNRVRAVAMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALAMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMES

SEQ ID NO: 31610 - protein, 458 aa, Pseudomonas fluorescens Pf-5
MSVPPRAVQLNEANAFLKEHPEVLYVDLLIADMNGVVRGKRIERTSLHKVYEKGINLPASLFALDINGSTVESTGLGLDIGDADRICYPIPDTLCNEPWQKRPTAQLLMTMHELEGDPFFADPREVLRQVVTKFDELGLTICAAFELEFYLIDQENVNGRPQPPRSPISGKRPHSTQVYLIDDLDEYVDCLQDILEGAKEQGIPADAIVKESAPAQFEVNLHHVADPIKACDYAVLLKRLIKNIAYDHEMDTTFMAKPYPGQAGNGLHVHISVLDKDGKNIFASEDPEQNAALRHAIGGVLETLPAQMAFLCPNVNSYRRFGAQFYVPNSPSWGLDNRTVAIRVPTGSADAVRIEHRVAGADANPYLLMASVLAGVHHGLTNKIEPGAPTEGNSYEQNEQSLPNNLRDALRELDDSEVMAKYIDPKYIDIFVACKESELEEFEHSISDLEYNWYLHTV

SEQ ID NO: 31611 - protein, 310 aa, Phytophthora infestans
MSALTQYKPVATSEKKSGAMSFLLDLAAGGVAGGISKTVVAPIERVKLLLQVQAASTQIKPEDQYKGIVDCFVRVTKEQGVNSLWRGNLANVIRYFPTQALNFAFKDKFKKLFMDGVTKEQFWRFFMGNLASGGAAGATSLLFVYPLDFARTRLGADVGKGKSRMYTGLVNCVSTIYKSDGISGLYQGFGVSVGGIIVYRAAFFGGYDTLRDVALRDPKNAPVWQKWLVAQTVTSLAGMISYPFDTVRRRMMMQAGRKDILYTSTLDCAMKIAKNEGSGAFFKGAGSNILRGTGGAIVLVLYDEFKKMMV

SEQ ID NO: 31612 - protein, 338 aa, Saccharomyces cerevisiae
MSLQHEKVTIAPLVLLSALDHYERTQTKENKRCVGVILGDANSSTIRVTNSFALPFEEDEKNSDVWFLDHNYIENMNEMCKKINAKEKLIGWYHSGPKLRASDLKINELFKKYTQNNPLLLIVDVKQQGVGLPTDAYVAIEQVKDDGTSTEKTFLHLPCTIEAEEAEEIGVEHLLRDVRDQAAGGLSIRLTNQLKSLKGLQSKLKDVVEYLDKVINKELPINHTILGKLQDVFNLLPNLGTPDDDEIDVENHDRINISNNLQKALTVKTNDELMVIYISNLVRSIIAFDDLIENKIQNKKIQEQRVKDKQSKVSDDSESESGDKEATAPLIQRKNKKN

SEQ ID NO: 31613 - protein, 241 aa, Oryza sativa
  misc_feature (121)..(121): Xaa can be any naturally occurring amino acid
MSSTNNSSGEPPPAVRVLGGWASPFTNRVVVALKLKGVEHELLQETVGKKSELLLRSNPVHKKFPVLLHHGKPLPESLVIVEYIDEVWPASNGAASAILPRDPHGRAVERFWARYVDDKGXRVLRGSVTGDKYKTAGEMSTALQRLEEAFVKCSQGKEYFGGDSIGYLDIALGSFLGWIKAVEKIAGVELLNETKLPILAVWADRFCAHPAVVDVVPDADKLVEFTVQYGAVLNTTNVLPK

SEQ ID NO: 31614 - protein, 480 aa, Sparrmannia ricinocarpa
TLEKENLGRISQIIGPVLDVAFPPGKMPNIYNALVVKGRVGQQINVTCEVQQLLGNNRVRAVAMSATDGLTRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKETLQRYKELQDIIAILGLDELSEEDRLTVARARKIERFLSQPFFVAEVFTGSPGKYVGLAETIRGFKLILSGELDGLPEQAFYLVGNIDEATAKATNLEMESK

SEQ ID NO: 31615 - protein, 567 aa, Physcomitrella patens subsp. patens
MQVGNQSFEQGDSNEVRKCTVRGCIKSTSGPWIVRRPPGKGQETAAAVLRMPSARERENNKRRERRRRAIAAKIFAGLRTHGNYCLPKHADHNEVLKALCHEAGWQVEEDGTIFRKSHNCINTIALRQKEKEEEEEEEEEVQEDEEERNGENYVVMHHICSSLVEGNVFSQIIRICPEETLYGSQPSPRQVMTAQKTPEGTPSCERSFKSDTSPSTSCSQAGQASDEPTCTARSDAAEVRQLGRTSVDFQYEDNRQYLDPLTNLQTMVDHASAGQARNTHPNCGDSKNRLGWKSGPVFLLPEQTVSLRHLSNLNDPPVPTSSGAEDDRYVCPTRAVKNEWETTHGISNAFCSGLRTMGKTSLITSASEKDVSSGHDKLSPTPHFAATMNSVDLDRSLECRSPLGVLDHTTQLERDQPNSHFSVQRRGDFTLGPLLQRKTQDPDVRKHFTLFPKAADLLRQSHKEQGDQYSCLTHEMVDLTDEAYESPQDGLFLCSGRAAATMSTGSTRVNLHPVNLVNERGGASSISNQHRKTSADGHARREITDELALTLCTSARHSHSSELGRVA

SEQ ID NO: 31616 - protein, 289 aa, Ostreococcus tauri
MHNRWIRRALNLERGASGGKPSAPRVVDVNAARRSAWLAGAAYCKHGIQNWTCAYCVDGPTRLRDVGVFEHKRKRVKAYAGYDGKTKVGVVAFRGTDPSSLYNWVEDLDAMHSTLPTAEVKDGVGRVHSGFHDAYDSVRKELISHMIDMRTKYDRMWRHFEVEVTGHSLGGALSTLVALELEALGFQIKSVTTFGSPRVGDEVFADFWGKKFGDRTMRMTHAHDMVPSLPPRMLGYHHVATEVFQNASGAYIMGDGSGEDPRGSDSEWTHASLADHLVYADLPMCNCNM

SEQ ID NO: 31617 - protein, 488 aa, Tilia platyphyllos
SGVSTLEKENLGRISQIIGPVLDVAFPPGKMPNIYNALVVKGRDTVGQQINITCEVQQLLGNNRVRAVAMSATDGLMRGMEVIDTGAPLSVPVGGATLGRIFNVLGEPVDNLGPVDTRTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESKLK

SEQ ID NO: 31618 - protein, 284 aa, Ostreococcus tauri
MSRTRIDLSKVAMERATSTTRASSGDEIWASLRQGGQELVEKEPLMGGFVYATILNQPTFERALAFLVASKIANATILQGQWNDLIMEALNATNEEGNRVQNGPGTGSISEAAREDLKAIVERDPACPSYTHAFCFFKGFQGLQAQRVSHWLWGHHRKVLACKMQSLVSEVFNMDLHPAAKFGRGIMIDHGHGVVVGETAVVDDGCTLLHGVTLGGTGKVRGDRHPKLGKRVVVGSNASVLGNITVGHDCKIGAGAALMHDLPPNTTVVGHKGRVVTKKTMSKL

SEQ ID NO: 31619 - protein, 237 aa, Streptococcus pneumoniae TIGR4
MNHDGKMMRTDDLIQFSKKHNIPLITIKELQEYRKVYDQLVERVSTVNMPTRYGNFKAISYIDKLNGEHHLALIMGNIEDEANVLCRVHSECLTGDVLGSLRCDCGQQFDKAMKMIVENGSGVLLYLRQEGRGIGLINKLKAYHLQDQGMDTLDANLALGFEGDLREYHIGAKMLKDLGLQSLHLLTNNPDKVEQLEKYGITISSRISIEIEANPYDSFYLETKKNRMGHILNMEEK

SEQ ID NO: 31620 - protein, 400 aa, Magnetospirillum magnetotacticum MS-1
MPFIADRLSAIKPSPTIAVTQKAAELKAAGRDVIGLGAGEPDFDTPDNIKTAAKVAIDKGLTKYGPPAGTVDLRNAIAAKFKRENGLDYTADQVTVGVGGKGVIFNAFMATINPGDEVIVPAPYWVSYPDIALMFGGKPVFVPCPEAAGFKLQPADLEAAITPKTKWLVLNSPSNPTGAAYSWDEMKALTDVLVKHPHVWIMSDDMYEHLVYDDFKFCTPAQVEPKLYDRTLTMNGVSKAYAMTGWRVGYAAGPVAIIKAINMIQSQSVTHTSSISQAASVEALNGTQDFIPKNAAVFKRRRDLIVGLLNQCPGITCRTPEGAFYVYPSCAGVIGKKTPDGKVINSDTDFVGALLEAEGVAVVQGAAFGLEPYFRISYATSDAALTKAAERIKRFCESLK

SEQ ID NO: 31621 - protein, 157 aa, Streptococcus pneumoniae TIGR4
MDFSRKDNQSMEYRKIQEALEALQKGRLVLVIDDKDRENEGDLICSAQAATTENVNFMATYAKGLICMPMSESLANQLMLSPMVENNTDNHKTAFTVSIDYKETTTGISAEERGLTARMCVAEDITPSDFRRPGHMFPLIAKKRWCPRKKWTHRSNC

SEQ ID NO: 31622 - protein, 260 aa, Photobacterium leiognathi
MAYMLKYDSTHGRFNGTVEVEGGNLIVNGKTVRVTAERNPEDLKWDAINVDVVAEATGLFLTDETARKHITAGAKKVVLTGPSKDATPMFVMGVNQDTYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDQVVSQDFIGETQTSVFDAKAGTL

SEQ ID NO: 31623 - protein, 460 aa, Frankia sp. EAN1pec
MTAAPVASLSHHSLLIFLLQVTVLLCLALGLGRLAIRLGLPSVVGELLAGVVVGPSLLGAVASEFSGWLLPAEPDQMHLLDALGQIGVILLVGLTGIEMDMRMVRRRGATAARISIAGLVLPVGLGIGAGLLLPESLLADGADRGEFALFLGVAMGVSAIPVAAKILHDMRLLHRNVGQLILASATVDDAVGWSLLSVVSAMATTGVRGGDIAWPVLSVIGVVAAAFVVGRPLARLAVAAGGLARPSAETAETADTGGTGSGSGIAVAVVFILAAAAGTHALKLEAILGAFIAGILLGSTPTLDIRRLEPLRLMVMGVLAPIFFASAGLRIDLTALTRPEVALAAVVILGLAILGKFAGAYIGARASRLGHWEALSLGAGLNARGVIEIVVAGTGLRLGVLSTATYTVIVLVAVVTSIMTPPILRATMRRVEQTAEEQLRELDLAGRSVGAPRGLDAERP

SEQ ID NO: 31624 - protein, 329 aa, Gloeobacter violaceus PCC 7421
MRAVAIKSFGGPENLAACQMPDPQPEVGEVTIDVEYAGVNYLELMFRRGFVAVPLPFVPGIEVAGHIRAVGEGVTDLQVGQPVAALTIVGQGGYAEVVRSPAALTFALDTLERPVDLAAAAAFPCTMITAYLVLSAAARFTPGDAVLVHAAAGGLGSALGQVARRLGAGQVLGTVGSPDKIAYAQAHGYDRVFLREHYREAVIAATGGAGVQIVVDPVGGNLRSESLEVLSVLGQLIVLGNAGNGEDTFQSTNGLWLSSKGVQGFNLLAVCLQAPEKIKDAARRVLEWIARDELHVPISGVLPLEAADEAHRRIEQRATTGKLILKIGR

SEQ ID NO: 31625 - protein, 153 aa, Actinobacillus pleuropneumoniae
MAKITGNLVATGLKFGIVTARFNDFINDKLLSGAIDTLVRHGAYENDIDTAWVPGAFEIPLVAKKMANSGKYDAVICLGTVIRGSTTHYDYVCNEAAKGIGAVALETGVPVIFGVLTTENIEQAIERAGTKAGNKGSECALGAIEIVNVLKAI

SEQ ID NO: 31626 - protein, 385 aa, Guillardia theta
MAFLPVRSLLLIGVIASSSAFVPSVSLRGASPARSSLPAASRVARHGAVVATKMNTETKPEGFGASHTSFYTSAKAKDSYATLDEVLNQKMKDEGVRQVTREMLDAAVKITEALRVNLVTVADAQNSVFGDVQLGVDVIADNIMWDAAKASKVVKEAASEEEPVLVETNPNGRFTICWDPLDGSSIVDNNWAVGTMIGIWDKKTGMLGATGRDQVTSIVVLYGPRTTALVACDDGVYEFTCGAGNKWIASREKIQIKKDSKIFSPANLRCCQEDAGYDALVKHWMEKRYTLRYSGGLVPDVYQHFTKEMGVFANPTSPKSPAKLRVAFEIAPFSLLVEKAGGKTSDGVTGNSCLDIKIEAVDQRTPACLGSANEVDLFNKMVLGK

SEQ ID NO: 31627 - protein, 294 aa, Glycine max
MDQYEKVEKIGEGTYGVVYKARDRATNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRSTNALKLADFGLARAFGIPVRTFTHEVVTLWYRAPEILLGSRQYSTPVDIWSVGCIFAEMVNQRPLFPGDSEIDELFKIFRIMGTPNEDTWPGVTSLPDFKSAFPKWQPKDLKNVVPNLEPAGLDLLSSMLYLDPSKRITARSALEHEYFKDIKFVP

SEQ ID NO: 31628 - protein, 144 aa, Fulvimarina pelagi HTCC2506
MTIKRILEEKGRDVVTLTPSVTLAEVAQVLSEKRIGAIILVEDNGRLAGIVSERDIVRVVAARGPDVLTQLVKEAMTPKVVTVREDMSIDEAMRLMTEKRFRHLPVVDETEQLVGFVSIGDVVKRKISEAEAEASMMRDYINTN

SEQ ID NO: 31629 - protein, 446 aa, Trichodesmium erythraeum IMS101
MTKVAIIGSGPCGLSILRSFQQAEEKGQIIPELVCFEKQSNWGGLWNYSWRTGSDQYGDPVHNSMYRYLWSNGPKECLEFADYSFDEHFQQPIPSFPPREVLYDYILGRAKKSNLKKYIKFNTVVNNVVFNDDQFVITSLNKKENSISQENFDYLVVATGHFSVPYVPEYEGMNSFPGRILHSHDFRDAEEFRNKDVVVLGSSYSAEDIALQCYKYGAKSVTIGYRNNPIGFEWPEGMKEVHYLDKLEGNKATFKDGHTQNVDALILCSGYLHHFPFLEESLKLKTHNRLYPPKLYKGVVWQDNHKLFYLGMQDQFYTFNMFDCQAWYARDVIMGKTQVPDDAEIEKDINNWVVKEEALEDSIQMIDFQTEYTKDLQVASDYPKIDFELIRTHLKEWKHHKEENIMTYRDKSFSSPVTGTVAPLHHTPWVEAMDDSMTTFMKAKSS

SEQ ID NO: 31630 - protein, 715 aa, Photobacterium profundum SS9
MTQHESANSQPSAFSLTFGDNGVAWLKIDVPNERMNTLQSAFVDQVTDVLAQLKDKKDIKGMVVYSGKPDNFIAGADIRMLAACQTADEAQQLAAKGQELFGQLEALPFHVVAAIHGPCLGGGLELALACHSRVCSDDDKTRLGLPEVQLGLLPGSGGTQRLPRLIGVANALDMILTGKQLRAKKAKNLGLVEEAVPLSILLDIAEKQALKGKPKRKGSFQEWAMGGNALGRSVVFDQAAKKTHEKTRGNYPAADAILDVIKYGLQHGMKKGLDQEAKRFGELVMTSESAALRSIFFATTAMKKESGSDALPATIKKVGVLGGGLMGGGISHVTATKAGYPVRIKDISNDGIKNALVYNFKLLDKQRKRRIISKAELQNKMFSITGGTTFTGFTNVDVVIEAVFEDINLKHQMVKDIEQQTSDYTIFASNTSSLPIHQIAAAAERPENVVGLHYFSPVEKMPLVEVIPHQGTENGSATSEQTIATVVALAKKQGKTPIVVADKAGFYVNRILAPYMNEAAAVLLSGEPIEHIDRSLLDFGFPVGPITLLDEVGVDIGAKISPILLAELGERFKAPDVFDLLLSDDRKGRKSGKGFYLYNTKKKEVDKSVYKLLSLEPEQKAAGQDIALRCTLMMLNEAARCLDEGVIKSARDGDIGAIFGIGFPPFLGGPFRYMDTLGAKRVVEMLKDHTDKYGGRFTPCDKLVAMANEEQSFYS

SEQ ID NO: 31631 - protein, 486 aa, Delftia tsuruhatensis
MKEFLNFINGEYVRNASGKTFQDINPVNGSVIGNIYEAGQAEVDAAVAAARAALKGDWGRLSVAERCKLLDAVAGEINRRFDDFLQAEIADTGKPHHLASHVDIPRGAANFQIFIDTIKSTATESFNMRTPDGKTALSYGVRVPRGVIAVVCPWNLPLLLMTWKVGPALACGNTVVVKPSEETPATATLLGEVMNQVGMPKGVYNVVHGFGPGSAGEFLTQHPGVNGITFTGETRTGTAIMKAAADGVRPVSLEMGGKNAAVVFADCDFQVTIDTLTRSCFENAGQVCLGTERVYVERPIFEKVVAALKERAEAMKPGLPFDHDTKIGPLISKKHQAKVLGLYKTAKDEGATIVTGGGVPDMPDALKDGSWVQPTIWTGLPETATVVTEEIFGPCCHISPFDSEEEVLGKVNANRYGLATAIFTQDIARANRLAHQIEVGLCWINAWFLRDLRTPFGGSKQSGIGREGGVHSLEFYTELRNVMVKF

SEQ ID NO: 31632 - protein, 215 aa, Phytophthora infestans
MGAMLPYWFTAMTMKSVGVAAMEMVKEVKHQFATIPGLLEGLPGHGPPDHARCIKISTDASLREMIPPGLLVMLSPIIAGTFFGVHAVSGLLVGSLTSGVQLAISQSNTGGAWDNAKKFVEKGCVSIEDKEGKLIVQGKGSAIHKAAVIGDTVGDPLKDTSGPALNILMKLMAIISLVFGDFFKSINNGRGLLNVPADVSAAAAPVVEVTAAPQL

SEQ ID NO: 31633 - protein, 333 aa, Phytophthora infestans
MANQVDHSNPITLSRFILAEKEIQGNADLSVLFTSIELACKVIASSVRRAGLTGLYGLDGSENSTGDQVKKLDVLANDIFINSLKFSTKIEVMVSEEEEKPIVVQNDSSGTKYCIAFDPLDGSSNIDCNVSTGTIFAIYQRDASSEGGYKDILQPGSKLVSAGYCMYGSSTQLVLTWGKGVHCFTLDPTIGAFMLSHQDIRIPDEPKAIYSCNEGNYAQWDSATKAFVDECKTGSKAYAARYVGSMVSDIHRTILYGGIYLYPGSTKAKDGKLRLLYECNPMSFIVEQAGGMATTGTERILDLVPTDIHQRSPIFLGCKRDVERVIALYKEHN

SEQ ID NO: 31634 - protein, 162 aa, Ostreococcus tauri
MDRTRAEASTEETYPGVPGIPRADVDAFLSRLDDCQPVIPDELTNHYLKRAGVREPDVRVTRLISLVTEQFVQSVADDAYRCAVQRHQAQAKDKRERGYDTRDKRIVLENEDLAAALKDHGVNLHKPPYYVGAARPEEVEEQEEAVKEELNEEPTEKKRRSN

SEQ ID NO: 31635 - protein, 402 aa, Zea mays
LIRLQLDLIHNFFQITTVDEAKEFYPLFGLGANIALIFSGRTLKYFSNLRRTLGPGIDGWEVSLKGMMSIVVLLGLVITSIYWGVNKFVLNDPSLPKADRKKKKEKPKLGMKESLKVLLSSRYVRDLATLVVAYGISINLVEVTWKSKLKAQFPSPNEYSSFMGDFSTATGIATFTMMLLGRIILRKFGWGVAAKITPTVLLLTGVGFFSLILFGQPLTPMLATMGMTPLLAAVYVGAMQNIFSKSAKYSLFDPCKEMAYIPLDEDMKVKGKAAIDVVCNPLGKSGGALIQQFMILTFGSLANSTPYLGGILLVIVLAWLAAASSLDKQFSSLAKQDLEREKAAQDQEKLERSLLSSKPAEGGTGDVLLVEQQTNGSATSKATGTESSPSNSSLPPHSIDRS

SEQ ID NO: 31636 - protein, 341 aa, Ostreococcus tauri
MVQSQYRPRRAKPELYSNARATRERGPDARERVHSLRDRFHRARAPRTLEGHPDSLRVAYQGVPGAYSEGAAVAAYEGCVTVPKEQFDDVYAATEAQEVDRAVLPFENSLGGSIHRNYDLILSHQLHVVGEVYYRVNHCLLGMPGQRIEDLTRAQSHPQALAQCEGYLMKKKMAREAVDDTAGAAKAISEGELMGVAAVASRRAADLYGLEVYDEAIQDDKSNVTRFLALSRDPIPPMETDVPYKTSIAVSLKEEPGALFKALACFSLRNINMTKIESRPLRTNPVTSAGARSSMQFTYLFYIDFEANIADEKMQNALRHLEETATFLRVLGSYPRDCSQL

SEQ ID NO: 31637 - protein, 414 aa, Phytophthora infestans
MAKLSIKNVDVKGKRVLIRVDFNVPFAQDGSISNTQRIDAALPTVQYVLDQGAKAVVLMSHLGRPEGKPKAKDSLAPVAVAVEQKLGRKVTFLKDCVGPEVEAACANPTEGSIILLENLRFHVEEEGKGKDAEGNKTKASSEAVAAFRASLSKLGDVYVNDAFGTAHRAHSSMVGVDLPIKAAGFLLDKELVYFAKALDAPQRPFVSILGGAKVADKIQLIMNMLDKVDEMVIGGGMAYTFKKVINNMEIGGSLYDEEGAKIVPQIVEKAKAKGVTLHLPVDFVIADKFAADAATKISTEEEGIPAGWMGLDVGPKSQEAFSAAVAKAKTVVWNGPMGVFEFDAFADGTKVVMDAVVKATESGATTIIGGGDTATCCVKFNTEDKVSHVSTGGGASLELLEGKILPGVDALSSA

SEQ ID NO: 31638 - protein, 170 aa, Triticum aestivum
  misc_feature (97)..(97): Xaa can be any naturally occurring amino acid
  misc_feature (123)..(123): Xaa can be any naturally occurring amino acid
GGRARTSSSSPGGGPPRASSAARSRCRRRSSGCCRSPGPSPPRTGKCRQGSGSACRSIYGGFVKWCMGKNDDGSDSKAVQLVDESHWDDLVIIIAVXKQKETSSTSGMRDTIETSPLLQYRAXDSNQFHVVCLDTSPPMFYMNDTPHRIISLVEKWNHSEGTPHVYSVPV

SEQ ID NO: 31639 - protein, 336 aa, Triticum aestivum
  misc_feature (99)..(99): Xaa can be any naturally occurring amino acid
  misc_feature (104)..(104): Xaa can be any naturally occurring amino acid
  misc_feature (237)..(237): Xaa can be any naturally occurring amino acid
  misc_feature (250)..(250): Xaa can be any naturally occurring amino acid
  misc_feature (260)..(260): Xaa can be any naturally occurring amino acid
  misc_feature (269)..(269): Xaa can be any naturally occurring amino acid
MASSVAAASLRALAGASPAPLPKPFLVLLSPAPPRRLGLGLRAARPRGPLAPLASSDSFFETSAAVDVAEPEDEALEAVAEEEPAVAEEEEDVAAEEEXWRRSXEYVEPPEEAKVYVGNLPYDVDSERLAQLFEQAGVVEVSEVIYNRETDQSRGFGFVTMSTIEEAEKAVEMFHRYDVNGRLLTVNKAAPRGARVERPPRDSGSSFRIYVGNLPWQVDDSRLVELVSEHGQVVHAXAVYHRDPGRFPGXFGFVTMASAXELDDAIAAXMDKSLEGRSPPVNVPNNAVIKCIGGHTRCREHTAPVNPTTLASRSPNVSLAPPFSPSSSNFNFPGLP

SEQ ID NO: 31640 - protein, 154 aa, Magnetospirillum magnetotacticum MS-1
MRIVETVVAVNEARKKQMAERVVAACGGSVKGKTVSVLGLTFKPNTDDMRDSPSIDIVAALMEAGAVVKAFDPEGMEEAKKLLPAGVEYCKDAYATMPGAHCTVIITEWNEFRALDFKKVKSLLAQPSIVDLRNVYEPSEMTEMGFAYTSIGRP

SEQ ID NO: 31641 - protein, 274 aa, Triticum aestivum
  misc_feature (262)..(262): Xaa can be any naturally occurring amino acid
  misc_feature (272)..(272): Xaa can be any naturally occurring amino acid
MAHLLRRSILRPLVASKPFVTPIATHRITRLASHLSTAKMAPVPSTMKAVQINKNGGVEVLEHNDVPVPKVGEGQILVRNQIAGLNFIDTYFRSGLYKAPQFPLTLGREAAGTIVDIHSSVKGFENGSRVVFMGTVGAYAQYSVVNASDAVKIPDDVPTEQAVAAYLQGLTAWTFIREAGQVKEGQWVLVHAASGGVGTLLVQLLRTVGAKIIGTASTDEKLELAKKNGAEWVISSHDDVVAKVKEITGGHGCGWVSLMGVXKVTFDADLEXIA

SEQ ID NO: 31642 - protein, 306 aa, Magnetospirillum magnetotacticum MS-1
MIGTGYVGLVSGTCFSEFGIDVVCVDKDAGKIEKLHQNIMPIYEPGLDDMVAANVEAGRLSFTTDLKAAVKDADAVFIAVGTPSRRGDGHADLSYVYAAAEEIADAMTGYTVVVTKSTVPVGTGDEVERIIRARRPDAQFDVVSNPEFLREGSAINDFMRPDRVVIGTESEKARKVMKQLYRVLYLIETPIAFTSRRTSELIKYAGNTFLATKITFINEIADLCEKVGANVHDVAKGIGLDGRIGRSSCIPAPAMAGRASPRTPWPWSRPRGIMTRPCASSRPWSPSTRPAKSRWPNASSPPVAVR

SEQ ID NO: 31643 - protein, 282 aa, Magnetospirillum magnetotacticum MS-1
MFPVGGMGTRFLPATKAMPKEMLPVVDKPLIQYAVEEAAAAGCEHFIFVTGRGKNALEDHFDHNPELERILKDRGKFDLVEAVTSWMPKSGQISYTRQSEPLGLGHAVWCARDLVADEPFAVLLPDDLILSKTACLKQMAAVHTEVGGHVVAVSDVPREHTKRYGILDVEHDNGRLARAKGLVEKPDPEVAPSTLSIIGRYILHPAVFDVLDKKEKGAGGEIQLTDAISQTIGMVPFHGLRFEGARFDCGDKVGWLEANLAFALARDDMAEAARDLITRFHG

SEQ ID NO: 31644 - protein, 537 aa, Frankia sp. EAN1pec
MIIVSELELRAGARTLIEPVSFRVQPGDRIGLVGRNGAGKTTMLKTLAGETLPFAGKVDIRGEIGYLPQDPRTGDLADTARDRVLAARGLDVILREMEKLQLEMAEFVDETARDTAVRRYGRLEERFGMLGGYAAEAEAARICSSLGLPDRVLGQQIGTLSGGQRRRVELARILFAGSGNSDATLLLDEPTNHLDADSITWLRDFLRAHSGGLIVISHDVDLLDKSVNKVFHLDANRAALDVYNVNWKTYLTQRDQDERRRRRERANAEKKIDSLRAQADKMRAKATKARAAHQMDRRAERLASGLAEVRVADRVAKLRFPDPAPCGRTPLTATGLSKSYGSLEVFTGVDLAIDRGTRVVVLGLNGAGKTTLLRMLAGQETPDAGEVHPGHGLRLGYYAQEHETLDTSRTVLDNMRAAAPTASDVDLRRILGAFLFGGDAVEQLAETLSGGEKTRLALAGLVCSSANVLLLDEPTNNLDPASRDEVLSALRTYRGSVVLVTHDPGAVEALSPDKVLMLPDGVEDTWSPDLADLVTLA

SEQ ID NO: 31645 - protein, 302 aa, Zea mays
ARREVMSVHGCKKLVLSSSAAVYGSPKNSPCTENFPLTPNNPYGKTKLVVEDICRDIYRSDPEWKIILLRYFNPVGAHPSGYLGEDPRGIPNNLMPYVQQVAVGRRPALTVLGNDYATRDGTGVRDYIHVVDLADGHIAALQKLFENSSIGCEAYNLGTGRGTSVLEIVKAFEKASGKKIPLIFGERRPGSAEIGFSETTKAERELNWKAKYGIEEMCRDQWNWASKNPYGYGSPDSIKQNGHQTNGSADSSKQNGHRTNGSTDSPKRNGHHAYGSADSPKRNGHCVFGSSDLKPNGNGHLR

SEQ ID NO: 31646 - protein, 262 aa, Zea mays
MAGLGKAMYAVGFWIRETGQALDRLGCRLQGKYFFHEQISRHRTIMNIFDKTPHVHKDAFVAPSASLIGDVQVGSGASIWYGCVLRGDANIIQIGSGTNIQDNSLIHVAKSNLSGKVFPTTIGNNVTVGHSAVLQGCTVEDEAFVGIGATLLDGVVVEKHGMVAAGALVRQNTRIPCGEVWGGNPAKFLRKLTDDEISFIAESAANYSNLSKVHAAENAKPLEKIEFEKVLGKKFAHQDEYDSSIGVTEGAPPELTSPNPAQ

SEQ ID NO: 31647 - protein, 511 aa, Oryza sativa Japonica Group
MARMGISKGGSGKEAKKPPLLLGRFEVGKLLGQGNFAKVYHARNVATGEEVAIKVMEKEKIFKSGLTAHIKREIAVLRRVRHPHIVQLYEVMATKLRIYFVMEYVRGGELFARVARGRLPEADARRYFQQLVSAVAFCHARGVFHRDIKPENLLVDDAGDLKVSDFGLSAVADGMRRDGLFHTFCGTPAYVAPEVLSRRGYDAAGADLWSCGVVLFVLMAGYLPFQDRNLAGMYRKIHKGDFRCPKWFSPELIRLLRGVLVTNPQRRATAEGIMENEWFKIGFRRFSFRVEDDRTFTCFELDDDAAVDAPTSPPDTPRTVDSGDVGAAPTRPRKAGSLTSCDSAPSLLEGRFGLGGSSRRRSSLNAFDIISFSPGFDLSGLFDQDDGGGAGAGSIPEQQKHTARFVSAAPVEVIVATLEAAAAAAGMAVREREDGSISMEGTREGEHGALAVAAEIYELTPELVVVEVRRKAGGAAEYEEFFRARLKPSLRELVCDDRPCPEDSGELSRSL

SEQ ID NO: 31648 - protein, 337 aa, Oryza sativa Japonica Group
MADEVAFETARKIIMHPLYTPRSSPWLDLKVFYVRVSNCEVDESAPDRLTLNHIPLSPDTVIEVNGQRSSMHTEFISSSLRRDRVDKMTEEATFVSTDSIRMTGSVRFQVFDKNDLLLTGDLELCSANGVVGESKNSSKRWNMKCQPASSCNGFLKGKPSTASESVHPVIEVYLAGTFCGTPIILTKTVQHISRRKSQMKLKLDSIPENEATEQQKEELNEDSLQIQRIMITDMSTYCKVLISQIFDSLYPFLPYRSFQVSESQNPKSEQDVDVDYNSLYSRQDFIEGEDGELSWFNAGVRVGVGIGLGICVGVGLGVGLLVRTYQSTSRNFRRRLP

SEQ ID NO: 31649 - protein, 161 aa, Methanococcoides burtonii DSM 6242
MRHTLAVLVENKYGVLARVAGLFSRRGFNIDSLAVGTTEDPTLSRMTIIVSGDDHVLEQVMKQLNKLIDVIRVIDLSSEEFVERELALIKVNTDASNRAEIIQIVNIFRARTIDVASKSLTIEVTGDVEKIKAIQTLLKPFGIKELARTGIVALNRGSKSQ

SEQ ID NO: 31650 - protein, 115 aa, Burkholderia sp. 383
MLCRGSCHCGDVKFEAEGDLQGVMACNCSICQRKGALMWFVPRDHMTLLTPDDHLATYMFNKHVIKHRFCKRCGIHTFGEGVHPNGTAMAAINVRCLEDVDIDALPVTHYDGRSH

SEQ ID NO: 31651 - protein, 520 aa, Oryza sativa
MASELHPTRADGRRAPPQARRRPASSSPGARTASELHTRAPTLASSSPARGRQASSSPARGRRRARGTASGLLPRAWTAGELFTRQEDGRRAPPPRTDARELLTRQADGRRAPPPRSDGRRAPPPAHGWPASSRDGRRAPPPSVDSRRAPPPCVVAVVSPRFTVGSQDVRRRTVVVARKKASPELLADGGFNGTSSVDKITDKKDLSHTIRGESVLGKSKYPLEARKDAIASAAAADRQKKSGAKQEKAKLSKVEGFKKTTKMLQVQLDILDKKLGNEIDKTRRDITKQFEDKGNKLEIKMKALEGKTDKLDKSLAELRDMGFVSKKEFDEIVEQLKKKKGLDGTVGDISLDDIRLFAKEIVEMEIERHAADGLGMVDYALASGGGKVVKHSEAFRKAKSFMPSRNSLLEQAKKMLEPSFGQPGECFALQGSSGYVEIKLRTGIIPEAVSLEHVDKSVAYDRSSAPKDFQVSGWYEGPEDDSDKESRVVTNLGEFSYDLEKNNAQTFQLERTADSRVINM

SEQ ID NO: 31652 - protein, 276 aa, Pyrus x bretschneideri
CENWGFFELVNHGISTELLDTVEKMTKDHYKKTMEQRFKEMVAAKGLDAVQSEIHDLDWESTFFLRHLPSSNISEVPDLEEDYRKTMKEFAVELEKLAEKLLDLLCENLGLEKGYLKKVFYGSKGPNFGTKVSNYPPCPKPDLIKGLRAHSDAGGIILLFQDDKVSGLQLLKDGEWVDVPPMHHSIVINLGDQIEVITNGKYKSVMHRVIAQSDGTRMSIASFYNPGDDAFISPAPAVLEKKTEDAPTYPKFVFDDYMKLYSGLKFQAKEPKFEAM

SEQ ID NO: 31653 - protein, 460 aa, Bordetella petrii
MSHVAARLERIPFCRPHFKLLLMGGLGFAFEALDAGIIAFILPVLRTQWSLSSLEVGFLASSTYIGFLIGALLAGLLGDRFGRRGVMMWALAIFCVMSIANAMTHDWHLFFLFRMLAGIGMGAEGAIIAPFLAEFVASRYRGRFTGSLAGFFSFGFVIAALLGYFIVPLSDNGWRWVLVISAVPVVVLLWWRHALDESPRWLESQGRHDEADAVVSRFEARAQRALGRALPAVAPQAETQVPVARAKESFSAQLKTLWSPAWRGVTAMTWTFWLSITFCSYAFFTWIPGLLVQQGMTITKSFGYSIAIYLAQIPGYYSAAYFNDKIGRKYTIVMYMAFACASAMALVFVKDPTHVLIASVLLSFGMNGVNAGQYAYTPELYPTSMRATGMGAASSFARLGAIASPTLVGAIYPILGFGGVFGMTTVVLLTGAVVVLFFGVNTNNRTLEDISRTRQEQAHS

SEQ ID NO: 31654 - protein, 495 aa, Halobacillus halophilus
MGKSTGFMEYERQSIPERDPATRTKDWEDYTLPMSDEEAQKQGARCMDCGVPTCHSGMEVKGMTTGCPVYHLIPEWNDLVYRGQWKEALKKEHEMNNFPEFTGFACPAPCEGACVLGINEPPVAIRSVERSIIEKGFAEGWVVPEPPEKRTGRSVAVVGSGPAGLAAAAQLNKAGHWVTVFERSDRVGGLLTYGIPEMKLPYEIVERRVNILKEEGIRFQTNTEVGRDYPVSRLNEEYDSVILCGGATTPRNLEVDGRGLKGIHYAMDFLYANTKSLLDSNHEDKNYISAKDKNVIVIGGGDTGTDCISTSVRHECKTLTQFDIYDKKGSERDNEVNPWPQYPIIHTVGYGQKEAEAKFGDDPRAYAVMTKKFVGDENNRIKEVHTIDVALSFDDEGNKVRTEIPGTEKVWPADLVLLAIGFSGPEQDLIEKLGIETTVRTNVAAQYGKYTTNVEGVFAAGDMRRGQSLIVWAINEGREVARECDRFMMGSTQLP

SEQ ID NO: 31655 - protein, 250 aa, Glycine max
MPIRNIAIGRPEEATHPDTLKAGLAEFISTLIFVFAGSGSGIAYNKLTDNGAATPAGLISASIAHAFALFVAVSVGANISGGHVNPAVTFGAFVGGNITLLRGIVYVIAQLLGSIVASLLLAFVTASPVPAFGLSAGVGVGNALVLEIVMTFGLVYTVYATAVDPKKGNLGIIAPIAIGFIVGANILLGGAFSGAAMNPAVTFGPAVVSWTWTNHWIYWAGPLIGGGIAGLIYEVVFISHTHEQLPSTDY

SEQ ID NO: 31656 - protein, 661 aa, Oryza sativa
  misc_feature (286)..(286): Xaa can be any naturally occurring amino acid
  misc_feature (298)..(300): Xaa can be any naturally occurring amino acid
  misc_feature (303)..(303): Xaa can be any naturally occurring amino acid
MRNLLLLPLLVAVAATVPLAAALSADGVALLAFKTAVTDDPSGALSSWSDADDDPCRWAGVTCANTSSSGPRVVGVAVAGKNLSGYVPSVLGSLALLRRLNLHGNRLSGTVPPALANATSLHSLFLYGNSLTGGLPPELCDLPRLQNLDLSDNSLTGSLPPELRRCKQLQRLMLSGNGFSGEIPAGVWPEMVSLQLLDLSDNSLTGAIPPELGKLAALAGTLNLSRNHLSGGVPPELGHLPATVTLDLRFNNLSGEIPQSGSLASQGPTAFLNNPGLCGFPLQVPXRAAPPSSSTPPXXXAAXSISGAGGPRQPVKTSLIVLISVADAAGVALIGVIVVYIYWKLRDRRGDGCGGDGDDDEERKRGLFPFPCMRADDSSDDGSDAGDDGGGGGEEGQLVAIDKGFKMELDELLRSSAYVLGKGGKGIVYKVVVGNGTTPVAVRRLGGGAAAAERYKEFAAEAGAIGRVRHPNVVRLRAYYWSADEKLVVTDFVNNGNLATALRGRSGQAATLSWSVRLRIAKGAARGLAHLHECSPRRFVHGEVKPSNVLLDADYNAVLADFGLARLLTIACADPSSASGGGLMGCALPPTPSSPPPPPRTTTAPARTAPRRPAPWARAPARSPTSTPSASCCWSCSPGARRSTTPRRPRRPPRPRRRRRW

SEQ ID NO: 31657 - protein, 175 aa, Nicotiana langsdorffii x Nicotiana sanderae
DFRWFALGNCIAILSSLATPEQASAIMDLIEARWDELVAEMPLKISYPALENHEWRLITGCDPKNTRWSYHNGGSWPVLLWLLTAACIKTGRPQIARRAIDLAESRLSKDVWPEYYDGKVGRYIGKQARKYQTWSIAGYLVAKMLLEDPSHLGMIALEEDKQMKPVIKRSASWTC

SEQ ID NO: 31658 - protein, 484 aa, Burkholderia sp. 383
MSFESLGLAEPLVKAVNELGYTSPTPIQQQAIPAVLGGGDLLAGAQTGTGKTAGFTLPILQRLHTFYADNRGAKRAVRALILTPTRELAAQVEESVRAYSKYLKLRSTVMFGGVSINPQIDALKRGVDIVVATPGRLLDHMQQKTIDLSNLDILVLDEADRMLDMGFIHDIKRVLAKLPPQRQNLLFSATFSDEIKALADSLLDSPALIEVARRNTTAESVAQKIHPVDRDRKRELLTHLIREHNWFQVLVFTRTKHGANRLAEQLTKDGISAMAIHGNKSQSARTRALAEFKNSTLQVLVATDIAARGIDIDQLPHVVNFDLPNVPEDYVHRIGRTGRAGATGEAVSLVCVDEKQLLRDIERLIKREIPQEVIAGFEPDPHAKPEPIQQRRGQQQPRSGGGGGGNRQPRAGGSGQPAAKRDGNAQPKASPQKAAKPRAQGQGQGGAGGSGGRPAGGGNSARPANGNAAHPNRNRSSRSGQRGH

SEQ ID NO: 31659 - protein, 444 aa, Halobacillus halophilus
MKLNFEEVHEGLNNQEAIEEANRCLYCYDAPCIKACPTSIDIPKFIKKIASGNLKGSATTIMSSNPVGATCARVCPTEELCEGACVLNHSTQPILIGDLQRFATDWAIKNEQLLFKPGEKNGMKVAVVGGGPAGLSAARELARFGYEVTIFEAEAEAGGLDTYGIVSFRLPQDISRWEVDQVRQMDVEIRTNTRVGTDITFQELSEQYDSIVLTIGMGNVPMLGIEGEELQGVHDAIEFVKSTKSGPLTKELLGKNVVVIGAGNTAIDAATCAARKGAADVKIVYRRTVKEMTAYDFEYDFAKQDNVEFNWLTQPIEIIGDETNQVTHLKCVKMALGEPDADGRRRPAPVEGSEFVIETDAVIKAIGQTRYSDLIEAFGLDHEGGVVKVDPESLQTSNSKVFAAGDVIFAKGQGEAMVVTAGQQGKEVAMAIHKQLAPAPTAAM

SEQ ID NO: 31660 - protein, 280 aa, Synechococcus sp. WH 5701
MRVAFLGPAGTYGEQATRQLAALEGIDAPELLAQSGIRSVVKALAEGRCDAAVVPVENSVEGGVTACLDGLWEHPDLRIRRGLVLPIRHALLGSGPIERVSEVLSHPQALAQCSLWLSENLSEALQLPTSSTAEAARLVAGSRFRAAVASPRAAKEHGLEVLAYPINDVPGNCTRFLMLQRQVESQTEAATLCSLAFSLRSNSPGALLEALSCFARLGLNMSRIESRPSKREMGEYIFFVDLEMPADPRLLEEAIEALRGHCQHLALFGTYPLTNLSEEP

SEQ ID NO: 31661 - protein, 286 aa, Oryza sativa Japonica Group
MQSVAAEFNTSITAFLVRADADAANPQFHIRWFTPVRESELCGHGTLAAAHYLISSGLVKCNAIDFLAKSGFLTAKKVVGLKQSSTLISPLQEACTKFLIELDFPLIPVVKCSPLEMPSIPETLNGASVSNVLKTVSDSATDLIVISLTYILSVEMQPVTLKFSCVSFIVELNSSEEVVNVRPNISELVQSAGRGVAVTGPAPVGSSYDFFSRFFCPKYGLNEDPVCGSVHCALAPYWGKKLGKQCMTASMASPRSGTLYLQWDEAAQRVQIRGEAVTVMVGNILV

SEQ ID NO: 31662 - protein, 454 aa, Phytophthora infestans
MVSIVSIKARQIFDSRGNPTVEVDLVTELGEYRAAVPSGASTGEFEALEMRDGGKDYMGKGVLNAVKNVNEIIAPALIGKDVTKQAEIDRFMVEKLDGTQNEWGWYKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSERLAKYNQLLRIEEELGNKARYAGEDFRDVEKLGKYSTF

SEQ ID NO: 31663 - protein, 229 aa, Magnetospirillum magnetotacticum MS-1
MASEGAHWAYEGHGGPKEWGMLSPEYAACSMGREQSPVDLSKPIAAIIGDPLTAWRPIPLRVQNNGHTIQVDCAGGGSLMLDGKSYDLLQFHFHHPSEHTVDGAFFDMECHFVHKAADGGLAVLGVMIAKGAANPALEAIWQVMPAKGGETATGTSMLDASMLLPKDPVTFRYAGSLTTPPCSEVVQWVVYRQAVTASAEQLAAFAKLFPNNARPVQPLNRRKLLLDVM

SEQ ID NO: 31664 - protein, 511 aa, Oryza sativa Indica Group
MALLLRHSPKRLPVAAVSSSNLHPEYAKKIGGSDFSHDRQSGKELQNFKVSPQEASRASNFMRASKYGMPITANGIHSLFSCIVYCPDLPPHQEIGMPSLSPTMTEGNIARWVKKEGDKVSPGEVLCEVETDKATVEMECMEEGYLAKIIHGDGAKEIKVGEIIAVTVEEEEDIGKFKDYKAPSSAESAAPAESKPQSEPTEPKKEKEQPKATKTEESFLSEDRTFSSPIARKLAEDNNVPLSSIKGTGPDGRILKADIEDYLASVAKGAKKETAAAPGLGYVDLPNTQIRKVTANRLLHSKQTIPHYYLTVDTRVDKLIKLRSELNPLQDTSGGKKISINDLVIKAAALALRNVPECNSSWMNDFIRQYHNVNINVAVQTEDGLFVPVIRDADKKGLATIADEVKQLAQRARDNRLKPEDYEGGTFTVSNLGGPFGIKQFCAIVNPPQSAILAIGSAEKRVIPGAEGQFEVGSFMSATLSCDHRVIDGAIGAEWMKAFKGYIENPTTMLL

SEQ ID NO: 31665 - protein, 391 aa, Oryza sativa Japonica Group
MCSCARFPHPALQPAPAPAPPPPNLKPKPAPTTRGPCPSPRTLVARAAPRRDDSTAPPPPPPSTFDFLALKRELEEEEEEEVVAVEPRDGGGGDGLASEDDGDGEAKRSGGGGESSGGRKRRQMARRSGLLAKQVISVSSARSLGFVSQLWVDAASTNPVVGVVFMDGAKQPSGWSVMQALTEVERRTHARKMKCGSVKMWIVALVEVRPSLLSGEAEKFLFEDIYQVGDVVLVEDETVVENEFKLVGLHSLVGYSVVTSRRRNVGKVRGFTFDINTGAMESLELDSFGISIVPSSLVSTYCLFVEDVLDIVSDTIVVHEDAISRVQRLTQGIWGTQNIQGPGGQMDDNGRYRRRKARRVQRQNGLRNSSGRKLHRKMRDRDGDWELPMDY

SEQ ID NO: 31666 - protein, 471 aa, Frankia sp. EAN1pec
MPRRAKIVCTLGPATNSPEMVRALVDAGMDIARLNFSHGTHEQHAAAYALVREAAAAAGRSVGILADLQGPKIRLGRFADGGVTLLPGQHFTVTIRDVLGDQEQVGTTYPGLTRDVAAGDTILVDDGRLNLRIDGVEDTDVRTTVVIGGKVSDNKGMNIPSAALTVPALSEKDADDLRFALELGVDMIALSFVRSAEDYAAVRSIMDEVGIRVPVLAKIEKPQAVDELDGIIEAFDGLMIARGDLGVELPLEDVPLVQKRAVSQARERAKPVIVATQVLESMVSAPRPTRAEASDCANAVLDGADAIMLSAETSVGSYPVESAATMARIIETAEADLGRIPPLRTPPRTLGGAIAQAAVSVGEAVGARYLVAHTLSGDTARRLIRYRSSVPVIAFTPIPSVRSQMALLWGVETVLVPFAESTDEMVRQVDTALQQVGHCRPGELVVVVAGTPPGVAGMTNAMRVHRIGEAV

SEQ ID NO: 31667 - protein, 272 aa, Zea mays
  misc_feature (171)..(171): Xaa can be any naturally occurring amino acid
MAPLGDGGAAAAAASNNLVVSFGEMLIDFVPDVAGLSLAESGGFVKAPGGAPANVACAIAKLGGSSAFVGKFGDDEFGHMLVNILKQNNVNAEGCLFDKHARTALAFVTLKHDGEREFMFYRNPSADMLLTEAELDLGLVRRARVFHYGSISLISEPCRSAHMAAMRAAKXAGVLCSYDPNVRLPLWPSPDAAREGILSIWKEADFIKVSDDEVAFLTRGDANDEKNVLSLWFDGLKLLVVTDGDKGCRYFTKDFQGSVSGFKVDTVDTTGA

SEQ ID NO: 31668 - protein, 301 aa, Triticum aestivum
STHASVDPRVRKDAKVIHELKAYLKSANADIHVIPKIESADSIPNLQSIIAASDGAMVARGDLGAELPIEEVPLLQEEIIRTCRSMQKPVIVATNMLESMIDHPTPTRAEVSDIAIAVREAADAIMLSGETAHGKYPLKAVKVMHTVALRTESSLYDPTKAPSLVARPKALLNDDFCKSQLSKMFGSHATMMANTLRTPIIVFTRVGSMAVLLSHYRPSSTIYAFTNEVRVKQRLALYQGVVPILMEFSDDAEETFSRAITSLLDAKYMNEGDYVTLVQSGSQSIWREESTHHIQVRKVQC

SEQ ID NO: 31669 - protein, 498 aa, Fulvimarina pelagi HTCC2506
METIGHFIDGERVAGSSGQTADVFNPATGQVTKKLALAGADDLQRAVDAAKAAQPGWAATNPQRRARVFMKYVQLLNDNMQELAELLSSEHGKTVEDSKGDIQRGLEVAEFVIGIPHLQKSEYTEGAGPGIDMYSIRQPVGIGAGITPFNFPAMIPMWMFAPAIACGNAFILKPSERDPSVPMRLAELMMEAGLPKGILQVLNGDKGAVDGILQHQDIGAVSFVGSTPIAAYVYAEAAKYGKRAQTFGGAKNHMIVMPDADLDQAADALIGAGYGSAGERCMAISVAVPVSEETANALVEKLTPRIEALKIGPYTDSEADFGPVVTKASKEKILGLVEKGVSEGAKLVVDGRGFNMQGYEDGYFVGACLFDNVTKDMDIYKEEIFGPVLSVVRAKDYDEALALPTDHEYGNGVAIYTRDGDAARDFASKVPVGMIGVNVPIPTPMAYHSFGGWKRSVFGDLNQHGPDSIKFWTRTKTITSRWPSGIKDGAEFSMPVMR

SEQ ID NO: 31670 - protein, 223 aa, Oryza sativa
  misc_feature (58)..(58): Xaa can be any naturally occurring amino acid
MHSTGMEMEVEVAGDDEAVPEAPERSVVLISAGASHSVALLSKPREREIAPRRWLIIXLDGLTWRVGGGVVCSWGRGEDGQLGHGDAEDRPVPTVLTAAFDDAPGGVASVVICGADHTTAYSDEELQLYSWGWGDFGRLGHGNSSDVFNPQPIQALQGVRITQIACGDSHCLAVTVAGHVHSWGRNQNGQLGLGNTEDSLLPQKIQAFEVSKRLHLALFVGTG

SEQ ID NO: 31671 - protein, 546 aa, Burkholderia sp. 383
MTGFNWHNPYPTTRIPVFARNVVSTSHPLAAQAGLRMLWKGGNAVDAALAAAAALTVVEPVSCGLGGDAFALVWDGERLSGLNASGVGPAAWNVDYFRKRHGEAGNGIANKPTRGWDTVTVPGVIAGWEALHAKFGSLPFADLLEPAIEIAERGYAVPPIVAHKWAAAVPELKGLPGFADTFMPHGRAPQVGERVCLPGHAQTLRTLQKEGARAFYEGVLAERIAAFSREGGGALTAADLHAYRPEWVEPIGKRFGRHTIHEIPPNGQGIAALIALGIAEHAGLTEWPVDSVDSQHLQIEAMKLAFADVYRYVADPRAMEVTPEQMLDDAYLAERAKLIDPARATHFGAGRPHSGGTVYLSAADERGMMVSFIQSNYMGFGSGLVVPGTGIALQNRGHGFSMDPASPNVVAGGKRPFHTIIPAFVTEEVDGRTEAVMSFGVMGGDMQPQGHLQTVVRMLGYGQQPQAACDAPRWKVNRDFTLDVEATMNRATVDALTARGHTIKSIDDPYMDFGSGQFIWRLDRDDRERGYVAASDSRRDGLAAGF

SEQ ID NO: 31672 - protein, 507 aa, Burkholderia sp. 383
MTQPNRYDLLVVGGGINGAGIARDAAGRGLSVMLCEQDDLASHTSSSSTKLIHGGLRYLEYNEFGLVRKALQERETLLRAAPHIMWPLRFVMPHMPNLRPAWLIRIGLFLYDHLAKRELLPGSRGIDMRRHAAGAPLIDSIKRGFVYSDGWVDDARLVVLNAMDAKERGAEILTRTKLVSAERRGDEWEARLQHADGSIRVVHARAIANAAGPWVGEVLKGALGRGAHHSVRLVKGSHIITRRLFDHDHAYIFQNPDKRIIFAIPYEHDFTLIGTTDVEYTNDPAKVAIDRDETQYLCDSINRYFKRKISPADVHWTYSGVRPLLEDENAANASAVTRDYRLELDDGAGAPLLSVFGGKITTFRKLAEEAGDMLCSVLGRDAKTWTAGVALPGGDIANAKFDAFADTFAKRHAWLPAALARRYARAYGTRAERVIDGAKSLAELGTEVAPGIYDAELRYLRDAEWATRAQDVLWRRSKLGLHVAPGTLDAVTAAVDAWFAAAHAPQA

SEQ ID NO: 31673 - protein, 324 aa, Burkholderia pseudomallei K96243
MPKAIRYDQPGGPEVMKWVDIDVGAPQPGEVRIKQHAVGLNYIDVYFRTGLYPQPLPGGLGMEAAGEVTELGEGVTALKPGDRVAYVAQPPGAYAQERVLAAAKLVKLPEAIGYEDAASAMLQGLTAQYLLRRTYKVEPGDTIVIHAAAGGVGLLVCQWAKALGATVIGTVGSDEKAALAKAHGCDHPIVYTRENFTERVKEITNGAGVPVVYDSIGKDTYIGSLDCLAPLGMFVSFGNASGPLPPIDSKEFSSRGSLFFTRPTLFSYIAKREDLDRNAAELFDVLASGRVKTSIRQRYPLENVAQAHRDLEARRTTGSTVLLP

SEQ ID NO: 31674 - protein, 513 aa, Robiginitalea biformata HTCC2501
MKESHEELNRRRAEALKGGGEKRIEKQHEKKKLTARERIRYLLDAGSFEELGSLVTHRTTDFGMADQQYYGDGVVTGYGTINGRLAYVYAQDFTIFGGSLSETHAEKICKLMDLAVKAGAPVIGLNDSGGARIQEGVRSLAGYADIFYRNVQASGVVPQLSAIMGPCAGGAVYSPALTDFIVMVEQTSYMFVTGPNVVRTVTNEEVDSEELGGARTHASKSGVAHRTAPNDAACLQDLKKLLTYLPQNNRELPPSVPFELGSEWREDLGNLVPDNPNQPYDMRAVIEGIVDAESFYEIHAEYADNILTGFARLAGKTVGIVANQPLSLAGVLDRDSSRKAARFTRFCDCFNIPLLVLVDVPGFLPGTDQEWNGIIVHGAKLLYALSEATVPRITLITRKAYGGAYDVMNSKHIGADLNYAWPGAEIAVMGAKGASEIIFRKEIAKAEDPEKKLAEKEAEYAEKFANPYRAAGRGFIDEVILPGETRRKLIRGFASLENKQVDAPKRKHGNIPL

SEQ ID NO: 31675 - protein, 191 aa, Zea mays
  misc_feature (65)..(65): Xaa can be any naturally occurring amino acid
  misc_feature (79)..(79): Xaa can be any naturally occurring amino acid
MAKARRSPFAAAERFLGFPRGGPSPGAVAPAPAAFDDLPDLAEADVWYSAAAAAATNDPGSPRAXGVQAGGGGGGQARXRQGGLSRAFGDGPGRQAAASAPVEVPAWPARFAFPDADPSLLFEMEMGGDDHDKGEGDDGRQGQGAGWVPPHVYLARRQARASVVEGAGRTLKGRDMSRVRDAVWSRTGFDG

SEQ ID NO: 31676 - protein, 264 aa, Lactobacillus reuteri
MRKPFIAANWKMHKNVQESVEFVDAIKGKLPDPQEVEVGIAAQAFALPSMVHAADDSGLKIIAQNAAAEYSGAFTGEISLRGLADAGVSYVMLGHIERRHLFHEDNELVNRKVLAALQMGVTPIICTDETMVQKEVNGEIHYVFQQLMSVLRGVSLDQIKNVVVSYEPSWAVGYGQHANPVLAEEGCRQIRRTIADNYTYEIADKIRILYGGSVNPDNIGMIMNKPDVDGVLIGRASLDVDNFLRMVNYLKNLNFKNKLATGLK

SEQ ID NO: 31677 - protein, 99 aa, Porphyra yezoensis
MADYKIHLLCEEEGIDVTFNCAEDTYILDAAEEEGIELPYSCRAGACSTCAGKVTEGTVDQADQSFLDDDQLLAGYVLTCIAYPSSDCTISTHVEQELY

SEQ ID NO: 31678 - protein, 597 aa, Photobacterium profundum SS9
MERKMTSPFNFSKRTFVKGLVAGGVIMGLSPCVTSAWAREYNGTNAQTPILTGTDFELIVSESIVNFTGVQRKATTINGSIPAPTLKFKEGDVVTIKVINQLKEPTSIHWHGLLLPYQMDGVPGISFPGIPAGETFTYQFKVQQSGTYWYHSHTAMQEITGMYGSIIIEPKEKDPFEYERDHVVILSDWTDENPMSVFNKLKMQGDYYNYNQPTVFGTLDQISRSGIAATYASKKMWNEMRMSPSDLADLSSETLTYLMNGNTPNGNWTGLFRKGERIRLRFINGASNTFYDVRIPGVKLTVVQCDGLNLEPVIVDEFRFGPGETYDVIIEPTEDANTIFAQAMDRTGFACGTLATSYGLKAAVPHLDAPQKLSMVDMMGDMTGMDHSKMDMSAMEGMDHSKMDMTVMEGMDHSMTDIIQNKASQHVRHARTEYGPSVDMRVNTPRTNLDDPGVGLRSNGRRVLTLADLKTFGGMIEHRPPERELELHLTGNMERYTWSFDGVEFGQSTPIHLRYGERVRIILQNDTMMTHPMHLHGMWSELETPNGELLVRRHTIPVQPAQRISFLVTADALGAWAWHCHLLFHMDAGMFRKVVIS

SEQ ID NO: 31679 - protein, 196 aa, Escherichia coli
  misc_feature (1)..(1): Xaa can be any naturally occurring amino acid
  misc_feature (20)..(20): Xaa can be any naturally occurring amino acid
  misc_feature (136)..(136): Xaa can be any naturally occurring amino acid
  misc_feature (190)..(190): Xaa can be any naturally occurring amino acid
XQLKRVAEAKLPTPWGDFLXVGFEELATGHDHVALVYGDISGHTPVLARVHSECLTGDALFSLRCDCGFQLEAALTQIAEEGRGILLYHRQEGRNIGLLNKIRAYALQDQGYDTVEANHQLGFAADERDFTLCADXFKLLGVNEVRLLTNNPKKVEILTEAGINIVERVPLIVGRNPNNEHYLDTKAEKXGHLLNK

SEQ ID NO: 31680 - protein, 422 aa, Zea mays
MASRLVYPVCHNICPEKSYCSCTGVVRPSCDLPKKKKKKKKKKKKKPQPQHNRLAFPSPPAPVSLSLLSDSLSRSRVHLAAASKRDQMAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 31681 - protein, 204 aa, Robiginitalea biformata HTCC2501
MLTIGIAGGTGCGKTTVVNQITGQLSDSEVGVISQDSYYRDLSELSYEERCKINFDHPRAIDFELMRSHLEALRDGRPIEQPVYSFKEHNRTDETIRTEPRKVMIIEGILIFTHPEIRDLFDIKIFVHADSDERLIRRLRRDITERGRDLDEVIRRYQDTLKPMHDQFIEPTKEFADIIIPNNKYNTVAIDIVRTIIAEKIALP

SEQ ID NO: 31682 - protein, 109 aa, Synechococcus sp. WH 5701
MSDTIRATETPTRSPGGAAVIEKEVQRVRKPSPRYRVLLHNDPVNSMEYVVTTLRQVVPSLSEQDAIAVMLEAHNTGVGLVIVCDLEPAEFYSETLKAKGLSSTIEPES

SEQ ID NO: 31683 - protein, 307 aa, Streptomyces coelicolor A3(2)
MSTPTTFRPVLERIAEEIERTPGSGRPADYIPALAARDPRRFGMAVAELDGTVYGVGDWREPFSAQSLTKVFTLALDLAREGDALWEHVGREPSGNPFNSLVQLEYENGIPRNPFINAGALVVTDRLHTRTGDAAGELLAFLRAESGNPDLGHDEEVAASEAAHGDRNAALAHFMASYGNIDNPVPVLLDQYFRQCSVAASCADLALATGFLARHGIRADGTRLLSRSRAKQINAVMLTCGTYDAAGDFAHRVGLPGKSGVGGGIIAVVPGHCTLCVWGPGLDERGNSVAGVAALDRFTTLTGLSVF

SEQ ID NO: 31684 - protein, 94 aa, Synechococcus sp. CC9605
MASFNISIEGGASFACPDDTYILDAAEEAGVDLPYSCRAGACSTCAGLLVSGSVDQTDQSFLDEDQMGQGFALLCVSYPTADCVIKANAEEHLS

SEQ ID NO: 31685 - protein, 171 aa, Phytophthora infestans
MPNPQVFFDMTVGGAPAGRITFELFADKVPKTAENFRALCTGEKGVGRSGKPLHFKGSSFHRVIPNFMCQGGDFTRGNGTGGESIYGEKFPDENFLLKHKGEGILSMANAGPNTNGSQFFICTVETSWLDGKHVVFGRVVDGMDVVKNIESVGSQSGQTKKPVVVANCGEL

SEQ ID NO: 31686 - protein, 203 aa, Saccharomyces cerevisiae
MSAEDYKNLPVTVEKPIPVVYDLGNLAAFDSNVLDKNDLDSSNARREEKIKSLTRDNVQLLINQLLSLPMKTTTESVGGTGGQSSVMTLLQLPDPTTDLPREKPLPKAKAMTKWEKFAAKKGIKPKERAGKMIYDEASGEWVPKWGYKGANKKLDDQWLVEVDDKVKGTDNELIDPRTLNRAERKRLVKKNEKQQRRNMKNAL

SEQ ID NO: 31687 - protein, 259 aa, Ostreococcus tauri
MPVGTPIRCENHFLHLDDYTKEEVQELIDIASSEKKRLQSGDRSYRPFEGKTLAMIFAKQSLRTRVSFETGFSLLGGNAVYLGPDDISIGKREATKDISRVLSRYNDIIMARLFSHNDIVELAEYSSVPVVNGLTDYNHPCQILADALTIYDAGISTIEISHDPDEGVKGADVIYSDVWASMGQKHEAEQRKKDFQGYQVDAEMMAATPNAIFMHCLPAERGLECTDEVLEAPYSVVFQQAENRMHAQNAVMLKLLGCK

SEQ ID NO: 31688 - protein, 228 aa, Saccharomyces cerevisiae
MAELNDYSTMIDILLSDMDLETVTTKKVRMALKEVYAIDVESQGKAINKLIRKHLDLVKERPRFERSLEDLLKENATLAIELTKEITVSKRSSGEEKNDSETKGTHVEKKKGTVSKSPISTRKVTLSKSLASLLGEHELTRTEVVRRLWAYIKAHNLQNPNNKKEILCDEKLELILGKSTNMFEMHKILASHMTEPKKISDCPPLIQEVRRKEKPIVSDSEQSDTKGI

SEQ ID NO: 31689 - protein, 118 aa, Brassica napus
STLPLQRVKSSHPRVNSFTFYCGQTRATFETQQKKVDYVQSVPRLTRTGSVPVWSNNPCDYPKGFDGYPGPAILLLSPPPSSLPMPKFSIKPKLRCNAEAAGKTELAPDNIRRVLQLR

SEQ ID NO: 31690 - protein, 279 aa, Sinorhizobium meliloti 1021
MSRQSFSDDLDGRAELCREVIRSAGALILKGFQGEARQNISMKGPQDFLTEVDEASEAHIREALAAHFPGDGFFGEEGGGAISDRVWVVDPIDGTANFARGIPHFCISIAFVQSGSTEIAAIYNPALDELYFARRGAGATRNGVPIRVAQTIRFDAASLEMGWSMRVPNTAYLGVMEALLGMGANVRRAGSGALALAYVADGRLDGYIELHMNSWDCLAGLLLVSEAGGVVCPYLEIGSLDAGGPALAVAPGLASDTSRASNIPLAACAMPADRQIAPA

SEQ ID NO: 31691 - protein, 319 aa, Kineococcus radiotolerans SRS30216
MPQQDTTPWTPDAMGRQEGRTVLVTGANSGLGLQVATEFARRGADVLLACRNAERGRAAVAELTAAVRDSGVEPTVEVIPLDVADLASVRRAAGDVLHRRSGIDVLVNNAGVMAPPFGRTVDGFETQVGTNHLGHFAFTGLLLPALLTGGGARVVSVASVAHKFGRLNRQNYQSERSYQKWLAYGQSKLSNLLFAFELQRRAAAVGAGIVSTAAHPGLSDTNLWKNTPLAPGRVGAPLGTALSRAVGQPPAQGAWPLLRAATDPAVVGGEYFGPGGRKEWRGFPVQVQANAAAYDTADAAWLWARSVEWTGVDFRELHA

SEQ ID NO: 31692 - protein, 564 aa, Magnetococcus sp. MC-1
MRLTGAEIIVQCLLEQGVKTVFGYPGGAVLNIYDEIYKCKDLQHVLGRHEQGLLHAADGYARVTGEVGVALVTSGPGATNAVTGLATAYMDSIPMVCITGQVPVALIGNDAFQEADTVGITRSCTKHNYLVKDVKDLARVLREAFYIARTGRPGPVLVDIPKDITIAATEYSPAKGEVSIRSYKPSISGHTGQIRKAAGLMAKAKRPLFYTGGGVILSNAAEELTQLVRKLGAPITNTLMGLGGFPCTDKQFVGMLGMHGTYEANMAVSRCDLLVAIGARFDDRVTGKISQFAPEAKIIHLDVDPTSISKNVEVDVPIVGDIKTVLGKMLAMMEDGKYQSELPDLGDWWAEIEQWRRKECLKFTQGDEVIEAQYVIQKLYELTKGNAIVATDVGQHQMWAAQFYGFEKPRRWLTSGGLGTMGYGLPAAIGAQMAFPHETVVLITGESSIQMNIQELATLKQYNLPVKIAILNNSFLGMVRQWQELFYERRYSESDMTVHPDFVQLAQAYGATGMMTARPAEVSGIIEKALAIDGPVLMDFRVNREANVYPMVPAGAALNEMILL

SEQ ID NO: 31693 - protein, 167 aa, Magnetococcus sp. MC-1
MKHVLSVLVENEAGVLTRVSGLFSARGFNIESLTVAPVGDGETSRITLVTTGEDNIIEQIIKQLHKLVPVIQVHDLTDRSHVERELMMVKVDAEREVRAEVLRIADIFRSRVVDATPNTFVVEVTGSSDKLDACLNLLTPLGVVEVVRTGKVAMARGPKRMKEVLPA

SEQ ID NO: 31694 - protein, 304 aa, Thiomicrospira crunogena XCL-2
MRVQKTMNLNKAQAQNIASVLAEALPYIQRFSGKTIVVKYGGNAMTEEALKNGFARDIVLMKLVGMNPVVVHGGGPQIGHLLERVGKQSEFIQGMRVTDSETMDIVEMVLGGMVNKEIVNLIHQHNGNAVGLTGKDGNLIRAKKMEMTAFNEDLNAPELIDLGHVGEVERINTKVLDMLIQDDFIPVIAPVGVDEQGHSYNINADLVAGKVAEALHAEKLMLLTNTPGLLDKQGELLTGLNAESVAALIEDGTIYGGMLPKIQCALDAVQNGVESSHIIDGRVEHAVMLEVFTDEGVGTLITSH

SEQ ID NO: 31695 - protein, 331 aa, Synechocystis sp. PCC 6803
MGFFVVRCRQISLLGGPLPMKIASNITELIGRTPLVRLNRIPLLEGCGAKIVVKLEGMNPAASVKDRIGINMINRAEQEGLIEPGKTLLIEPTSGNTGIALAMVAAAKGYQLILTMPETMSQERRAMLKAYGAKLELTPGSEGMGGCIRRAQELAESLPNAYMLQQFDNPANPQIHQQTTALEIWQDTDGAIDFLVAGVGTGGTITGVASVLKEKKPSFQAIAVEPQNSPVLSGGKPGPHKIQGIGAGFIPEVLDVNLIDEVIAVTDEEAIAYGRRLAREEGILSGISTGAALAAAIKVAKRPANKDKLIVMIQPSFGERYLSTPLFQDLE

SEQ ID NO: 31696 - protein, 509 aa, Synechocystis sp. PCC 6803
MVTLLENPFRTGLRQERTPEPLILTIFGASGDLTQRKLVPAIYQMKRERRLPPELTVVGFARRDWSHDHFREQMRKGIEEFSTGIGSEDLWNEFAQGLFYCSGNMDDPESYLKLKNFLGELDEKRNTRGNRVFYLAVSPNFFPPGIKQLGAAGMLSDPVKSRIVIEKPFGRDLSSAQSLNRVVQSVCKENQVYRIDHYLGKETVQNLMVFRFANAIFEPLWNRQFVDHVQITVAETVGVEERAGYYESAGALRDMVQNHLMQLFCLTAMDPPNAIDADSIRNEKVKVLQATRLADINNLENAGIRGQYKAGWMGGKPVPGYREEPGVDPSSTTPTFAALKLMVDNWRWQGVPFYLRTGKRMPKKVSEIAIQFRQVPLLIFQSVAHQANPNVLSLRIQPNEGISLRFEAKMPGSELRTRTVDMDFSYGSSFGVAAADAYHRLLLDCMLGDQTLFTRADEVEEAWRVVTPVLSAWDAPSDPLSMPLYEAGTWEPAEAEWLINKDGRRWRRL

SEQ ID NO: 31697 - protein, 404 aa, Frankia sp. EAN1pec
MHDTARIFLELGAVLFALGVLGHFALRVGISPIPLYLIGGLAFGHGGVLPLGASEDFIEIGAEIGVILLLLTLGLEYTAEELLHGLRRQAPAGVLDLTLNAVPGVAAAFLLGWGPLAAVVMGGVTAISSSGIIAKVLGDLGRIGNRETPVVLSVLVLEDLAMAVYLPVVTALLAHHTFARGSLTVAVALGALVAVLYVALRHSDKVTLLVFSPNVDRNDEVLLLRSLGLTLLVAGVAQRMQVSAAVGAFLVGIALSGPVAEGAHEVLMPLRDLFAAVFFVFFGLQTDPVEIPPVLLAASLLALAGVATKIVTGWWAARRAGIATMGRYRAGAALVARGEFSIVIAGLAVAAGVNPQLGPLAACYVLLMAVLGPLAARFVEPVVRTIRRWSRARRPPDPATARGA

SEQ ID NO: 31698 - protein, 485 aa, Bacillus subtilis subsp. subtilis str. 168
MSFETLNKSFINGKWTGGESGRTEDILNPYDQSVITTASLATGKQLEDAFDIAQKAQKEWAKSTTEDRKAVLQKARGYLHENRDDIIMMIARETGGTIIKSTIELEQTIAILDEAMTYTGELGGVKEVPSDIEGKTNKIYRLPLGVISSISPFNFPMNLSMRSIAPAIALGNSVVHKPDIQTAISGGTIIAKAFEHAGLPAGVLNVMLTDVKEIGDGMLTNPIPRLISFTGSTAVGRHIGEIAGRAFKRMALELGGNNPFAVLSDADVDRAVDAAIFGKFIHQGQICMIINRIIVHQDVYDEFVEKFTARVKQLPYGDQTDPKTVVGPLINERQIEKALEIIEQAKTDGIELAVEGKRVGNVLTPYVFVGADNNSKIAQTELFAPIATIIKAGSDQEAIDMANDTEYGLSSAVFTSDLEKGEKFALQIDSGMTHVNDQSVNDSPNIAFGGNKASGVGRFGNPWVVEEFTVTKWISIQKQYRKYPF

SEQ ID NO: 31699 - protein, 132 aa, Zea mays
FGSSNELGAMVDRMESAKLKTVNLTDNDLAKDHLRYFIGGRSEIKDELVYRFIFPERPGALMKFLDAFSPRWNISLFHYRAQGETGANVLVGIQVPPVDFDEFKSHADNLGYEYMSENNNEIYRLLLRDPEV

SEQ ID NO: 31700 - protein, 530 aa, Gibberella zeae PH-1
MASSSSNVVGVHYRVGKKIGEGSFGVIFEGTNLLNNQQVAIKFEPRKSDAPQLRDEYRTYKILVGCPGIPNVYYFGQEGLHNILVIDLLGPSLEDLFDHCGRRFSIKTVVMVAKQMLSRVQTIHEKNLIYRDIKPDNFLIGRPGTKASSVIHVVDFGMAKQYRDPKTKQHIPYRERKSLSGTARYMSINTHLGREQSRRDDLEALGHVFLYFLRGGLPWQGLKAATNKQKYEKIGEKKQTTIIKDLCEGFPEEFSKYLTYVRNLGFEDTPDYDYLRELFTQALKNTGEVEDGEYDWMKISKDSGKGWDSKNHSNAYLHNPNVRPGPSQMELHSGHRPGNTTSHQQAQNLTVGRLNAAQPPPPSPIKQMGKQRDRPSAPGALSAQRGSGVGGLRDMATPTGSTQAQFQNSAQNLPQQPRTSQQGPATQPTQASGQPANPQPSGFQKLMKTLCFVRVRNLSLSCSPRCYCSPERQSHHARTRSPSSRYFRTLPPPSHPIFSCMTTREGKQIWFGITAKGFPFSCLTTITKLY

SEQ ID NO: 31701 - protein, 547 aa, Kineococcus radiotolerans SRS30216
MVTPDAPETQVETTPDTRPAEVEAERAHRPVLVVDYGAQYAQLIARRVREADTYSEIVPSSTPVAEILAKDPAAVILSGGPSSVYAEGAPQVDPALFEAGVPVLGICYGFQAMAKALGGEVARTGQREYGGTAAALPNAAESTLLRDQPAEQPVWMSHGDSVSRAPEGFRVTASTDGTPVAAFEDDERRLYGVQWHPEVKHSTHGQDVLVNFLRHGAGIDPDWTTGNVIEEQVARIKAQIGDGKVICALSGGVDSAVAGALVQRAVGDQLTCVFVDHGLLRAGEAEQVEKDFVAATGVKLHVVDAVQRFADALDGVSDPEQKRKIIGREFIRVFEQAARDVVAKEGTDGGEVRFLVQGTLYPDVVESGGGTGAATIKSHHNVGGLPDDLAFELVEPLRALFKDEVRAVGVQLGLPEAMVYRQPFPGPGLAIRIVGAVTPERLEILRAADAIARAELTAAGLDRDIWQCPVVLLADVRSVGVQGDGRTYGHPVVLRPVSSEDAMTADWTRLPYDVLARISTRITNEVPEVNRVVLDVTSKPPGTIEWE

SEQ ID NO: 31702 - protein, 339 aa, Bacillus subtilis subsp. subtilis str. 168
MAILVTGGAGYIGSHTCVELLNSGYEIVVLDNLSNSSAEALNRVKEITGKDLTFYEADLLDREAVDSVFAENEIEAVIHFAGLKAVGESVAIPLKYYHNNLTGTFILCEAMEKYGVKKIVFSSSATVYGVPETSPITEDFPLGATNPYGQTKLMLEQILRDLHTADNEWSVALLRYFNPFGAHPSGRIGEDPNGIPNNLMPYVAQVAVGKLEQLSVFGNDYPTKDGTGVRDYIHVVDLAEGHVKALEKVLNSTGADAYNLGTGTGYSVLEMVKAFEKVSGKEVPYRFADRRPGDIATCFADPAKAKRELGWEAKRGLEEMCADSWRWQSSNVNGYKSAE

SEQ ID NO: 31703 - protein, 335 aa, Glycine max
  misc_feature (218)..(218): Xaa can be any naturally occurring amino acid
  misc_feature (244)..(244): Xaa can be any naturally occurring amino acid
QLRRPPPPLKFSIVFFFFRFSIFYSMGIGGSALGPHFVAEALAPDNPPLKIRFVDNTDPAGVDHQIAQLGLELASTLVIVISKSGGTPETRNGLLEVQKAFREAGLDLPKQGVAITQENSLLDNTARIEGWLARLPMFDWVGGRTSEMSAVGLLPAALQGIDIIEMLAGASLMDEANRSTADMAILPYKDSLLLFSRYLQQLVMESLGKVFDLDGNRXYIQQLREGVHNFFVTFIEVLRDRPPXHDWELEPGVTCGDYLFGMLQGTRSALYANNRESITVTVQEVTPRTVGALIGLYERAVGIYASLVNINAYHQPGLGNMACGRGMLNCIQMKT

SEQ ID NO: 31704 - protein, 363 aa, Oryza sativa Japonica Group
MDAKKPYVIVIVIQLINTGLFVISKAAFNHGMNTFVFIFYRQAAASLLLLPLAIVLERNTLSLNMYNLGLKYTSPTVASATTNSIPVVTFFFALLLRRAQSIIHLWVEVIRLKSLSGAAKMAGVVLCVGGVLAIALYAGPAISPVNHHRAFGGGGGGGHESASATTRTRWVKGTLLMLLSNATWSLWTVLMASLLREYPSKLLATAAQCALSAAQSLALAAAAAGRDPAAWRLRPDAGLLAVAYSAVAVTGASLYMQAWCIEKKGPVFLAMSNPLSFVFTIFCALFVLGEVVHLGSVVGGVLMVVGLYSVLWGKSKEHDTLTLATAMPTPASVQQQEKKVAAVPAPADSSSSDSEQERLASIA

SEQ ID NO: 31705 - protein, 646 aa, Gibberella zeae PH-1
MSTFTALNGGSPRTSDPPTVTIEKPSAIDERTHSTAASQPPPTPEVPSSQVPAQSADRPSFQSPDYPDVEGAHKRKRSDSVEIRREHVIHVHTPESAHPHHDSREAYGTPSRDYRSYGDEHRDKEGWYPHQARDERSYDSQQNSATTPHGQTEEQIGDALRRANSQMDHEGYSNASPDGDDHSIIYGGQYSSDQRRDGLMQQDPKKRKRNFSNRTKTGCLTCRKRKKKCDEQKPECGNCLRGSFVCAGYPPQRGPGWQKPENKAAAVPLESKDPTYIPPGAYGMPQQSPYGNQPVKREPLPPYRGQALRIDPPQGRPLVTDDDRPTASTIPSASVASPENKLSALPYTPANVFPTPVSANPQPPPPPFGERMAKEYQRVPPLHDLSRTEPDSNHLGNQLPQINILHPTRTNSPAPPPPAPTSNAQVAAQLALSHSQFPQRRTQKEEMLSGRHFYPFDKELCLERERCSAACWRFNTLNGISHEERARLFLEILQPRDPVRVSPTEASPITNVGRVGRNVAVEKPFACDYGYNITIGHQVAIGRNCTINDVCEVKVGDNCVIGPNVSIFTAGLPVDPKKRQGSQGPQVGKPVVIEQDCWIGGGAIILPGNTIGKGSTVGAGSIVTKDVPPFTVVAGNPARVLRGIAS

SEQ ID NO: 31706 - protein, 317 aa, Ustilago maydis 521
MGTVADPAKTKKTVSGFATDFLMGGVSAAVSKTAAAPIERVKLLIQNQDEMIKQGRLAAPYKGIGDCFVRTYQQEGLVSLWRGNTANVIRYFPTQALNFAFKDFFKSLFAVPKTAPYWKSLSANLASGGAAGASSLLFVYSLDYARTRLANDAKSAAKGGGDRQFNGLVDVYRKTIASDGIAGLYRGFVPSVVGIVVYRGLYFGMYDSLKPVLLTGNLSNNFLASFLLGWGVTTGAGLASYPLDTIRRRMMMTSGGKVHYKNMFDAGRSIIAAEGVSSLFKGAGANILRGIAGAGVLSGYDKLQELMFGKVYKGGSG

SEQ ID NO: 31707 - protein, 294 aa, marine gamma proteobacterium HTCC2143
MGTSLVYNRQQFVDLIDAVDIFLTIINSLGENSRMKASIKTPQQISKMRIAGGLAADVLEMIGPFVQPGVTTEELDNICHDFMVNTQHVIPAPLNYNGFPKSICTSVNEVVCHGIPSAKKTLKDGDIINIDITVIKDGFHGDTSKMFHVGKPQSHTDRLVKITQECLYKAIDIVRPGTTLGDIGHIIQKHAEANYYSVVQEYCGHGIGEVFHEEPQVLHYGKKGTGLVLEEGMTFTIEPMLNAGKRHVKLNKKDGWTVTTKDGRPSAQWEHTMGVTHDGVEIFTARPDEPYFKR

SEQ ID NO: 31708 - protein, 236 aa, Burkholderia sp. 383
MSLMSISSAPADAFADLPLLDSEPVPPRIAAALEAMRAGRAVVLQDDHDRENEADLIVAAERITPETMALLIRECSGIVCLCLTDDTVRALELPPMVQTNESRNGTAFTVSIEAREGVHTGVSAADRVTTIRAAIAEGAKPHDIVRPGHVFPLRAQPGGVLARRGHTEGTVDLSILAGLKPAGVLCELMNPDGTMTRGDDVERFAQQHGLPMLTIAELVEFREALAAARERCCEPA

SEQ ID NO: 31709 - protein, 268 aa, Agrobacterium tumefaciens
MADLHTGHTAEAIVEEIARKAGALALQYFRKLADLPVEKKGHLDLVTEADRQVEEFLIANLKRSFPEDGVYGEEGGEINGTSGRTWVIDPIDGTFNFVRGGQNWAISIGLYEHRRPVFGVIYAPVRDLMLTGGRDVETQLNDKPLQPIPPLDLSRASMGVGIHPSVATEDRLEVVRFISDDLRISFRCCGSATLSLIEVAMGETDGYVSLGDSTWDVMAALPILGNLGVSHTIDWDRTELPQKLRFACGSDAFLEKVRPLLQKVAVAA

SEQ ID NO: 31710 - protein, 258 aa, Oryza sativa
  misc_feature (156)..(156): Xaa can be any naturally occurring amino acid
  misc_feature (214)..(214): Xaa can be any naturally occurring amino acid
EDDDDTDEDEDDEEEEQKMQQHLAPQYKHLITIKAGKPKGTLLDALQSDPEKVRRLSLSEQQLAKLADHHGTEIVRFTQRNLLRIYPKGTRVTSSNYNPFLGWVHGAQMVAFNMQGYGRALWLMHGFYKANGGCGYVKKPDFLMQTDPEVFDPKKXSLSPKKTLKVKVYMGDGWRMDFTQTHFDQYSPPDFYARVGIAGVPADSVMKRTRAIEXFTFKLTVPEIASLRWRCRVHMSERRFGADGRAVGPPGTRGAPKG

SEQ ID NO: 31711 - protein, 198 aa, Porphyra yezoensis
MLTNSERVKVLSEALPYIQQFSSRIIVIKYGGAAMKNQKLKDQVISDLVFLSFIGLRPILVHGGGPEINFWLDRLKILPKFDDGVRVTDQPTMDIVEMVLVGRVNKDLVATINKQGGKSVGLSGKDGLLITPRPNGKANLGFVGEVQNIDTKLLKILINNNYIPVIASVAADKEGQSYNINADTVAGEIAAASLMPKN

SEQ ID NO: 31712 - protein, 174 aa, Griffithsia japonica
MSTNTATLQSGAKMPLNGFGTWKASVEETEQAVTAALRAGYRHIDCAAVYWNEAAVGTAISKAISGGVVKREDLFITSKVWNTCHATDKVVDSCRQSLKDHQVDYFDLFLVRDIGVSNYSVALLVDTLNYARIKPSVNQCEAHVYFARPQLRDVCREFGVHLPCTPSSQRPKGR

SEQ ID NO: 31713 - protein, 434 aa, Ostreococcus tauri
MQTVELTARTAIAGNFRKATTPRADAKVRVCAIDRDRARVRRARGARRLTNATACVTQANVNVVTEAKVKVAINGFGRIGRNFVRCWKTRGPDCPLQVVCVNQSGGAKPAAHLLKYDSILGTFKSDVKVIDDSTISVDGDVIKVVSDRDPLNLPWKEMGIDIVIEGTGVFLDGPGAGKHITAGAKKVVITAPAKGNDIPTYVVGVNADQFDPSANIVSNASCTTNCLAPFAKVIDDKFGIVKGTMTTTHSYTGDQRILDASHRDLRRARAAALNIVPTSTGAAKAVALVLPQLKGKLNGIALRVPTPNVSIVDLVVNVEKKGVTAEEVNAAFKEYADGPMKGVLAITDTPLVSVDFRCTDVSTTIDAALTMVIGDDMVKVVAWYDNEWGYTQRVVDLTLIVANSLINEGSVTLDPLDQLCSDDPSADECKVFDS

SEQ ID NO: 31714 - protein, 497 aa, Legionella pneumophila
MIRNSMKSHTELLSWNLLQKEADRVRLNSDSLTCVVPDSNNYESSKQINCIEYDYSRQRVNRTIIDLLIDLANEVKLQEKIDNLINGKKINISENRPALHTALRDLGNKSIMIDGLDIMSAVINTREKIKVISNQIREKKWLGHSGLPITDIVNIGIGGSDLGPRVCINALSNYISKEFNYHFISDVDPASFNDVIAKINPQTTLFIVSSKSFTTKETLLNARKAFALYEDTASIDQHFIAVTAHPERAYQMGIKTVLPIWDWVGGRFSFCSAVNLITAIAIGYEQFVELLAGAHDIDTHVQFTDFKNNIPVLMALIGIWNNNFLNIHYDLIGYNFKEYFVPYVQQLDMESNGKSIDVNGRMVDYATGPIVWGGLGNQAQHSYFQLLCQGTHRCVGDFITLKTNDEHEINSMCHYKMKVLSEGIQTIENPYGYIPGNMPMNHLILSDCSPYTLGALVALYEHKIFEQSVIWNINPFDQPGIESAKSAHREITLSSES

SEQ ID NO: 31715 - protein, 489 aa, Phytophthora infestans
MSSPASLESSLPPAALEVLPDIMAAIGQTPMVCINSIGKKAHLQCELLAKCEFFNAGGSVKDRIGKRMVEDAEAAGRIKPGDTLIEPTSGNTGIGLALASAIKGYRCIITLPEKMSLEKVNVLKALGAEIIRTPTEAAWDSPESHIGIARRLQAELPNAHILDQYANPSNPLAHYDGTAEEILEQCDGKVDMVVMGVGTGGTISGIAKKLKEKCPSVIVVGVDPEGSILALPDSLNDKNRLQSYKVEGIGYDFIPDVLDRSLVDQWEKTNDQESFIMSRRLIREEGLLCGGSSGSAMAAAVRAASVLKPGQRCVVVLPDSTRNYMSKFLNDAWMYENKYVENTVHTRENYSKYRKETATWWSQQRVSVLELPHPSTVSPQLSCAAAIETMERHGYDQLPVVKEDGTVQGVVTIGNLLSRLSSGRVMRTDPVATVTFGNFSRVTHESSLAELAAIFDKDYFAVVTSTDGKIAGLATRIDLLNYITSAREE

SEQ ID NO: 31716 - protein, 622 aa, Populus tomentosa
MEAGKKNSLFCCVASLICLWTTAYGELTAAGVNYEVEALMGFKNSLHDPHNILNWDEHAVDPCSWAMVTCSPDNFVTSLGAPSQRLSGTLSPYIGNLTNLQSLLLQDNNISGHIPSELGRLPKLKTIDLSSNNFSGQIPSALSNLNNLQYLRLNNNSLDGAIPASLVNMTQLTFLDLSYNDLSTPVPPVHAKTFNIVGNPQICGTEQGCAGTTPVPQSVALNNSQNSQPSGNNKSHKIALAFGSSLGCICLLVLGFGFILWWRQRHNQQIFFDVNEQHNEELSLGNLRSFQFKELQVATNNFSSKNLIGKGGFGNVYKGYLQDGTVVAVKRLKDGNAIGGVIQFQTEVEMISLAVHRNLLRLHGFCMTTTERLLVYPYMSNGSVATRLKAKPALDWGTRKRIALGAARGLLYLHEQCDPKIIHRDVKAANILLDDYCEAVVGDFGLAKLLDHRDSHVTTAVRGTVGHIAPEYLSTGQSSEKTDVFGFGILLLELISGLRALEFGKSTNQKGALLDWVKKIHLEKKLELLVDKDLKNNYDRIELEEIVQVALLCTQYLPSHRPKMSEVVRMLEGDGLAEKWEASQRAEESRSRANEFSSSERYSDLTDDSSLLVQAMELSGPR

SEQ ID NO: 31717 - protein, 378 aa, Porphyra yezoensis
MLNFKTENTKYSLEEYTRYSKHLVLPQIQLEGQERLKEAKVLFIGAGGLGSPGIIYLAAAGIGSIGIIDDDIIDLSNLQRQILYRCNDIGYSKVEIAKKKILDLNPQCIVTVFKTRLSYENSIDIIRQYDIIIDGSDNFDTRYLLNDTCLELNKIHIYGAIFQFEGQVSVFNYQGGPVYRDFYSETENKESARDTCSNSGVLGLLPGIVGTLQATEAVKIVLGYKSILSGTILTYNSLTSSFNKFKIINTKFVLSTKKHWNKYYGSKSSTFVREISVIQLQKFLISRNPQYILIDVRNHEEYHKSHLIHSLNLPLQKIKGMNYSHINLQDKICFVYCSLDSRSIFASKFLIAQKLNIVRVRGGLNAWKNIIGDLDWTL

SEQ ID NO: 31718 - protein, 153 aa, Griffithsia japonica
  misc_feature (133)..(133): Xaa can be any naturally occurring amino acid
MVKHIDVEQDFDAAINASPVVVFDFYADWCGPCRFIAPEIQKLDEHLNADTADTKGKVAFYKVNVDQNQALAVKMDVSAMPTFIIYYNGSVVSTIVGANFPKLKHAVTDYLDKLSAEPAEGTNADAAKDDADXEEAPPISVVRRAPWRRASPL

SEQ ID NO: 31719 - protein, 208 aa, Phytophthora infestans
MVLTIRKPAPEFTADAVVNGEFIKISLSDYKGQYVVLFFYPMDFTFVCPTEICAFSDRADEFKKLNTQVIGCSIDSKFTHLAWINTPRKKGGLGDMNIPLVADVKKDLCSKYEVLVSEGDDEGVAFRGLFIIDKEGVLRQITINDLPIGRNVDEVLRLIEAFQFHEEHGDVCPANWKKGAKGMTANPKDSLKYFETVEEPSKKRKLTK

SEQ ID NO: 31720 - protein, 1228 aa, Ostreococcus tauri
MGRSTHRSRPARRATRARRAARATTAEDVAIDMSVQEYIEKHDLTRKVEEALNAAVKAKADEPLAFVVRAPIARRDRWRRDGDATFFDATQSEYMKKRTAPAITKVVGRQIFDSRGNPTVEADVYTHKGMFRAMVPSGASTGIYEAVELRDGGNTYMGKGVQQAVKNLNEIIAPALVGKDPREQKALDDFMCKELDGTENKGKLGANAILAVSMAIAKAGAAEKDVPLYKHLADLAGNGKLVLPVPAFNVINGGSHAGNKLAMQEFMILPVGAKTFKEAMQMGSEVYHNLKSVIKKKYGQDACNVGDEGGFAPNIQDNKEGLDLLVEAIEKAGYTGKMKIGMDVAASEFLTEDKQYDLDFKTENNDGSMKKTGAQMIDLYQEFINEYPMISIEDPFDQDDAENTAALTAKGNCQIVGDDLLVTNPKRVQAAIDGKWCNALLLKVNQIGTISESIEAVGMSKRAGWGVMASHRSGETEDCFIADLAVGLSTGQIKTGAPCRSERLAKYNQLLRIEEELGDAAVAPLASKSPRSHRSPTRLPRPRAHFTPRAMARRRLDARPSSARPLERARCGLYNASNTCYLNAVIQARPPRSARRRRDRARSHRARSDARAQALRHSRDFIDYLLSDEAAALFSARNATLGADGGGTRRSYAAEDEILRFHDGVGRKRRKTGDVGDGSEASGTSGTSGRRRFAIRPPAMTRGSRADMESAEGLDVGAEIRKVMRTMIEGECEAFPPQELLRSVWRLVPSFAGNEQQDAHEFMRFLLDRLRKELSLGKYAVRTRGIVTPRQKEHSPGNGGIPHPPTRARSARKRSGRLSPSPGFLKNDGDDDLNGMKTNSNSDHSSYVGMANDDDKEERNGAESGENDGYIIISRWGAKKHKRGCICRPCKAKRKLEENGGGSDTNDGEETSTMMVVNTTLSSPIASTLVTPSRLSRGVTASEVREKLEESQKDVVPKASPRSPTLNTDKEDDKIMELFGGLAVTRVTCMTCERFTERREPFMDLSLPIPSVLGKNGSAPTTPVSPSSDFVDGEGPNGEVTLQQCLAAFVRNETLSGHGRYFCEGCGKVQSATKSTRIAKLPPILCLHLKRFTWKGHTTRTKLTNDVDFPLDDLDLAPYCESDGEGDKKQEKKTAASSGKSRTPLRGANASTQHTHSDKLYDLIAVVTHHGSSASSGHYTACARELTDDGSNGWQHFNDDEVNLLTPEEVRSGQGYIFLYARRPTETS

SEQ ID NO: 31721 - protein, 411 aa, Saccharomyces cerevisiae
MSSAATKATFCIQNGPSFEGISFGANKSVAGETVFTTSLVGYPESMTDPSYRGQILVFTQPLIGNYGVPSGEARDEYNLLKYFESPHIHVVGIVVAEYAYQYSHWTAVESLAQWCQREGVAAITGVDTRELVQYLREQGSSLGRITLADHDPVPYVNPMKTNLVAQVTTKKPFHVSALPGKAKANVALIDCGVKENIIRCLVKRGANVTVFPYDYRIQDVASEFDGIFLSNGPGNPELCQATISNVRELLNNPVYDCIPIFGICLGHQLLALASGASTHKLKYGNRAHNIPAMDLTTGQCHITSQNHGYAVDPETLPKDQWKPYFVNLNDKSNEGMIHLQRPIFSTQFHPEAKGGPLDTAILFDKFFDNIEKYQLQSQAKSSISLKVTYSTDKSRLQSINVTKLAKERVLF

SEQ ID NO: 31722 - protein, 557 aa, Acinetobacter lwoffii
MNYKQPLIVKSQQQALSALRNLKMQTQDTHLNQFFSDDSGRFERFSVEQEQLVLDFSKHRIDQNVLNGLVDLAHAQDLTQWIQRLFSLEEINYTEQRAAMHWALRVPEQNQQVLPEITAQVHTQLERMYSLVEKIHAGQYRGATGEVIQDVVNIGVGGSDLGPLMVTHALSDFKVVTAKPLDVHFVSTMDGSQLSDLLHQLRPETTLFIISSKSFGTIDTLSNAQTVRQWLEKALGKNSHVLKHHFIGVSTKPDKMSEWGIAPENQLLLWDWVGGRYSLWSCIGLPIALTVGVDGFKQLLSGAYAIDQHFQTAPFAQNIPVLIGLLGVWNNNFLDIQTHAVLPYDGRLKYFAAYLQQLEMESNGKSTQRSGEKVDSATCPIVWGEVGPNAQHAFYQLLHQGTHKVSCDFIAPVKRYNANHFTYAENAEALIEQHHLALSNCLAQSRLLAFGNQALTADEIEDLPTYKQYEGNQPSSTILLKELNPYSLGMLIATYEHKVFVQSVLWNINPFDQWGVEKGKEIANQLLPILNREQDDLSTFDASTQGLLKILLGKNNG

SEQ ID NO: 31723 - protein, 396 aa, Thiomicrospira crunogena XCL-2
MTDFIPSIADHAKTIQPFRVMKILGEAKALERQGKDIIHMEIGEPDFESLECVHDAVKTALDQGKTHYTPTLGLPELRHKLSEFYADFYRANVKSDNIMLTPGASSALQLALTALLNPGDKVLMSDPTYPCNRQFVQLLHGELVLLPVDADSDYQLTLAHLKRHWQDGIKVVMVASPSNPSGTVIEQDELIKMAEFAATKNAYFLVDEIYQGLVYDRPAESILSHDHPPDNVIVINSFSKFFNMTGWRLGWMVAPSHLMSVLERLGQNLFLSAPTPSQYGALRVLEKEALMQLEGRRKIFERRRNTLFHAMQDAGIPPKVLPQGAFYLYWDVSDYTDDAEQFCSRLLAETGVAITPGTDFGTHKAHQHVRLAYTTSEDQLKQAVLKIRAFIDTLSL

SEQ ID NO: 31724 - protein, 286 aa, Synechococcus sp. CC9605
MPGCFGIVGCGYVGSAVAAHLRHQGHEVVGTTTSPGRLAELCDLVDHPRLYSAEDPVADTSFLDRLDGVLIAMAPTTATFEEDQYEKVYGQAVPALVDAIRQRQGCKPLHVAYLSSAGVYGDQSGAICNELTPPDCSNGANALLVSAESCVLALNDASTQACVLRLGGIYGPGKDIPSYIRSAAGQSVRKNGNHINAWVHLHDIIRGVDFAFGRRLQGIYNLVDDLQFTRRQLSNALCDDFGLPPVIWDNHDRPGARVFNARISNARLREIGFQPSVSSMLEPVAA

SEQ ID NO: 31725 - protein, 223 aa, Brassica napus
MAQQQQSLIYSFVARGTVILVEFTDFKGNFTSIAAQCLQKLPSSNNKFTYNCDGHTFNYLVENGFTYCVVAVDSAGRQIPMAFLERVKEDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIVIALILIIVLSVCGGFNCGK

SEQ ID NO: 31726 - protein, 440 aa, Thiomicrospira crunogena XCL-2
MEHSKMKSTHYQSNSLTLTGAVAMGTGVMIGAGIFALTGQVAELAKSWFPLAFLVAAIVAGFSAYSYVKMANAYPSAGGIAMFLKKAYGKTVMTGAGALLMYFSMVINESLVARTFGTYTMELFDTSQYAEWLIPALGVGLLLVAFFINILSNRFIERFSFFMAFIKIGGLVVFALAGLWVSGLSFESISVSPPEASSGGDFLGAVALAVLAYKGFTTITNSGGEINHPHKNVGRAIIISITLCLVLYMLVTFAIGANLSIDEIVQAKDYALAEAAKPAFGNGGLWFTVVFAIVATVSGVIASVFAVSRMLAMLTEMNLVPHRHFGMPGDLQKHTLVYTIVIAMLLTVFFDLSRIAALGAIFYILMDIAIHWGVLRFLREDVKANAAILITAIVLDIIILVALIAVKVQTDPLVIYVALIGLGVIFIGERLFLKQQRTAD

SEQ ID NO: 31727 - protein, 305 aa, Streptococcus pneumoniae TIGR4
MSIYNNITELIGQTPIVKLNNIVPEGAADVYIKLEAFNPGSSVKDRIALSMIEKAEQDGILKPGSTIVEATSGNTGIGLSWVGAAKGYKVVIVMPETMSVERRKIIQAYGAELVLTPGSEGMKGAIAKAQEIAAERDGFLPLQFDNPANPEVHERTTGAEILAAFGKDGLDAFVAGVGTGGTISGVSHALKSENSNIQVFAVEADESAILSGEKPGPHKIQGISAGFIPDTLDTKAYDGIVRVTSDDALALGREIGGKEGFLVGISSAAAIYGAIEVAKKLGTGKKVLALAPDNGERYLSTALYE

SEQ ID NO: 31728 - protein, 250 aa, Oryza sativa Japonica Group
MAWKDSYLDLVLIPAGIVFPIVYHVWLWHVVRRRPLSSTVGINTATRRLWVLGMMKDNEKKAVLVVQSMRNVIMGSTLMATTAILFCTGVAAILSSTYTVKKPLSDAVFGAHGEYMMALKYVTLLLAFLLSFLSHTTAICTLNQATFLLNTLSSSSSFAADIAGLPVTKDYVADVLERGFLLNLVGNRLFYAGVPLLLWIFGPVLACLCSVVMIPILHSIDVVYVDGSSKGEANARVEMVYESDESVMQV

SEQ ID NO: 31729 - protein, 208 aa, Gossypium klotzschianum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVI

SEQ ID NO: 31730 - protein, 215 aa, Gossypium klotzschianum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGG

SEQ ID NO: 31731 - protein, 209 aa, Gossypium davidsonii
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIV

SEQ ID NO: 31732 - protein, 1067 aa, Oryza sativa
MSTRLELLVVFVFIVAPALAATKPSYIVYLGGRHSHGDDGGVISPEEAHRTAAESHYDLLGSVLGDREKARDAIFYLYTKNINGFAARLEAEEAAAVAERPGVVSVFPDRGRRMHTTRSWQFLGLERPDGSVPPWSPWEAARYGQNIIIGNLDSGVWPESLSFNDRELGPIPNYWKGACRNEHDKTFKCNSKLIGARYFNNGYAKVIGVPLNDTHKTPRNANGHGTHTLATAGGDACYDSDILAAFEAAIADGVHVISASVGADPNDYLEDAIAIGALHAVKAGITVVCSASNFGPDPGTVTNVAPWILTVAASTMDRAFPAHLVFNRNRVEGQSLSPTWLRGKTFYTMISAANAAVPGYPPADALLCELGALDGKKVMGKIVVCMRGGNPRVEKGEEVSRAGGAAMILVNDEASGNDVIADAHVLPAVHINHADGHALLAYINSTKGAKAFITRAKTVVGVKPAPVMAAFSSQGPNTVNPEILKPDVTAPGVSVIAAWSGAAGPTGLPYDQRRVAFNAQSGTSMSCPQVSGVAGLIKTLHPDWSPAAIKSAIMTTATELGNDMRPIMNSSMSPATPFSCGAGHVFPHRAMDPGLVYDLTVDDHLSFLCTIGYNATALALFNGAPFRCPDDPLDPLDFNYPSITAFDLAPAGPPATARRRVRNVGPPATYTAAVVREPEGVQVTVTPTTLTFESTGEVRTFWVKFAVRDPAPAANYAFGAIVWSDGNHQLDQEYSNSYQISYVYESSMSLTDKMRKLKELLHKSENRICADCSSPDPKWASANIGVFICLKCSGIHRSLGTHISKVLSVTLDEWTDDEINSMLEVGGNSYANAIYEAFLPGGYHKPHPDSSQEERADFIRSKYELQEFLKPSLRIVSNKSSLQAMDSRKDIGNASNSYSFKSEAGMVEFIGIIKVKVIRGTKLAVRDILSSDPYVVLTLGQQKAKTKVIKSNLNPVWNEVLTLSVPQKYGPLKLQVYDHDVLSRDDIMGEAEVDLQPMITAAMAFGDPGLLSDMQIGRWLMSRDNALARDSAVSVVGGRVKQEVSLRLQNVECGEVDLELEWIALNQ

SEQ ID NO: 31733 - protein, 215 aa, Gossypium aridum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGG

SEQ ID NO: 31734 - protein, 149 aa, Saccharomyces cerevisiae
GLQDEVMNIKPVQKQTRAGQRTRFKAVVVVGDSNGHVGLGIKTAKEVAGAIRAGIIIAKLSVIPIRRGYWGTNLGQPHSLATKTTGKCGSVTVRLIPAPRGSGIVASPAVKKLLQLAGVEDVYTQSNGKTRTLENTLKAAFVAIGNTYG

SEQ ID NO: 31735 - protein, 161 aa, Synechocystis sp. PCC 6803
MTALRIGNGYDIHRLVGDRPLILGGVTIAHHLGLDGHSDADVLTHALMDALLGALSLGDIGHYFPPSDARWQGADSLKLLAQVHQLILERGWRINNLDNVIVAEQPKLKPHIQAMKENLAKVLTIDPDLIGIKATTNERLGPTGREEGIAAYSVALLIKEG

SEQ ID NO: 31736 - protein, 214 aa, Gossypium aridum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTG

SEQ ID NO: 31737 - protein, 257 aa, Bacillus subtilis subsp. subtilis str. 168
MRKQVALVTGAAGGIRFEIAREFAREGASVIVSDLRPEACEKAASKLAEEGFDAAAIPYDVTKEAQVADTVNVIQKQYGRLDILVNNAGIQHVAPIEEFPTDTFEQLIKVMLTAPFIAMKHVFPIMKKQQFGRIINIASVNGLVGFAGKSAYNSAKHGVIGLTKVGALEGAPHGITVNALCPGYVDTQLVRNQLSDLSKTRNVPYDSVLEQVIFPLVPQKRLLSVKEIADYAVFLASEKAKGVTGQAVVLDGGYTAQ

SEQ ID NO: 31738 - protein, 219 aa, Gossypium aridum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHAGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 31739 - protein, 271 aa, Sulfolobus solfataricus
MSSTPSNQNIIPIIKKESIVSLFEKGIRQDGRKLTDYRPLSITLDYAKKADGSALVKLGTTMVLAGTKLEIDKPYEDTPNQGNLIVNVELLPLAYYTFEPGPPDENAIELARVVDRSLRDSKALDLTKLVIEPGKSVWTVWLDVYVLDYGGNVLDACTLASVAALYNTKVYKVEQISVNKNEVVGKLPLNYPVVTISVAKVDKYLVVDPDLDEESIMDAKISFSYTPDLKIVGIQKSGKGSMSLQDIDQAENTARSTAVKLLEELKKHLGI

SEQ ID NO: 31740 - protein, 219 aa, Gossypium aridum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 31741 - protein, 524 aa, Xanthobacter autotrophicus Py2
MSSPALDTAAQETVLIIDFGSQVTQLIARRVREEGVYSEVVPFQKGAEAIQRLKPKAIILSGGPASVIEGQSPKAPEEAFAAGVPVLGICYGEQCMAAQLGGAVEAGHHREFGRAELTVQKVVPLFEGVWRAGERHTVWMSHGDRVTALPEGFEVVATSDNAPFAAIADLSRNYYGVQFHPEVVHTPDGARLLSNFVRKVAKLEGAWTMGAFRERAIARIREQVGTGRVICGLSGGVDSSVAAVLIHEAIGDQLTCVFVDHGLMRQAEADEVVSLFRGHYNIPLVHVDASELFLKELEGVEDPEAKRKTIGRLFIDVFDAEARKVGGADFLAQGTLYPDVIESVSFAGGPSVTIKSHHNVGGLPERMNMKLVEPLRDLFKDEVRALGRELGLPESFVGRHPFPGPGLAIRCPGAITREKLDILRKADAIYLEEIRYAGLYDVIWQAFAVLLPVRTVGVMGDGRTYDHVLALRAVTSVDGMTADFYPFDMGFLGRTATRIINEVKGVNRVVYDVTSKPPGTIEWE

SEQ ID NO: 31742 - protein, 125 aa, Zea mays
MAKMSSTATVTRAHLENKLALAKRCSREATLAGAKAAAIATVASAVPTLASVRMLPWAKAHLNPTGQALVVCTVAGMAYFVAADKAILSLARRHSYESAPDHLKDTSFAGAAAAVRPRPPAFFRP

SEQ ID NO: 31743 - protein, 216 aa, Gossypium schwendimanii
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 31744 - protein, 216 aa, Gossypium schwendimanii
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 31745 - protein, 253 aa, Glycine max
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAGQPDVDGFLVGGASLKPEFIDIINAATVKSA

SEQ ID NO: 31746 - protein, 158 aa, Robiginitalea biformata HTCC2501
MATSGKNLSHYDKEQLPDTGGMRIGLVVSEWNEEITEALFKGAYETLIDCGLADDRILRWNVPGSFELTFGCKRMIERERPDAVIAIGSVIRGETSHFDFVCQAAAAGIKDLNVRQDVPVVFCVLTDDTIQQARDRSGGRHGNKGAEAAIAALKMAAL

SEQ ID NO: 31747 - protein, 423 aa, Ostreococcus tauri
MSATTSAPARARVSGRARGLGRWRRRRATATTATATATGVDGRVDDALDWAHTTVMKFGGSSLADAARVREVGAIVRSFPEETPVVVLSAMGKTTNDLLRAGELALRCDGDHETIETMEPLVATYEKIQARLAPRPGQGPAVRVVTGFLGRGIKTGAVCTLGRGGSDLTATVIGKALGLEEVQVWKDVDGVLSADPREVSNTVPMPFLSFQEATELAYFGAQVLHPHSMRPAMDSGKLAVRVKNSYNIRAPGTVIGHKRAEDLHKDWLLTSIVRKKNVTMLDITSTRMLGQYGFLAKVFNIMATNGISVDVVATSEVSVSLTLDPSKLWERDLAKEELEKLKLDFENDGIANVAVSSGHSIISLIGNVERNNEIMERAFRALGSKDIKVKMVSQGASKTNISLLVNDSQGADAARAIHAEFFE

SEQ ID NO: 31748 - protein, 679 aa, Arabidopsis thaliana
MESMTPISCPTTPRWNQDRPFLTGRFHQETRASSKFADSKRFTLDSSSSSGVEQAIGCYDTPVQELIVIDDLLSALVGIEGRYISIKRFHGKEDSIAFQVDPSMDLALQELAKRIFPLCEYYLLIDQFVESSSQFKNGLVNHAFAAALRALLLDYQAMVAQLEHQFRLGRLSIQGLWFYCQPMMGSMRALAAVIQQASTKQFVGSGVLNLLQSQAKAMAGDNSVRSLLEKMTECASNAYLSILERWVYEGIIDDPYGEFFIAENRSLKKESLSQDSTAKYWSQRYSLKDTIPGFLANIAATILTTGKYLNVMRECGHNVQVPISERSKLTIFGSNHHYLECIKAAHEFASIELVNLIKDKYDLVGRLRSIKHYLLLDQGDFLVHFMDIAREELNKKVHEISVEKLQSLLDLALRTTAAAADPRHEDLTCCVDRASLLTTLGMHKDTDSNSIEDPMSITGLETFSLSYKVQWPLSIVISKKALSKYQLIFRFLFHCKHVERQLCGAWQIHQGIRSMNSKGTAILRSSLLCRSMLKFISSLLHYLTFEVLEPNWHVMHDRLQSTRSVDEVIQHHDFFLDKCLRGCLLLLPDVLKKMEKLKSVCLQYAAATQWLISSSIDINSQSHPQKTMIRDTTVTESIFNFEREFNSELQSLGPVLSKGSQAEPYLTHLSQWILGVSKE

SEQ ID NO: 31749 - protein, 590 aa, Ostreococcus tauri
MPVVMEAKALISSTEEWRALRSHVEAIDKTHLRDLIRDEARCDALALEYDGLYCDFARQRVTTETMEKLYDLARAAGVREKVNAMFNGEAINSTENRAVLHVATRAPKDKVINVDGRNVVPDVHDVLEKIKEFSERVRNGEWIGETGKPLKDVVAIGIGGSFLGPLFVHTALRTNPEAAVGASGRQLRFLANVDPVDVARSLNGLDPETTLVIVVSKTFTTAETMLNARTVRAWIRASLGENAVQKHMVAISTNLKLVKEFGIDPDNAFAFWDWVGGRYSVCSAVGMLPLSLQYGYDTMEKFLEGAWSMDQHFANAPFEENLPVTLGMLSVWNVSFLGCPARAILPYCQALAKLAPHIQQVAMESNGKGVAIDGTPLDYDTGEIDFGEPGTNGQHSFYQLIHQGRTIPCDFIGIVKSQQSVYLKGEIVSNHDELMCNFFAQADALAVGKSAVELRSENVPDALIPHKTFSGNRPSLSIMLPELNAYTTGQLLSLYEHRVAVQGFVWGINSFDQWGVELGKVLASRVRATMNDKRTKGETMSGGEGYNPSTTRLLNRYLAGKAKLIYPEPKDVFPCDLIDSDECRPPTSYV

SEQ ID NO: 31750 - protein, 523 aa, Ostreococcus tauri
MEDERRAHAARVARALASDGGSGATSGRGGRRAALVEALEGGARVDAGRVRTLASDGGVPDDDDGRTRALVWKLCLGYLPEERTRWASVERGRREAYDGFVEEFCARADARAAWMERYVGDAIAEQIDRDVMRVHPDMHFFNDEGEDGRRRKDHMRDALYVYAKLNPGVGYVQGMHEMFGCLYYVFATSMKDESNTRAAAADAFYCFTEIFSEFRDVFVKELDATDQGVRAYLDALSDMLATHGPEVHGHLTSMNLSTSMYAFRWITLLFTQDFEFADVLRLWDVMLASPRSRMECLLRLCVACVLNIGTELIEGDFATCMKMLQNYPPVDIRRITRLAAALPYGIQLDAHRVDLQTELTNRSRPSSLTTRRVVENVHVDAPLWNLHVSHHASANETVPHAPHVRVPLLIRHPRILKLNVQVLIHRDERSRDGEIVLELHRHRFPDERLKVRVKQPTIARDDTAVPSVPASASERARRRPLAIDPRARVARRRRRRRTLSLRSNRIAHRDRPFPSPTRDPTRA

SEQ ID NO: 31751 - protein, 507 aa, Oryza sativa Japonica Group
MGFEWTVATAAAAVAASWAFIAVVVKLGVAGPGYRFFSGNLSEIRRLRAEGANLVLDVSSHDFVPIVQPHIRKWIPLYGKTFLYWFGTRPNICLADMNMVRQVLSDRTGMFPKYIDNMQFARLLGKGLVLTDDDEWKRHYKVVHPAFDMDKLKMMTETISDYAQSMMFEWESELGMKGGSTEIELSRWFEELTADVISRTAFGSSYREGKQVFLAQRKLQFLAFSVFLTIQIPGFSYLLTKKNLKTWSLDKKVRSMLMNIIKSRLTNKETMGYGNDLLGLMLEACVPEHGGSQPQLSMDDIIAECKTFFFAGHDTTSQLLTWTMFLLSTHQHWMEKLRKEVRMVCNDEVPTGDMLNKLKLVNMFLLETLRLYGPVSLVTRRAGTDVKLGSIKVPKGTILTIPIATIHRDKEVWGEDADEFKPERSENGVLNAAKHPSALLSFSIGLRSCIGQNFAMIEARTIIAMILQRFSFTLSPKYVHTPISVITLRPKYGLPMILRSLKVKRDR

SEQ ID NO: 31752 - protein, 320 aa, Gibberella zeae PH-1
MTSHASAPQITVLGSLNMDLVSYVPHHPLPGETLTSSHFNTSPGGKGANQAVACGKLSRDSDLANPSANVSMVGAVGADPYGTLLLDSLRSFGVSVDSVTARQDQKSGIAIIIVDEPSGQNRIIVSPEANHSLRPADFETLPGLRPDLLIMQLEIPFDTVMQALKVAKRDGVPVLLNPAPAQTLPMDAYDGLAHLVVNETEAAILAECNESELDTPAGLERVGRVFIDRGVHNVIITLGGRGVYFVNKQGQSALLPATKTTVVDTTAAGDTFVGSYSLAAVAARGGQFDIEAAVTAANRAAALTVARKGAQISIPWKDEL

SEQ ID NO: 31753 - protein, 474 aa, Magnetococcus sp. MC-1
MLIPTILAGGGGTRLWPLSRDLYPKQFHSGLGDDRPLLLQTAARVQGLPHLSDPVVICNEQHRFMVEEMLREEGNPCQAIFLEPVGRNTAPAAAIAALYARTQQADALVLLMPSDHHIVDSAGFRACVEQGMPHAANRKLVTFGIVPHSPNTGYGYIRRGEPLAEGVFQILNFTEKPNASTAQAYLEQGDYSWNSGIFLFHAGFFLETLARLAPAMYDTCLAAFEAAQPDHAFTRLGKAFLAVPADSIDYAVMEKSNDGVVIPMGVGWNDMGAWDALWEVGNKDPQHNLSVGDTLSVDTHNSLIWSSSRLVATVGVENLAIVETADAILVARKDRVQEVKKIVDQLKQSKRCEFSHHNMVYRPWGTFTQVDAGPRFQVKRIMVKPGAKLSLQMHHHRSEHWVVVKGTALVTRGDTEILLKENESTYIPLGVKHSLANPGKIPLEIIEVQSGPYLGEDDIIRFEDIYARLEDHPR

SEQ ID NO: 31754 - protein, 295 aa, Picea sitchensis
MAQQQQSGSGGGGGAMGQFGDTTFTKVFVGGLAWETQKETMRRYFEQFGEILEAVVITDKNTGRSKGYGFVTFRDPESAMRACVDSSPIIDGRRANCNLASLGAQRSRPSTPQPGSRFRILGSFPTGLQTGGSFYNVGAAFPQPAHYGFQQGFSPYHTYGFSSYSSENTFHPNYYSPYGGPHYPQMYPGPAGMISNPALYPYFQYTQPLQGSAGYPQATQNFGLHFPHIMHYPAAGSSGAISGLQAQQYGGVLSIPTAVPSSGMTLALPAPSLYQIRSPAQPQQTSGGTSDRSSA

SEQ ID NO: 31755 - protein, 197 aa, Burkholderia pseudomallei K96243
MPFNFPIFLTWVRIVLIPLVVGVFYLPDTMLSADHRNLAAAVIFILAALTDWFDGYLARKWNQTSAFGAFLDPVADKLMVTAALLMLVQLARIDAAIALVIVGREIAISALREWMAQIGASKSVAVNSLGKFKTACQMVAIPMLLFYGRLPFGGGVAIDTRGWGEWLIYLAAVLTIWSMLYYMKLAWPQIRERGGAA

SEQ ID NO: 31756 - protein, 169 aa, Brassica napus
AEDIRNEKVKVLRSMRPIQVEDVVIGQYKSHTKGGVTYPGYTDDKTVPKDSLTPTFAAAALFIDNARWDGVPFLMKAGKALHTRRAEIRVQFRHVPGNLYNRNNTGCDLDKATNELVIRVQPDEAIYLKVNNKVPGLGMRLDRSNLNLLYSARYSKEIPDAYEMLLLDA

SEQ ID NO: 31757 - protein, 98 aa, Glycine max
MPPFYIHCRRSSVAPPPPSSGGARLQFYSRLRIQAVATDGNTASGQVLLVSDRNKNKSMLICTYSTLWMIGGFVFIVYMGHLYIWAVVAVLVYHSSTG

SEQ ID NO: 31758 - protein, 322 aa, Kineococcus radiotolerans SRS30216
MAPRDDRTVLGTWPTPVEAAPRLAAAIGLGPGDLLVKRDDLVGLAGGGNEVRELERTLGAALAEGARTVVTSGAPQSNHARLTAAAGARLGLDVVLVLEGSPPAAPGGNLLLDALLGARIVWAGDVSPGELAARVEAEAEDLRAGDGAGGVAVVPFGGSSVLGARGYVDAGAELLEQVPDLDVVVVAVGSGGTMAGLVHALGAHRVLGVDTGAVDDPEQRVRGFAAGLAAQDGTPAPGALRLRRDEVGAGYGVLTARVRQALTLVARTEGIVLDPVYTGRAAAGLLTAVEQGEIRPGQRTVLLHSGGLPGLFGHPDAASLTG

SEQ ID NO: 31759 - protein, 498 aa, Magnaporthe grisea 70-15
MPEKGFVSSNLQMAASMEERHDDLLMQRMPSEEDEQDFEEVDELIDPKSPEELDILGLLLLTCPSLGLQVYWFLLQSSGTPYLRSLGLDGASISIIWALGPIFGAFVQPILGSLSDEIHHPLCRRKPFMMGGSLLVMLSTLAMACAQELTPDPLATPWQPRALAVVCLVVILLALSAYSVGVRAIVVDNCPPSQQFAAAAWSMRWNVLGSATLSTVGFVAVGRHPDTDPAVTFRTLACVAAVCSAATVGLVCWFAPREATPRFRSPGSFGLRKVLSLCAPGALVRRWRRLPPLTNKVCNIQLLGWCGWFPMLYYMSRYATQRGLATKSVETQAKSYPLYASLFFSFGTLSSTLVLTLVNASSCPKITLPRIWFLSQVLATASLLLTFLLCSTHASLALICFMGATWTVTMWVPFALINAELAELRTGVAGVQGLHNMAVSLPQIASALVCAAVLGALRLAGVDGGAVWLLRLAAVPVAWSAWLIWRLDGASRDLSPAC

SEQ ID NO: 31760 - protein, 220 aa, Gossypium schwendimanii
DIYYWECKGYTPLFPRILGHEASGIVESVGEGVNDLKPGDHVLPIFTGECKGCRHCLSEESNNMCELLRTNCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRS

SEQ ID NO: 31761 - protein, 331 aa, Clostridium perfringens
MAVNLKGRSFLTLKDFTPAEIRYLLDLSHDLKAKKRAGILGDSLKGKNVVLLFEKTSTRTRCAFECGAAEEGAHVTFLTNSQMGKKESIEDTAKVLGRMYDGIEFRGFKQSTVEELAKHAGVPVWNGLTDADHPTQILADFLTIEEHAHKPLSAIKLVFTGHTRNNMSYALMYGAAKMGMHFVALGPDSLKPDEDILKEMQEYSKETGATIEFSSNVDEAVKGADVIYTDIWVSMGEDESLYPERVKLLTPYKVTREMMNKTGNKNTLFMHCLPSFHDEDTEVCKDRWIDLGLDIREVEDEVFRSKNSVVFDEAENRMHTIKAVMVATAGR

SEQ ID NO: 31762 - protein, 220 aa, Gossypium schwendimanii
DVYYWECKGYTPLFPRILGHEASGIVESVGEGVNDLKPGDHVLPIFTGECKECRHCLSEESNNMCELLRTNCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRS

SEQ ID NO: 31763 - protein, 215 aa, Gossypium laxum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 31764 - protein, 476 aa, Clostridium perfringens
MAEQHNEPKKLGFAQLAALIVGSMIGGGAFNLPSDMARGAGTGAVIIGWIITGIGMIALAFVYQSLANRKPELTGGVYSYAKGFGEYIGFNSAWGYWLSAWIGNVSYSVLLFGAVGYFLPMFGAGNNVASIIGASVLLWAFTLLILNGVSGAALINLITTIAKLVPIFLFIVISLFMFNFDKFTFQFWGTSDLGGIVTQVKSTMLVTLWCFIGIEGAVVSGRAKKQSDVGKATVLGLIGTLIIYMLITLMALGVMDRVKLSGLENPSMAYVLEFAVGKWGAVLINLGLIISLFGSLLGWALLAAEIPYVAAKDGVLPKVFAKLNKKGTPSGSLIITNLLVQAFLILTLVVSSTYQALYSVASTAILVPYLLSAMYGFKLALTGETYDKNPTGRTRDKIFGGIATVYAIWLCYAAELKYLLLCFILYAVGIIFFYIGKKQNNKDAEVFVGKEKILAIIVLVIAIIAIVMLFNGTITI

SEQ ID NO: 31765 - protein, 477 aa, Synechocystis sp. PCC 6803
MTNPFLNLTYEPALESLGNEFFDPVSAATFPEHKLRFRNDRLLPMLGLEPSQVKDDNFVEAFGLFHGVRPFLALRYHGYQFGEYNPNLGDGRGFLYGQVRGVNGELFDFGTKGSGQTPYSRGGDGRLTLKGGVREVLAAEALHRLGVKTSRCLSLVETGDSLWRGDEPSPTRASVMIRFSRSHIRFGTFERLHYHHQTEQIAQLLDHVIVTYYPEVSGSNSDDSAHIAFFRVLVERVAKLVAQWMAAGFCHGVLNTDNMSITGESFDYGPYGFVPTYDLNFIAAYFDYGGRYRFGNQPAVCRWNLERLQVSLSSVIPSKAMTEALEDYEKIYLGYYITLIARRLGISSTLGDRLDPELWEKLVGQTLQCLAQSQWSYPDFFAQLRLNFSPSWRDNADLILENVDLLGADWSTWRSIYQQVLKQLPPESLAAVPTVLEQANPLTDLLRPRIETVWQAIAEDDNWQPFNDLVQKLQSGN

SEQ ID NO: 31766 - protein, 176 aa, Xanthobacter autotrophicus Py2
MPIYALDGVAPTLPASGHYWIAPDAVLIGNVTLKEGASIWFGSVLRGDNEPIVVGEGSNIQENCVLHTDPGFPLTLGTNVTVGHMATLHGCIVGDGSLIGMGSTVLNGANIASKCLVGSKALVTEGKVFEPFSLIVGAPAKVARQIDEATAARLVGTAEHYQRNWQRYAKGLKRID

SEQ ID NO: 31767 - protein, 350 aa, Zea mays
MHVNFDKFSEGLLLPRAKLSFWRNGKIVQRNFGLPTLSTKDWADIEFGIAEGVDCIALSFVNDANDIKQLKAYLSRRSLEHIKVFAKIESLESLKNLKDIIEASDGVMVARWDLGVQIPLEQIPAIQESIVKLCRHLNKPVIVASQLLESMVEYPTPTRAEVADVSEAVRQYADAVMLSAESAIGAYPQKALSVLRAASERMESWSREENMQKLLPRHQLAIALPDRISEQICSCAVEMANNLAVDAIFVYTKHGHMASLLSRNRPNPPIFAFTDNANSRKSMNLYWGVIPLHLPLSNSMEDNFNKTISLMRSKGSVKPGDTVLVVSDSDLNQPCAATSVFQSIQVRLVE

SEQ ID NO: 31768 - protein, 132 aa, Robiginitalea biformata HTCC2501
MIKPDAVENGHIGPILEKITAAGFRIVAMKYTQLSRRDAEEFYAIHKERPFFGELVDFMTRGPIVSAILEKDNAVEDFRALIGATNPAEAAEGTIRKLFASDIAENAIHGSDSDANAEIEGAFHFSGREIYS

SEQ ID NO: 31769 - protein, 163 aa, Burkholderia pseudomallei K96243
MRHIISVLLENEPGALSRVVGLFSARGYNIETLTVAPTEDQSLSRLTIVSIGSDDVIEQITKHLNRLIEVVKVVDLTDGAHIERELMLIKVRAVGKEREEMKRMADIFRGRIIDVTEKTYTIELTGASDKLDAFIQALDAGSILETVRTGSSGIGRGERILKV

SEQ ID NO: 31770 - protein, 211 aa, Brassica napus
MSVSSVRRLAVSAAVIAAASGGAVYLSPSVASSDRAGGGPVLDSLNRTLGDPSASVPSRSAQESALIKATSSNPLDVLVIGGGATGSGVALDAATRGLRVGLVEREDFSSGTSSRSTKLIHGGVRYLEKAVFNLDYGQLKLVFHALEERKQLIENAPHLCHALPCMTPCFDWFEVVYYWMGLKMYDLVAGPRLLHLSRYYSAQESAELFPT

SEQ ID NO: 31771 - protein, 373 aa, Robiginitalea biformata HTCC2501
MKQTFSLLLLIGLLATGCKSNQYADLGDGLYAEMQTNQGEIILRLEYEQTPVTVANFVTLAEGTSPFVSEEFKGKPYYDGVTFHRVMKDFMIQGGDPTGTGRGTPGYRFSNEIVDSLVHDRKGILSMANSGGTKTNGSQFFITHAPTPWLDGIHTVFGEVVQGIEVVDSIAAVPVDPASNKPLDSVVMETVEIVRKGRDAKDFDAVEVMRNYFAQEEAAEAARRQRLQDYVAEFADQKARAESLPSGLQYLVLNEGEGPKPSIGQRVLVNYSGWLEDGTLIDSSDESVAREFGELDRLMQMHRGSLTPYPMPYSPDTQLIAGFKEALLLMEVGDKWRVFIPSHLAYGDQGNGPVPPGADMIFDLEIIEIEGSE

SEQ ID NO: 31772 - protein, 487 aa, Chlorobaculum tepidum
MSIAADSGGDALHTTSYVMQQADTLAAQFDVAVIGSGPGGYEAAIHAARYGLKTCIVEKAVLGGVCVNWGCIPTKALLRSAEVFDLAKNPETFGVNVGNVSFDLAQAVKRSRNVALKSSKGVAYLLKKAAVEVLAGEAVLTGGAGVMVTMPDGSVRMLGAKNIIVATGSTPRVIPGLEPDGKKIITSREALILKEVPKSMIVVGGGAIGVEMAWFYAKAGSKVTIVELMPRMLPAEEAEVSEALKRSFEKAGITVHCGAKLDNVAVSESGVSAELVVEGSAPQTLNASCLLVAVGVTGAIDGLGLDAVGVETERGFIRTDGQCRTSAPGIYAIGDVRGGMLLAHKASAEAAIAVEAIAGKSPEPLSEPLIPRCVYAQPSVASVGLTEEAAVNAGYQVAVGRSQFAASGKANAYGQLEGFVKLVFDAATGKMLGGHLIGHDAVELIGELGLACRYGVTAGGLVNTVHAHPTLSETVREAAFDALQSMG

SEQ ID NO: 31773 - protein, 293 aa, Zea luxurians
IIESVGEGVTDVAPGDHVLPVFTGECKECAHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMA

SEQ ID NO: 31774 - protein, 147 aa, Lactobacillus reuteri
MVKDEYTLVLVKPDGVKTRHIGDIITRIERKGYNIEALKMIDPSEKKLRQHYFDKVDKPFFPELLEYMTEGPIVGIVVSGTNVIQAIHNMAGATNPGEAEWGTIRGDYGREWPDGNLRNIIHTSDNVNSATREIGIWFPEFDIKDKQ

SEQ ID NO: 31775 - protein, 467 aa, Ostreococcus tauri
  misc_feature (158)..(164): Xaa can be any naturally occurring amino acid
MATTTTADDDARDVVVVGGGPGGYVAAIKAAQLGLRATCVEGRGTLGGTCLNVGCIPSKALLNASHKYEDAKHGMAKHGIAFGGEVTIDVGTMMAHKTKAVTGLTKGIEGLFKKNGVDYAKGWGRLTSANEVEVTSEDGTKRTIKTKNVILATGSVPXXXXXXXKNACRRRWRLIGGGVIGLELGSVWSRLGAKVTVIEFAPAICGAGIDDEIRTTFQRSLKKQGFDFKLNTKVVSAVKKPEGGVTLTLEPSAGGEQTTLEADIVLVSTGRRPFTDGLGLEDVGVETNKKGQVVIEPHSFKTSVPNIYAIGDVVEGPMLAHKAEEEGVSIVEQIAGKKGHVNYDTIPSVIYTHPEVAWVGKTEAQVKEMGIEYVVGKFPLAANSRARANDDSEGVVKFVCDKATGKVLGAHIVAGGAGELLAECVLAMEYGATAEDIARTCHSHPTVSEAVKEAAMAAVPGMGSIHF

SEQ ID NO: 31776 - protein, 557 aa, Synechococcus sp. CC9605
MSTATFAEFAERADYSLLEALTPDPESTADGKDHRPRQVLSGHYVPVTPTPIPEPQYLAHSRSLFSELGLSNDLAQDDQFCRMFSGDLGVATGPMRPWGWATGYALSIYGTEYTQQCPFGNGNGYGDGRAMSVFEGVFEGRRWEMQLKGGGQTPYCRGADGRAVLRSSVREFLAQEFMHALGVPTSRSLTLYVSHAESVRRPWYSENSRSMDPDVMVDCPAAISTRVAPSFLRVGQLELFARRARSEAHPRAHQELHLIVAHLIERNYRQEIDPGLPFSDQVVLLARLFRDRLTALVANWIRVGYCQGNFNSDNCAAGGFTLDYGPFGFCELFDPRFQPWTGGGAHFCFFNQPAAAEANYRMFWKSLRTLMEGQAQAQAQLDQLLEDFPAAMQETMQRMWSSKLGLPSADDTLVQELLKLLVESSADYSMFFRRLSDLPEQIDPLRDCFYLPLSAPLESQWNDWLLRWRAQWPSGVEPSVISAGMRRVNPAITWREWLIAPAYQQAAEGDTSLMTELQQLFSTPYETPSPDMAARYDRLKPREFFSAGGVSHYSCSS

SEQ ID NO: 31777 - protein, 386 aa, Chlorobium tepidum TLS
MGLSLGERCGLVMQSDIRAMSIECARMGGINLSQGVCDTPVPPVVLQGAADAVMQGANIYTHHTGIRELREAIVAKQRRFTGVAFDAEREVVVSAGATGAMYCAFQALLNRGDEVIVFEPFYGYHVSTLRAVEAVPLFVPLDPSDGWSFRVEALEAAVTPKTKALLINTPANPSGKVFSCDELALLAEFAIRHDLFVFTDEMYEHFVFGGLSHVSMASMPGMRERTITISGLSKTFSVTGWRIGYALCDPRWAASIGYFNDLFYVCAASPLQVGVTAGLRLLGDDYYHGLAAEYEVRRDLFCAALAEAGLEPHVPQGAYYVLAGTERLPGATAREKAMHILRETGVASVPGSAFYHDGGGENLVRFCFAKESHVLEAACEKLLKLR

SEQ ID NO: 31778 - protein, 647 aa, Pseudomonas fluorescens Pf-5
MLTKLVDSAAIMIRLQNLTLQRGPQRLLEDAELTLHAGQKAGLIGANGAGKSSLFALLRGELHPDSGDCFLPADWRIAHMRQEVDTLERLAVDYVLDGDLRLRQVQRDLAAAEAAQDGAAQARLHAELDSADGYTADARARKLLAGLGFTNEQMDRQVGDFSGGWRMRLNLAQALMCPSDLLLLDEPTNHLDLDAIIWLEEWLKGYPGTLLLISHDRDFLDAVVDHVAHVDQRKITLYRGGYSAFERARAERLAQQQQAYEKQQAQRAHMESYIARFKAQATKARQAQSRIKALERMEELSAAHVDSPFDFTFRESTKISSPLIDLSDARLGYGERAVLEKVKLQLTPGARIGLLGPNGAGKSTLIKNLSGELQPLSGRLTRGENTVVGYFAQHQLDSLDSKASPLLHLQRLAPTEREQTLRDFLGGFDFRGARIDEPVLNFSGGEKARLALALIAWERPNLLLLDEPTNHLDLEMRLALTMALQEFSGAVLVVSHDRHLLKSTTDNFFLVADGKVEEFDGDLDDYTRWLVDYRQRNAPVSNTPVNPDKTDKKAQRQAAAALRQQLAPHKREADKLEAELGKVHERLAKIEASLGDSGLYEAARKDELRDLLAEQAKLKTRESELEEAWMEALELLESMQAELEALS

SEQ ID NO: 31779 - protein, 354 aa, Oryza sativa Indica Group
MDNARESEDEHCLYAQELVFAYNRSMVLRAAIQLGLLDALAGGGDALTADELAGKIQATDGVAVDRILRFLASFDVVRCSTETSPGGGAALIRRYTPAPVCRWLTKNNGEGSLAPFSVFIIDEDHLLPWQHIAEAVASGGPAPSERTNGMPYHEYIGNNKRLSGLFDHAMAQHSAIRARKMLERFEGFDGIQRLVDVGGGDGSTLGMITSRYKHIRGINYDLPHVISQAPSLPGVEHIAGDMYESVPNGDVILLQWMLLMFSDEDCIKILKNCHQALPEGGKVIIVEGLLPETPNTTPAARDSFTMDMILFVLFKVGKHRTEEEFAKLAKESGFTGTFRSTYIFLNFYALEFNK

SEQ ID NO: 31780 - protein, 447 aa, Salmonella enterica subsp. arizonae serovar 62:z4,z23:--
MDQTCSLESFLNHVQKRDPHQTEFAQAVREVMTTLWPFLEQNPRYRHMSLLERLVEPERVIQFRVVWLDDRNQVQVNRAWRVQFNAAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSACVFTGKGLSFGGSLIRPEATGYGLVYFTEAMLKRHGLGFEGMRVAVSGSGNVAQYAIEKAMAFGARVVTASDSSGTVVDESGFTQEKLARLCEIKASRDGRVADYAREFGLIYLESQQPWSVPVDIALPCATQNELDVDAARVLIANGVKAVAEGANMPTTIEATDLFLEAGVLFAPGKAANAGGVATSGLEMAQNAARLSWKAEKVDARLHHIMLDIHHSCVEYGSDNKHINYVQGANIAGFVKVADAMLAQGVI

SEQ ID NO: 31781 - protein, 492 aa, Picea sitchensis
MTGGGVSESESTDTDQQLVDLDPSCHSSPADINWSSGSSSSCDTFAAGSGNVGSSSKPHKANNDAGWEAIRSLRAEAPLSLSHFRVIHKLGSGDIGSVYLAELKGTECYFAIKAMDKKALTSRNKLMRAETEREILETLDHPFLPTLYAHLDEPQLSCLVMEFCPGGDLHVLRQRQPGKRFRDHAARFYASEVLLALEYLHMLGIVYRDLKPENVLVREDGHIMLTDFDLSLKCIVHPTLLQKSRGLESLFDIDSDDRATPPGMPTPSSIIQSYVLPCGHPSRQNNPTTVSCLPVFHHFAKKKSKPPKFHSLRHAESSASAASNLQLLAEPTDARSMSFVGTHEYLAPEIIAGDGHGNAVDWWTLGIFIFELLYGRTPFRGPDNDKTLANVVAQALHFPDDDDEDDETVLGLGPSAAAKDLIRGLLVKDPSRRMASSRGASEIKQHAFFRGINWALIRCSIPPHIPSPFVPPRPPPPSPPDKRPTSGDFEDF

SEQ ID NO: 31782 - protein, 137 aa, Salmonella enterica subsp. arizonae serovar 62:z4,z23:--
MANQLSAEELKKKLSEMQFYVTQNRGTEPPFTGRLLHNKRDGVYHCLVCEAPLFHSHTKYDSGCGWPSFYQPVSKEAIRYIDDFSHGMQRVEIRCGNCDAHLGHVFPDGPQPTGERYCVNSASLAFSDEKNGDQLKG

SEQ ID NO: 31783 - protein, 462 aa, Fulvimarina pelagi HTCC2506
MADGSDISGSGTDYFAERQLKRGAAGWLLLVGLGVAYVVSGDFAGWNFGLQYGGWGGLLIATLLMATMYVCMCFSLAELATIAPTAGGGYGFARRAFGPWGGFLCGIAILIEYAIAPAAIAVFIGSYCGSLFGIDGWPVYLAFYAVFLGIHINGAGEALRLIFVITALAVLALIVFVIAMIPHFDTNNLFDIAATDAVGASTFLPFGYVGIWAAIPYGIWFFLAIEGVPLAAEETADPDRDLPRGLIGGISVLLLTAGLILVFGAGGAGSSVLQDSGNPLVAALEAPNAYGEPTLVSRFVNFVGLAGLIASFFSIIYGYSRLVFAMSRAGYLPKVLSLTNRRQSPYLALIIPGIIGFILSLTGQGDLLILVAVFGATISYVMMMASHIKLRLAEPELKRPYRTPGGMLTSGIALVLALIATIAGLLVDPRAVLRAAIVYALFIAYFAIYSRHQLVKGAPGEI

SEQ ID NO: 31784 - protein, 217 aa, Clostridium perfringens
MAVNLKGRSFLTLKDFTPAEIRYLLDLSHDLKAKKRAGILGDSLKGKNVVLLFEKTSTRTRCAFECGAAEEGAHVTFLTNSQMGKKESIEDTAKVLGRMYDGIEFRGFKQSTVEELAKHAGVPVVNGLTDADHPTQILADFLTIEAHKPLSEIKLVFTGDTRNNMSYALMYGAAKMGMHFVALGPDSLKPDEDILKEMQEYSKETIEFSSNVDEAVK

SEQ ID NO: 31785 - protein, 215 aa, Gossypium lobatum
IYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 31786 - protein, 267 aa, Triticum aestivum
MAEEQFLAAAVGAAKSAGEIIRKSFYLSKKVEHKGQVDLVTETDKACEDLIFNHLRMLYPDHKFIGEETSAALGSTDDLTYDPTWIVDPLDGTTNFVHGFPFVCVSIGLTIGKIPTVGVVYNPIMNELFTAVRGKGAFLNGSPIKTSPQNELVKALMVTEVGTKRDKSTLDDTTNRINKLLFKIRSIRMCGSLALNMCGVACGRLDLCYEIGFGGPWDVAAGALILKEAGGFVFDPSGDEFDLMAQRMAGSNGHLKDQFIKALGDAS

SEQ ID NO: 31787 - protein, 148 aa, Fagus sylvatica
MLPLSLLKTAQGHPMLVELKSGETYNGHLVNCDTWMNIHLREVICTSKDGDRFWRMPDCYIRGNTIKYLRVPDEVIDKVQEETKSRADRKPPGVGRGRGRGREEGSGARQVRGAGRDVMMQVAKAWVEVRGRGASAGKSGGRGGRGRG

SEQ ID NO: 31788 - protein, 867 aa, Oryza sativa Indica Group
MAGAGAVGGSNWEEMVRRMLPPGTTIPEAPANLDYSIALEYDGPPVSYELPRIDPVDLPAIPTAQPVSGPLVPGRSNGVVAPVVRPVFMPPVHRKQDAHRAEPPPVAAQGRRRRSSESVDSAPQNEGFSDDDDSCSVSQESAHNFHGQRGGRTAAQEGRRAQVVTFGVTEDSRYESKEFDDVSEQYVAVTKKEKRGRTCSRCGKRKWESKESCIVCDARFCSYCVLRAMGSMPEGRKCITCIGQPIDENKRSKLGKGSRILSRLLSPLEVRQILKAEKECQANQLRPEQLIINGFPLNPDEMASLLSCQRPPQKLKPGRYWYDKESGLWGKEGEKPDRVVSTNLTFNGKLQPNASNGNTQVYMNGREITKIELRVLKIAQVQCPRDTHFWVYHDGGYEEEGQNNIKGKIWESPVTRFACALFSLPVPPANSDEPKDEAPYSARTVPDYLDQKRIQKLLILGSPGAGTSTIFKQAKLLYDTRFTQEELDSIKLMIQSNMFKYLGILLEGRERFEEEALAGSNNPSSEDENTQHDGNKSNGSDSCIYSINAKLKKFSDWLLDIIAMGDLDAFFPAATREYAPIVEEMWKDPAIQATYKRKDELHFLPDVAEYFLSRAIEVSSNEYEPSEKDIIYSEGVTQGNGLAFIEFTLDDRSPMSEMYTDNHEPHSQTLNKYQLIRVSAKGMNEGCKWVEMFEDVSMVIFSVALSDYDQLGAPSSGGNSPLVNKMIQSRDLFEATIRQPCFRDMPFVLVLNKFDLFEEKIGRVPLSTCEWFSDFCPLRTHHNNQSLAHQAFYYVAMKFKELYAACTDRKLFVWQARARDRLTVDEAFKFIREVLKWEDEKDGGGYYPDESFYSTTELSSSRLIRQE

SEQ ID NO: 31789 - protein, 361 aa, Prymnesium parvum
MLHLLPPLVGALVLPGGALTTPQRALAVRMQTTDAAFGASHTSFYTDAVKQDSYFSLEEVLEQKMSDKDLGSVIKTMFDACGTITEALRKELVTVAEKQESVFGDVQLGVDVLADDLMWEVCKTDPLIKEGASEEEPEVREMHADGKFCICWDPLDGSSIVDNNWAVGTILGIWGAETGILGATGRDQKASMVALYGPRTTVFVTLDDGVYEFTYGANGVDGWLCSRERCEIAPKSKIFAPANMRAAQDLPEYAALIDYWMANKYTLRYTGGLVPDICQQFTKKMGVFANPTSESSPAKLRLAFEAAPFGLLVEKAGGKTSDGVSGGSVLDVKITGIDQRTPLCIGSAEEVDRFNTMLKLN

SEQ ID NO: 31790 - protein, 510 aa, Fulvimarina pelagi HTCC2506
MLEIVEQLEEKRVEARLGGGQKRIDKQHEKGKLTARERLDVLLDPGSFEEYDTFKTHRATDFGMARQQYPGDGVVTGWGTINGRPTYVFSQDFTVFGGSLSETHAEKICKVMDLAVQNGIPLIGLNDSGGARIQEGVASLGGYAEVFWRNVQASGVVPQISVIMGPCAGGAVYSPAMTDFTYMVRDTSYMFVTGPDVVKTVTGEVVTAEELGGATTHTKKSSVADAAFDNDVEALMEVRRLFDFLPSSSRETAPTLDVHDDPNRLENSLDTLVPDNANTPYDMREVIEKIADEGDFLEIQKDFAGNILIGFIRMNGQSIGVIANQPMVLAGCLDIDSSRKAARFVRFCDAFNIPILTLVDVPGFLPGVSQEYGGIIKHGAKLLFAYAQATVPKVTVITRKAYGGAYDVMASKHIRADVNYAWPSAQIAVMGAKGAAEIIHRKDAGDAEKLAAHTKEYEDRFANPFIAAQRGFIDEVIMPHSTRRRVLRALEILKTKDVPEPMRKHDNIPL

SEQ ID NO: 31791 - protein, 271 aa, Sulfolobus solfataricus
MSSTPSNQNIIPIIKKESIVSLFEKGIRQDGRKLTDYRPLSITLDYAKKADGSALVKLGTTMVLAGTKLEIDKPYEDTPNQGNLIVNVELLPLAYTTFEPGPPDENAIELARVVDRSLRDSKALDLTKLVIEPGKSVWTVWLDVYVLDYGGNVLDACTLASVAALYNTKVYKVEQISVNKNEVVGKLPLNYPVVTISVAKVDKYLVVDPDLDEESIMDAKISFSYTPDLKIVGIQKSGKGSMSLQDIDQAENTARSTAVKLLEELKKHLGI

SEQ ID NO: 31792 - protein, 488 aa, Prunus dulcis
LPTEDDMGNSEVGHNALGAGRIFAQGAKLVDSALETGKLYEGEGFKYIKESFPTNTLHLIGLLSDGGVHSRLDQLLLLVKGASERGAKRIRVHILTDGRDVLDGSSVGFAETLENYLAQLREKGVDAQIASGGGRMYVTMDRYENDWGVVKRGWDAQVLGEAPHKFKNAVEAIKTLRQEPNTSDQYLPPFVIVDENGKPVGPIVDGDAVVTFNFRADRMVMIAKALEYADFDKFDRVRFPKIRYAGMLQYDGELKLPSKYLVEPPEIDRTSGEYLTYNGVRTFACSETVKFGHVTFFWNGNRSGYFNPQMEEYVEIPSDSGITFNVQPKMKAVEIAEKGRGAILSKKFEQVRVNLPNSDMVGHTSSIEATVVACKAADEAVKIIIDAIEQVGGIYVVTADHGNAEDMVKRNKKGQPLLDKNGNIQILTSHTLQPVPIAIGGPGLAPGVQFRKDVPNGGLANVAATVMNLHGFEAPADYETTLIEVVDN

SEQ ID NO: 31793 - protein, 395 aa, Fulvimarina pelagi HTCC2506
MDIHEYQAKELLARHGVNLPRGGLAYSPEQAAYRASEIGGERWAVKAQIHSGARGKAGGVKLCDSDKAVKQAAEEMLGKRLVTHQTGPEGKLVNRLYIEETVDIAQELYLGFVLDRKAERIMIIASSSGGMEVEEIADKEPESLIKTVVDPGHGLQEFQAREIAYNLGLEYKVVNRMVDTILGCYRAFRDYDGSMLEINPLVITGGGSVMALDAKMSFDENALFRRQEISELRDKSQEDPRETFASDRGLSYVGLNGEIGCIINGAGLAMATLDMIKIAGGEPANFLDIGGGASPDRVAKSFRAVLQDENVKVIFVNIFAGINRCDWVAEGVIKAKKEVGVSLPIIVRLAGTNVEKGKQILADSGEDIIVADTLKEGAEKAVKAWKDAGGTKAAA

SEQ ID NO: 31794 - protein, 231 aa, Methanococcoides burtonii DSM 6242
MKERNANASSSEKEAAGNAAASLVEDGMIIGLGTGSTTAFAIAEVGRRVREEGLNVLAVVTSYQAEMLAIEAGVPLTSLAEHPVLDLAIDGADQVDAKLNVIKGGGAAHTHEKVVAHSAKRFIVVVDESKISEELDHFVPIEVLPYARELAKKQFIELGGKPQIRLASRKDGPVISDNGNVIIDVEFGVIEDAAELSQKLSTCVGVVEHGIFLNTDEVYVGMKDGSVKIIN

SEQ ID NO: 31795 - protein, 251 aa, Burkholderia pseudomallei K96243
MSKQRIKRVIGNWKMHGRLSGNEALLDEVAQGAQAVPEHVGIGVCVPFPYLAQARARLHGGRVAWGAQDVSAHEQGAFTGEVAAGMVAEFGAAYAIVGHSERRAYHGESNEIVAAKAQRALAAGLTPVVCVGETLAEREAGATEQVVGVQLAAVLAVLSQDEAARIVVAYEPVWAIGTGRSATAEQAQQVHAFLRGRLAAKGAERVSLLYGGSVKADNAAELFSQPDIDGGLIGGASLKSGDFLAICRAAQ

SEQ ID NO: 31796 - protein, 312 aa, Brassica napus
ADGNYITPFATSEVDIYSGESYSVLLTTDQDPSQNYWISVGVRGRKPKTPPALTVLHYVTAPSSQPPSSPPPETPRWNDFDRSRNFSKRIFSAMGSPPPPRKFKKRLILLNTQNMIDGATKWALNNVSLVVPATPYLGSVKYKLRRGFDRKSPPTTFPMDYDIMNPPRNRNTTKGNGIYVFPFNVTVDVILQNANGLDANASEIHPWHLHGHDFWVLGYGEGKFRPEIDEKTYNLKNPPLRNTVALYPYGWTALRFVTDNPGVWFFHCHIEPHLHMGMGVVFAEGLNRIGKVPDEALGCGLTKQFLMNRNNP

SEQ ID NO: 31797 - protein, 166 aa, Malassezia furfur
EIGSTIPNATFAYVPYSPELEDHKVCGMPTSFQSHERWKGKKVVIVAVPGAFTPTCTANHVPPYVEKIQELKSKGVDEVVVISANDPFVLSAWGITEHAKDNLTFAQDVNCEFSKHFNATLDLSSKGMGLRTARYALIANDLKVEYFGIDEGEPKQSSAATVLSKL

SEQ ID NO: 31798 - protein, 417 aa, Cytophaga hutchinsonii ATCC 33406
MNSKVKVEDIVEAANRLKNVVTHTPLTKNEHLSQEYNCNLWLKREDLQLVRSYKLRGAYNFMCSQKREDIEKGVVCASAGNHAQGVAYSCQALKIKGRIYMPSTTPKQKVTQVKFFGKEFVEVVLTGDTFDDSYKEAMNYCTENKLLFVHPFDDPKVIAGQGTVGFEILNDIVGTIDYIFVPIGGGGLAAGLCTYIKELSPHTKIIGVEPLGAPAMKRSLEEGKVVVLEEIDKFVDGAAVKRVGDLNFDICSEYLDDVQLVPEGKTCSTIIKLYNEEAIVAEPAGALSISVLDYYKDEIKGKNVVCVISGSNNDIDRMQEIKERSLLYEGLKHYFIIRFKQRTGALREFLDEVLGPNDDITYFEYTKKTNRENGPAMVGIEVKMKEDFNLLIDRMNAKNVDYTLVNSDSNLFSFLIM

SEQ ID NO: 31799 - protein, 278 aa, marine gamma proteobacterium HTCC2143
MTNRLDGKVAVITGAASGIGAVTARRFVAEGCRVILGDIQTQEGRELADSLGDAALFCPCNVTSEKNVSTLVDLAVSSFGKLDIMFNNAGIVGSKGPIHTTPGEEWVATLDILVNGVFYGVKHAARVMRQQGSGSIINMSSVAGLVGGLGPHAYTVAKHAIVGLTKSTSAELCSDGIRVNAIAPYSMATPMVAAAHLQDHQAIEQTSKNLAEKSPLPNRAGTADDVANAALWLASDESGYTSGLTLTTDAGVTAGSLMRAARYADYSPMQKEAGKTGL

SEQ ID NO: 31800 - protein, 260 aa, Ostreococcus tauri
MDDKAREIAEASAVIKMEIQRLNESLVELQNVRARGGARGEGSKTASDHDGAVVDTLKNRLATATKTFKETLTNRQASIKAGEERRAMFGASAGPSAVNAGLDYLGDDAFARAMRAGIGGGAGFGNLQGSGAAAANAFVPRPDAPGQGVSTPYAMQTQDQMQLYNQNAAYADSRQEALQNVERTITELGGIFQQLATMVSEQGELAIRIDENVDDTLANVDSAQAQLLKYLNSISSNRWLIMKIFAVLISFFTFFIVFIA

SEQ ID NO: 31801 - protein, 189 aa, Porphyra yezoensis
MILIIDNYDSFTYNLAQCVGELGYDVLVCRNDEIDIPTIKQLNPNKIIISPGPGKPSDSGISLDVISSFSDSIPILGVCLGHQSIGYLNGGRIIKVSEIMHGKTSKIYHNNEDLFKTLPNPFIATRYHSLIIDNLNFPSSLAITAWTENNIIMACRHKDNQMLRGIQFHPESLWTFYGQQLLRNFLEYS

SEQ ID NO: 31802 - protein, 380 aa, Malus x domestica
MSNTAGQVIRCRAAVAWEAGKPLVIEEVEVAPPQANEVRIKILFTSLCHTDVYFWEAKGQNPLFPRIYGHEAGGIVESVGEGVTDLKAGDHVLPVFTGECKDCAHCKSEESNMCDLLRINTDRGVMLSDGKSRFSIKGKPIYHFVGTSTFSEYTVVHVGCLAKINPSAPLDKVCLLSCGISTGLGATLNVAKPKKGSTVAVFGLGAVGLAAAEGARLSGASRIIGVDLHSDRFEEAKKFGVTEFVNPKAHEKPVQEVIAELTNRGVDRSIECTGSTEAMISAFECVHDGWGVAVLVGVPHKDAVFKTHPVNFLNERTLKGTFFGNYKTRTDIPSVVEKYMNKELELEKFITHKVPFSEINKAFEYMLKGEGLRCIIRMEE

SEQ ID NO: 31803 - protein, 397 aa, Robiginitalea biformata HTCC2501
MDDDFLKYQAQTTPHPLGLNILRASGSYVYDDREKEYLDLIAGVSACTLGHCHPEVVRAIREQAGKYLHVMVYGEFAMEPAVAFCRELAAALPAPLETTYLVNSGTEAMEGAIKLARRVTGRSEILAARDAYHGNTLGSLSLMSLESRKAPFRPLLPDVRHIRFGHAGDLDKITGKTAAVVLETIQGGAGFLLPPEGYLQQVRERCSQTGTLLILDEIQPGFGRTGKLFAFEHYRCIPDILVMGKGMASGLPVGAFTASREHMTALSNRPKLGHITTFGGNPVVAAAALATLRVLREGTLMEAITRKEMLFRELLRHPRIQEIRGRGLMLALILSDPAEADHVILRGMERGLLLFWLLFEPRAVRITPPLTISEEEIRKGCQMLLELLDTCPKAPVN

SEQ ID NO: 31804 - protein, 699 aa, Polaromonas sp. JS666
MTTHYEVRGTVALITLDNPPVNGLGYATRSSITDNLQKANADAAVKSIVLTGAGKAFSGGADIKEFGTPKALLEPNLLSVIRAVENSSKPVVAAIHTVCMGGGLELALGCHYRIAAPGCSVALPEVKLGLLPGAGGTQRLPRTVGVEPALNMIVSGEPVKSELLAQIPGQKLFDRMAASPESLAEDALAFAQSIADTRPLPLVRNLPCKHPDGDAYFQFARNMVKGMAKNFPAPLKCVDAVEAATKKKFEDGLAFERELFINLMWTPESRALRHIFMAERAASKIPDVPEDTPRREIKSIAVIGAGTMGGGISMNFLNAGIPVKILEMKQEALDRGIATIRKNYESQVKKGKLKQDKYEQRMSLLSTTLSYDDLKDADMVIEAVFEEMGVKEKVLKELDRVMKPGAILASNTSTLDMNQIASFTKRPQDVIGTHFFSPANVMKLLEVVRGEKTAKDVLATVMALGKKIKKTAVVSGVCDGFIGNRMIEQYSRQAGFLLEEGATPAQVDKAVEKFGFAMGPFRMGDLAGNDIGWAIRKRRYQEKPGMKYSKTADLLCEMGRYGQKTGAGWYDYVPGKRDAIPSQVVVDMIEKHRKDIGVTPRRISDEEIVERLVYSLVNEAAHILEEGIASKASDIDMVYLTGYGFPLHRGGPMLYADQMGLFNVVQSMNRFAQNPLDDASFWKPAPLLARLAAEGKTFN

SEQ ID NO: 31805 - protein, 259 aa, Vibrio sp. Ex25
MTDTSLQSNTALENETTHFGFSTVAKDEKVTKVAEVFHSVATKYDIMNDLMSGGIHRLWKRFTIDCSGARPGQRILDLGGGTGDLTAKFSRIVGDEGHVILADINNSMLNVGRDKLRDNGIVGNVHYVQANAEELPFPDDYFDAITISFCLRNVTDKDKALRSMFRVLKPGGRLLVLEFSKPVLEPLSKVYDAYSFHLLPRIGELVANDSESYRYLAESIRMHPDQETLEGMMQDAGFENTKYYNLTGGIVALHRGYKF

SEQ ID NO: 31806 - protein, 412 aa, Synechococcus sp. CC9605
MATTPLPSTGALSGLGETLAFFTQADFAQRRFETHGDVFETKLLAQRMVFIRGERAIGDMLGQGDALQGWWPESVRQLLGSRSLANRSGPGHKARRRVVGQLFSSAALARYTPSIEQLVAELCHELITTNTALPLAARMRRFAFAVIATTVLGLDGASRDALFADFEIWTRALFSIPLAIPGTPFAKAMAARQRLLKRIKGVLQAGTNQGGLDLLSGGLDEAGIPLDDDDLAEQLLLLLFAGYETTASSLSCLFRALLLNPEVESWLRDGLNKDPASPKLDATVMEVMRLTPPVGGFFRRSLAPIELAGVAVPEGSVIQVVLSPTSDGDDDDLASFRPQRHLDGSFKQTLLPFGGGERVCLGKALAELEIRLMAVGLLQAVELQLQPGQDLALQLIPSPTPKDGLLVQAAAR

SEQ ID NO: 31807 - protein, 387 aa, Campylobacter coli RM2228
MNIHEYQAKAIFADNGIPTLKGKVAFSVEEAVENAKELGGSVWAVKAQIHAGGRGLGGGVKIAKNLDEVKDYASKILGMNLVTHQTGPEGKLVQKLYIESGANIVKEYYLAILFNRMAEQITIIASSEGGMDIEKVAKESPEKIAKVGIDPQIGFKMFHGLEVAKVLGLDKDESKKLISMIAKLYKLYMDKDMNMLEINPLIKTAEGDFYALDAKCSFDDSALYRHPEIAELRDITEENPAEREAAEFGLSYVKLDGDVACMVNGAGLAMATMDIINYSGAKPANFLDVGGGASAETVAKAFEIILRDKNVKVIFINIFGGIVRCDRIANGILEATKNVEVNIPIVVRLDGTNAAEAKAILDSSNLKNIKAATNLKNGAELVKSLVG

SEQ ID NO: 31808 - protein, 384 aa, Picea sitchensis
MGSVTSSMAAKFAFFPPNPPSYKIIQDEVTGRLVMTDVPQRENVDVLKLLTRRGQEIMAIYVRNPLASLTVLYSHGNAADLGQMYELFAELSAHLRVNLMGYDYSGYGQSSGKPSEHNTYADIEAAYKCLEEQYGAKEEDIILYGQSVGSGPTLDLAARLPSLRAVVLHSAILSGLRVMYPVKRTYWFDIYKNIDKMPLVNCPVLIIHGTSDEVVDCSHGKQLWDLCKEKYEPLWLKGGSHCNLELYPDYIRHLRKFISTVEKSPVLRNSSRRSTDRSETSRRSTDCSEPSRRSTDRREKSRSSVDRSEKSRRSTDRRDKSRTSVDRSEKSRNSIDRPDKSRNSIDWHEKSRNSVDRYDKSRKSTDQFDKARTSIDRMERTKAG

SEQ ID NO: 31809 - protein, 79 aa, Burkholderia pseudomallei K96243
MDNIEQRVKKIVAEQLGVAEAEIKNEASFVNDLGADSLDTVELVMALEDEFGMEIPDEEAEKITTVQQAIDYARANVKA

SEQ ID NO: 31810 - protein, 285 aa, Salmonella enterica subsp. arizonae serovar 62:z4,z23:--
MRTVKNVTFCGQATLPAIGQGTWYMGERADNRQREVAALRAGLDLGLRLIDTAEMYADGGAEKVVGEALAGRRDEAYLVSKVYPWNAGGQKMIAACEGSLRRLKTDYLDLYLLHWAGSFSFEETIEGMERLMAQGKIRRWGVSNLDYDDMQALWRTPGGQQCATNQVLYHLASRGIEYDLLPWCQQQRMPVMAYSPLAQAGRLRSGLLNHPVVNEIAQAHNATGAQILLAWVIAHPGVVAIPKAGSAEHVKQNAAALEIALSANEIALLDSAWPAPKGKTALDMV

SEQ ID NO: 31811 - protein, 200 aa, Oryza sativa Indica Group
MEKMPWPATGPSSRWSGPRSDCQFATNSNSIWHVGPTTPVETQAHKSGSNFDPPTAAAAAISARRSGPTRQRDVLIAAGGLLLLILLVWINDFWGAEINWLAEMAVTRIGLAGLAVMGQNLALNIAEKGFPISVYNRTTSKVDETVQRAKVEGNLPVYGFHDPASFVNSIQKPRVVIMLVKAGAPVDQTIGNSCSTLGAG

SEQ ID NO: 31812 - protein, 249 aa, Burkholderia pseudomallei K96243
MDKTLDKQVAIVTGASRGIGRAIALELARRGAMVIGTATTEAGAEGIGAAFKQAGLEGRGAVLNVNDATAVDALVESTLKEFGALNVLVNNAGITQDQLAMRMKDDEWDAVIDTNLKAVFRLSRAVLRPMMKARGGRIVNITSVVGSAGNPGQVNYAAAKAGVAGMTRALAREIGSRGITVNCVAPGFIDTDMTKGLPQEQQTALKTQIPLGRLGSPEDIAHAVAFLASPQAGYITGTTLHVNGGMFMS

SEQ ID NO: 31813 - protein, 465 aa, Picea sitchensis
MDNNEKHHRSHPLACELDDTVEISRTGTVWTEVAHLITSVIGAGVLSLSWSVAQLGWIAGPAAMIVFALVSLYTTFLLVDCYRFPDPVSGPMRNTSYRKTVRVNLGERKAWLCALVQNAFFYGICVAYTITTSVSIRAISRSNCYHKNGHDSPCHFPNITYMIIYGVIQVILSQIPSFHKIWGLSILAAIMSFTYSTLGFGLGLAKVIENGKIYGTLGGISTTVSLTRAQKFWRILPALGDIAFAFPFTPLVIEIQDTLKSPPPENKTMRKASLVSMMITASFYMLCGFLGYAAFGENAPGNLLTGFGFYEPYWLIDFANACLAVHLVAAYQVFCQPIFSLVEGWISRKWPSNTLISKRIGIRVPLFGFYKVNLLTLCWRTAFVVSTTGIAILFPLFNDVLGVLGALSFWPLVVYFPVEMYIVQKKVQRWTLKWSLLQTLSFIALLISLVTAAGSIEGLVKDKES

SEQ ID NO: 31814 - protein, 446 aa, Oryza sativa Indica Group
MAVTRIGLAGLAVMGQNLALNIAEKGFPISVYNRTTSKVDETVQGAKHTWSRVTVLLMEEMSGTRTLRGGRRQWRSVASSILGMVFPEEREGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVSPCHQQWRQHPRHVGESRVHVHEEAQGNVKEPPICEFCDGGLMATHSNEMVMARRPDQTKTMVGVRPLLPISPLAKG

SEQ ID NO: 31815 - protein, 148 aa, Capsicum annuum
MEQTFIMIKPDGVQRGLVGEIIGRFEKKGFSLKGLKLITVDRAFAEKHYADLSAKPFFNGLVEYIVSGPVVSMVWEGKGVLTTGRKIIGATNPLESAPGTIRGDYAIDIGRNVIHGSDAVESARKEIALWFPEGVAEWQSSLHCWIYE

SEQ ID NO: 31816 - protein, 279 aa, Vibrio cholerae O1 biovar eltor str. N16961
MLCLGLVVMRCQPLRRALNCSQGWWIIKIDIYDVFIGKSAFGNPCGVLELNGWLSDSELHQITREVGQPVTSFITHVDGRFHIRWFALDGEINLCGHGSLGAGAAILSKYQLENVVFNSKYGEVVISKRDDQYSLVLPSWEAKPCAVPVEISDLATDAIDVFSTRDLVLVLPSVEAVMNFQPDDDRLREINEYHALIVTAANGNSGYVLRYFAPKIGISEDLATGSAQCSLAPYWFKKLGSDALNARQLSMSGGYFEVERTTENSITVFAQAKRRAIAI

SEQ ID NO: 31817 - protein, 205 aa, Triticum aestivum
MDHKDEHSAHPDQEVEEEEDEEAKRAVVLGPQVPLKDQLELDKDDESLRRWKEQLLGQVDTEQLGETAEPEVKVLNLTILSPDRPDLVLPIPFVPDEKGYAFALKDGSAYSFRFSFIVSNNIVSGLKYTNTVWKTGVRVENQKMMLGTFSPQAEPYTYEGEEETTPAGMFARGSYSAKLKFIDDDGKNYLEMSYYFEIRKDWPAV

SEQ ID NO: 31818 - protein, 272 aa, Oryza sativa Indica Group
MDVKPALAVLRKFFSAVRTVKVTNVSLSATVQDIKEFFSFSGDIEHVEMQSGDEWSQVAYVTFKDPQGAETALLLSGATIVDLSVIIAPAPEYQPPPTSSAPPMYSATSVPVSEDNNVVHKAEDVVSTMLAKGFTLGKDAVGKAKAFDEKHGFTSTAGAKVASIDRKIGLSEKFTIGTSIVNEKVKEMDQKFQVSDKTKSAFAAAEQKVSTAGSAIMKNRYVFTGASWVTNAFNKVAKAATDVGTMTKEKMAAEDQHKGSGPSGGHSYTPIQ

SEQ ID NO: 31819 - protein, 149 aa, Cicer arietinum
HNITTMPLSSMDFLSKNPYLFAALSASLTLLMIQFMWRKLNKSNSMKKKKKYHPVAGTVFNQMMNFNRLHHYMTDLAGKYKTYRLLNPFRNEIYTAEPTNVEYILKTNFDNYGKGLYNYHNLKDLLGDGIFSQRVLSSLLLFRLVLGYA

SEQ ID NO: 31820 - protein, 473 aa, Xanthobacter autotrophicus Py2
MGKVTGFLEIDRREQKYQPASDRIRHFREFTLPLPDAEVANQASRCMDCGVPFCHGPNGCPVHNQIPDWNDLVYRDEWEEAARNLHTTNNFPEFTGRICPAPCEEACTLNLEDMPVTIKTVEQAIADKAWKKGWIKPEPALVKTGKKVAIVGSGPAGLAAAQQLARAGHDVHVFEREPKAGGLLRYGIPDFKMEKHHIDRRVKQMEAEGVTFHYNENIGIVRPFQELLDTHDAVLLAGGSEAPRDPKLPGQEMEGVHFAMPYLVQSNRREGDEPVNEIPIVAGGKHVVVVGGGDTASDCVGTAFRQGALSVTQLDIRAVPPMKEDKLAVWPYWPTKFRTSSSQAEGAEREFACATLGIEGRNGRVTGVKCARVDQKRQPIPGTEFVLRADLVFLAIGFAHAAHPGLIEQSGVVLDKRGNVQADDLAYATSVPKLFAAGDMRRGQSLVVWAIREGRQAAHAIDKELMGATTLPR

SEQ ID NO: 31821 - protein, 559 aa, Mesembryanthemum crystallinum
MGSTEFSWKLADHPKLPKGKTLAMVVLDGWGEASANQYNCIHVAETPTMDSLKQGAPEKWRLIRAHGKAVGLPTEDDMGNSEVGHNALGAGRIYAQGAKLVDLALESGKIYDGEGFNYIKESFETNTLHLIGLLSDGGVHSRLDQLQLLLKGSAERGAKRIRVHILTDGRDVLDGSSVGFVETLENDLAQLRAKGVDAQIASGGGRMYVTMDRYENDWSVVKRGWDAQVLGEAPYKFKNAVEAVKTLRQEPKANDQYLPPFVVVDESGKAVGPIVDGDAVVTLNFRADRMVMLAKALEYEDFDKFDRVRFPKIRYAGMLQYDGELKLPNRYLVSPPEIERTSGEYLVHNGVRTFACSETVKFGHVTFFWNGNRSGYFKPEMEEYVEIPSDSGITFNVQPKMKALEIAEKARDAILSGKFDQVRVNLPNSDMVGHTGDIEATVVACKAADEAVKMIIDAIEQVGGIYVITADHGNAEDMVKRDKKGQPAMDKNGNIQILTSHTLEPVPIAIGGPGLTPGVRFRNDIPTGGLANVAATVMNLHGFEAPSDYEPTLIEVVSN

SEQ ID NO: 31822 - protein, 427 aa, Coxiella burnetii
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLEAIKGYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 31823 - protein, 427 aa, Coxiella burnetii
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLGAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 31824 - protein, 111 aa, Zea mays
  misc_feature (10)..(10): Xaa can be any naturally occurring amino acid
PNVHEMSGSXVCFDVITQTWSPMFDLVKDLEVFLPKLLLYPNPSDPLNGEAAALMMRDKTAYEQRVKEYCEKYAKAEDIGAATEEKSSDEEMSDEEEYASSDEAVPGHPDL

SEQ ID NO: 31825 - protein, 427 aa, Coxiella burnetii
MTELTGVSIVTYQHIKVPSQGEKITVNKAVLEVPDRPIIPFIEGDGIGIDIAPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGRPWHVFENPKTGQKITIKDVIADAFLQQILLRPAECSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 31826 - protein, 279 aa, Candida albicans
MTKFRGCIDIHSGQVKQIVGGTLTQDDSASSKTSSAKENFVSTKPSSHYAQLYKDYNVKGCHVIKLGSNPANDDAAKLALSTWPHNLQVGGGINLDNAQYWLDQGASHVILTSWLFTKNEQDKMELDFGKLREISKLIGKEKLIVDLSCRTVIENGKTNWYVAMNKWQTITDTILSAEFLLKVSAYCDEFLIHAADVEGLCKGIDEKLVENLGEWCPVGFEEKIVYAGGAKSINDLDTVAKLSKGKVDLTYGSSLDIFSGKLVNFTDLVEWNKANSKTN

SEQ ID NO: 31827 - protein, 764 aa, Zea mays
MRNIGMLRALVLALAVAAAAAAEKRRTYIVHMAKSAMPAEYADHAEWYGASLRSVSASASAAKMLYAYDTVLHGFSARLTPQEASDLASAEGVLAVNPEARYELHTTRTPEFLGIAGQGLSPQSGTAGDVVVGVLDTGVWPESKSYDDAGLAEVPAWWKGQCEAGPGFDASAACNRKLVGARFFSKGYEAAMGPMDTDRESRSPLDDDGHGTHTSSTAAGAAVPGASLFGFAAGTARGMAPRARVAAYKVCWLGGCFSSDILAGMDAAVADGCGVLSLSLGGGAADYSRDSVAIGAFAATEQNVLVSCSAGNAGPGSSTLSNVAPWITTVGAGTLDRDFPAYVVLGDGKNYTGVSLYAGKPLPSAPIPIVYAANASNSTAGNLCMPGTLVPEKVAGKIVVCDRGVSARVQKGLVVRDAGGAGMVLSNTAANGQELVADAHLLPAAGVGETEGTAIKSYVASAPNPTATVVVAGTEVGVRPSPVVAAFSSRGPNMVTPEILKPDMIAPGVNILASWTGKAGPTGLAADTRRVGFNIISGTSMSCPHVSGLAALLRSAHPEWSPAAVRSALMTTAYASYSGGSSLLDAATGGMATPFDYGAGHVDPARALDPGLVYDLGTRDYVDFLCALKYSSTMIAAVARSREYACAENKTYSVGALNYPSFSVAYSTANGDGGGDSATVTHTRTLTNVGGAGTYKASTSLAAAKGVAVDVEPAELEFTSVGEKKSYTVRFTSKSQPSGTAGFGRLVWSDGKHSVASPIAFTWT

SEQ ID NO: 31828 - protein, 496 aa, Polaromonas sp. JS666
MTAAPDTPSDPLDLAEPGLKWGNSFARLGPGFYTELQPTPLPSPYWVGRSQALARELGLEDHWLESAEALEVLTGNRSTAGSRPLASVYSGHQFGVWAGQLGDGRAILLGDLQTPAGPQEIQLKGAGRTPYSRMGDGRAVLRSSIREFLASEAMHGLGIPTTRALCVTGSDAPVRREDIETAAVVTRTSPSFIRFGHFEHFSYSNQHDRLKTLADYVIDGFYPACREAKQPYAALLEAASERTARLMAAWQAIGFCHGVMNTDNMSILGLTIDYGPFQFLDAFDPGHICNHSDPQGRYAYNKQPNIAYWNLFCLGQALLPLIEDQEQALAALESYKTVFPQALEARMRDKLGLVETQAGDRELIESTFKLLASNKVDYTIFWRRLCGFTPQSGHESVRDLFFDRESFNAWALQYSERVAGVDQGVRANLMLKSNPKFVLRNHLGEEAIRAAKLKDFSGVNTLLGLLQAPFDEHPGHDSFSDFPPDWASSIEISCSS

SEQ ID NO: 31829 - protein, 517 aa, Staphylococcus aureus subsp. aureus Mu50
MSEEKHVVEHEQQKKEKTKKQYKPFWIVMSFIILIVVLLLPAPSSLPIMAKAVLAILAFAVIMWVTEAVSYPVSATLIIGLMILLLGFSPVQNLGEKLGNPKSGSAILAGSDLLGTNHALSLAFSGYATSAVALVAAALFLAAAMQETNLHKRLALLVLSIVGNKTRNIVIGAIIVSIVLAFFVPSATARAGAVVPILLGMIAAFKVSKDSKLASLLIITSVQAVSIWNIGIKTAAAQNIVAINFINHQLGFDVSWGEWFLYAAPWSIVMSVALYFIMIKVMPPEINTIEGGKDLIKEELHKLGPVSPREWRLIVISMLLLLFWSTEKVLHPIDSASITIIALGVMLMPKIGVMTWKHVENKIPWGTIIVFGVGISLGNVLLKTGAAQWLSDQTFGVLGLKHLPIIATIALITLFNILIHLGFASATSLSSALIPVFISLTSTLHLGDQSIGFVLIQQFVISFGFLLPVSAPQNMLAYGTGTFTVKDFLKAGIPLTIVGYILVIVFSMTYWKWLGLL

SEQ ID NO: 31830 - protein, 223 aa, Vibrio sp. Ex25
MELTVSVKIHYQNTHFITSAPDIRHLPEDEGVEIAFAGRSNAGKSSALNRLTNQKSLAKTSKTPGRTQLINLFKVEEGCHIVDLPGYGFAQVPVEMKNKWQKSLGEYLQKRECLKGLVVLMDIRHPMKDLDQQMIFWAIDSHIPVQVLLTKADKLKSGARKQTLLKVRKQVETFGGDVSVDVFSSLKGLGVDQLRAKLDTWFAPALAHLIEEGELDTPASDEE

SEQ ID NO: 31831 - protein, 284 aa, Polaromonas sp. JS666
MSITYKDAAGIEGMRLAGRLASEVLDYLTPFVKPGVTTNEIDRLAHDYMTQVQGTIPATLGYGPPGYVPYPKSLCTSVNHQVCHGIPNDKPLKKGDIVNIDVTVITKDGWHGDNSRMYLIGEASIAAKRLCKVTYEAMWQGIMRVKPGVRLGDIGFAIQAYAEKQGFSVVREFCGHGVGQKFHEEPQVLHYGRPGTLEELKPGMTFTIEPMINAGKRDIKDGPEKDGWSIVTRDHSLSAQWEHTILVSETGYEVLTVSAGSPAIPAFVADFVAQNNPAQVLVSA

SEQ ID NO: 31832 - protein, 726 aa, Oryza sativa Japonica Group
MTVTPQITVSDGRLAVRGRTVLTGVPENVTAAHASGAGLVDGAFVGADAGEAKSHHVFTFGTLRECRFMCLFRFKLWWMTQRMGSSGRDVPLETQFMLIEVPATAAGDGHDGGGDGEPVFVVMLPLLEGKFRAALQGNDDDELQICIESGDKAVQTEQGVNMVYIHAGTNPFDTITQAIKAVEKRMQTFHHRDKKKMPSFLDWFGWCTWDAFYTDVTADGVKQGLRSLANGGAPPRFLIIDDGWQQIGTEDDDTDEHPAVAVQEGAQFASRLTGIKENVKFQSKNGGAGEDTPGLRMLVEEVKGEHGVRQVYVWHAMAGYWGGVAPAPAMERYEAALAYPVQSPGVTANQPDIVMDSLSVLGLGLVHPRKVLDFYDELHAYLASCGVDGVKVDVQNIIETLGAGHGGRVALTRAYNRALEASVARSFPDNGCISCMCHNTDMLYSARQTAVVRASDDFYPRDPASHTIHVASVAYNTVFLGEFMQPDWDMFHSLHPAAEYHGAARAIGGCPIYVSDKPGNHNFDLLRKLVLPDGSVLRARLPGRPTRDCLFSDPARDGESLLKIWNLNNCGGVVGVFNCQGAGWCRVAKKTRVHDAAPGTLTGAVRADDVDAIAQVAGGDGGGWDGEAVVYAHRARELVRLPRGAALPVTLGALEYEECAVDAAAAVALRVRGCGRFGAYFSRRPARCALDGADVGFTYDGDTGLVAVDLPVPEQEMYRWNLEIHV

SEQ ID NO: 31833 - protein, 431 aa, Campylobacter coli RM2228
MYYCISFTHKNTDLSLRERLSFSDEAKKNEFLRLLSIHENIEECLVISTCNRVEIVAYVKEACAEYIIKSLALLCNVDKESLVQKADIFEDSGAIHHLFSVASSLDSLVVGETQIVGQLKDAFAFALKNNFCAVHLSRAIHSAFKCAAKVRNETQISKNPISVASVAVAKAKELLPLDGKSAIVIGAGEMGELAAKYLITAGARVIVLNRDMEKARILCERLGVLSECDSLNNLKKYLDEYELFFSATNAPNAIITNSLIDEVSHKRYFFDIAVPRDIDISENEKISVFAVDDLEVVVRKNLALREQEARMAYGIIGRETAEFFRYLNDLALTPIIKAIRLQAKECANKQLQIALDKGYLKHSDEEEARKLIHQVFKAFLHTPTMNLKHLQGKMQSDTVINAMRYIFDLENNLEGLNQYTCEFNMENNDEI

SEQ ID NO: 31834 - protein, 317 aa, Synechocystis sp. PCC 6803
MTIDNIRLRNEFINTEVITRSSGKKLGVVKEVLVDVDQREIVALGLRDNFLSLTGMPQYLYLNSIVQTGDVVLVENDDVFELVEVDLYSPLVNSEVVTETGEPLGRVRDFQFDLATGKVSSIIIASLGLPQIPDQLISTYELSIDEVVSSGPNRLIVFEGAEERLNQLSVGLLERLGIGRPSWERMEEDLYYPPTTRPENQLGSGIPVRPPVQVRQPEPVLEERWNEDDWQDTRPAPPPRREVAPLRYPEPEYEDDYEVDNWGEASSRSSAPEPDYDYEDGVAGDVWDDDEAPAPYSPPRVNIPETRREKMPEYYEE

SEQ ID NO: 31835 - protein, 231 aa, Legionella pneumophila str. Lens
MSISQNINKVRELITQTELSSNRQPNSVLLLAVSKEQSPELIREAFQQGIRHFGENYFQEAQEKILALRDLPICWHFIGPIQSNKTKGIAKYFNWVHSIDRNKTAKLLNQFRSEQLPPLNVCLQINLTGETTKSGIPPEHAIDLALEVKQLPNLQLRGLMTIPPQQNNMQTQYNLFLKLNQLKESINKALHLKMDTLSMGMSDDLVPAIKAGSTIVRIGRAIFGERKGKLL

SEQ ID NO: 31836 - protein, 262 aa, Legionella pneumophila str. Lens
MNISFIGYGNMAKAIACHLQKQNKYSLSAASPSLSAGISKENIRTHYDNKEVAKDANVIILAVKPAQMREVINEINPFISSGCLLVSVAAGLSLTWFAKYCKKGQAVVRTMPNTPAIVGFAATSMIANEFVNEKQKKWAEQLFSSIGITDWVKDEEDMDTLTALSGSGPAYVFLFLEAMINAGIQLGLEETVAKHFAIQTFSGSLQLAQHSQLSLTELRKKVTSPGGTTAAALEILHGDLDELIFSAMKAAKQKAHQLGKVE

SEQ ID NO: 31837 - protein, 283 aa, Solanum chacoense
MSKDVIEEGQAHHHGKDYVDPPPAPLLDMAELTKWSFYRAVIAEFIATLLFLYVTVATVIGHKKLNALDQCDGVGILGIAWAFGGMIFVLVYCTAGISGGHINPAVTFGLFLARKVSLIRAVAYIIAQSLGAICGVGFVKLFMKHYYNAEGGGANFVQPGYSKGTALGAEIIGTFVLVYTVFSATDPKRSARDSHVPVLAPLPIGFAVFMVHLATIPITGTGINPARSFGAAVIYGHEKIWDDQWIFWVGPMVGAMAAAIYHQFVLRAGAVKALGSFRSNQTN

SEQ ID NO: 31838 - protein, 427 aa, Coxiella burnetii
MTELTGVSIVTYQHIKVPSQGEKITVNKAVLEVPDRPIIPFIEGDGIGIDITPVMKNVVDAAAEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSTSQFGKAIIKHIL

SEQ ID NO: 31839 - protein, 478 aa, Oryza sativa Japonica Group
MAAAAAHHPLPHQQKAANLARTFTKLLRRKRADAVAAATAVGEPGVPDAAAASVVGDEYECSVEAAAAGVPSLSKLKLSGNLGAAYSLDAFFRNAAEKKAAGVAGVAVAQTSPQVAPDVAKDSLLANLFAGVSAVKAAYAQLQLAQFPYDAEAIQAADAALVAELTRLSDTKRRYLRDPAAAAKNAAAAGHTALYAHAEEQRHLLKTYQITARKLEGELRAKEAEADRARSSLTAELRAERAMEARLHPGAHPRSAGWDLAAAAAAVHPGVQLRRAGDTKFVFESYVAMKMFANFHRRDFNLSFLDEREFYDRRRFFEEFTELKAAPASAFLDARNARWGGFGKFLRAKYLSLVHARMETAFFGRLEQRGIVSAGPGFPESSWFADFAEMARRVWLLHCLFYAFDGGAEEDGASIFQVRTGARFSEVYMESVSDGRSDEAAAAAAEERVVGFTVVPGFRVGRTMIQCRVYLSRPGRRP

SEQ ID NO: 31840 - protein, 466 aa, marine gamma proteobacterium HTCC2143
MEKFDLIVIGSGAAGLTSAFTALGFGKKVLIVEKHKSGGECTWSGCIPSKGLINEAKAVYTARKFAEFKVDTAAILARVRATSESIYQHETPEVLEQAGAIFVTGPAIFESAKIITVNERRFQGKKIMIATGSSPLVPPIPGLDTVPYLTNDNFFEQQALPESMVVLGGGAIGMELSQAMNRLGVDVTVVEMMPEVMFREEPEFSAIVRQTLAAEGVKFLLGAKATLFENCEAGVRVHAEKDQKNIVIEARSLLVALGRSPNIDGLNLAAAGIEINKGIKVDERLQTTAKGVYACGDVAGPYLLSHMANFQGKIATMNALFPLRRKVSYEHVAWATFTDPEFARAGLTEAEAKEQHGDSIRVYHYDFDKLDRAKTKQGDMGRIKLITNRKGKVLGAHIIGERAGELIAEVQVVKTLGLNFAKLQGVIHPYPTYSDALRQIAQQVFLDNLLNHPVVRFFRSFSRSKK

SEQ ID NO: 31841 - protein, 908 aa, Ustilago maydis 521
MGVLAAQRSSARGLARATVAAQRWLSTASAARVATASSAASTQVECSKPRAAATPAVRSYSSAAARENAYDRETITRLLYSLASRKEVERYLRIFSAADKFAVIKVGGAILTHQLEELALSLSFLHRIGLYPIVLHGAGPQLNELLEKEGVEPDYIDGIRITDAKTLKVARRIFLEENMRLVEKLESLGSRARPIPIGTFTAEYLDKDKYGLVGKINKVDKEPIESAIRAGCLPILTSLAVTNDGQILNVNADVAASELSKTLEPLKIVYLNEKGGLYHGKTKELMEVINLDEEYADLMKEEWVKYGTKLKLREMKELLDHLPRSSSVAIISVDQLQKELFTDSGAGTLIRRGYKLYRKNSIEEVGAERIRQVLKENDDEIKDGRKSVAEFFSEISQHPYTVYGDEPFDCVAFVSQPEGEVAILQKLVTTRNGVLNGVNDNIWKQIRRDHKRLVWTSRADDDQRAWHYERADGSFTRNGRSLFYYGIHDVAEVESIVRNLEEKSRIERAYLPLKPAKPSSPSGTRAYSTMSRPGLTSWRMMAGSRRGYATAVERSARIPASTTEKKRVALIGARGYTGQSLIALLNNHPHIQLSHVSSRELAGMPLKEYTKAHVNYTNIGVEDLKKLERGEGPGAPPDAYIMALPNGVCKPFVEAVQEGGKNKRNGHGVIVDLSADYRFQDEWTYGLPEIYGRRQVRGSKLISNPGCYATNNQALIAPLLPVLDRSAGPTVFGVSGYSGAGTKASETPTGERKTVPKISADDLAGGIRAYALTDHIHEREATYHLSRLSADAVKVAFIPHVAPWFQGIISTVSAPLNQKMSSKQIKQLYADFFANEPLVKIQDQVPEIKDIQLQHGIKLGGFQVHSDAKRVVVVGVIDNLLKGAATQCLQNLNIALGYDETAGIPHLQ

SEQ ID NO: 31842 - protein, 327 aa, marine gamma proteobacterium HTCC2143
MEINTSAINWQEMINNAWERRKPLWQDSNVDCFRVFHGYEEGSRGTVVEKFNDAAVIDYKRDIRDELPELAQALLSVFPFKNIVARGHQSLGLTLKERFIILHGTDTSAICNENDLRFMVKLDTPHNPGLYLDARDSRDWLIKNSANRRILNLFAFTGSLGLSSAFGKAAEVIHLDRSKELLPRIQENYKINQVNFETRNFLRGDIYKHLPRAIKAGKRFDGIILDPPPKVYQSRYAQHKTNGQDFSALIKYCTQLLNPGGWILGMLHRFDCSWDDFEEQVIEASGHALLPQHRLTSGIDFPESLPDKKLRVSIFVEKNDPMKKDGT

SEQ ID NO: 31843 - protein, 492 aa, Bordetella bronchiseptica RB50
MRISMGKITGFMEFQRLQEAAEAPQKRLKHWREFVLHLNDEQAKQQAARCMDCGIPFCSNGCPVNNIIPDWNDLVYRQDWRRALDVLHSTNNFPEFTGRICPAPCEAACTLNINSDAVGIKSIEHAIIDKGWAEGWVTPQVPVRKTGKKVAVVGSGPAGLACSQQLARAGHSVTLFEKSDRIGGLLRYGIPDFKLEKSQIDRRIAQMEAEGVEFAPSTYIGNPDDAAADGLTVRTPQSLLADFDAVVMTGGSETPRDLPVPGRELSGVYYAMDFLRQQNKAVAGDRLSGQTLAKDKHVVVIGGGDTGSDCVGTSNRHGAASVTQFELLPQPPECEDKPMVWPYWPLKLRTSSSHDEGCERDWSVATKALAGSDGQVEKLVGVRVEWFKDEATGQMKMREVEDSEFEIPADLVLLAMGFVSPVATVLDAFGVDRDARGNVRANTDDYRTNVDKVFAAGDMRRGQSLVVWAIREGRQCARSVDEYLMGTSELPR

SEQ ID NO: 31844 - protein, 528 aa, Oryza sativa Japonica Group
VIDGAGRRRRRRGGSGGLDVAVDGAVQLVWRPYAVARAFGRQRIRGPAYRLFVGSDGEANAMRAATRGDVLDRRCHDIVPRVMPHYRAWMSRYGKVFVSWSGATPALCVGDYAMVKQILSDRTGLYGKPEPEPSILALIGNGLIFIGGDDWARHRRVVHPAFAMDKLKMMAKTMADCAREVIREWEARATADGERRVQVEVGGQLQELTADVISHTAFGSSYREGKEVFVAQRELQSIAFSAINSTRFPGSQYIPTKTNLRRRHLAKKVRGTLMAIIRERQAAAAKEDSGHGNDLLGLMLEANATDACGSGGEKSMTMDEIVDECKTFFFAGHDTTSHLLTWAMFLLGTHPEWQHRLREEVLRECGGGGDTEALPNGDALNKLKLMTMVLYETLRLYGPVSLMARTATADAELGGVRVPKGTMTMIPMAILHRDADVWGAGAGEFDPLRFRGGVNKAAAHAGALLAFSLGQRSCIGQDFAMMEAKTTLAMILRRFAFEVSPEYVHAPLDLLTLQPKCGLPMVLKLLDQ

SEQ ID NO: 31845 - protein, 410 aa, Xanthobacter autotrophicus Py2
MRGPRRGRNPMNIHEYQAKALLKEFGVPVSRGLAAFTPQDAEAAAAKLGGIAFVVKAQIHAGGRGKGKFKELPAEAKGGVRVVKTAADVKANAAEMLGNTLVTIQTGPDGKQVNRLYIEEGASIDKEFYLSMLVDRATARVAFVVSTEGGMDIEEVAHATPERIVTFSVDPATGVQPLHGRKVAQALGLSGDLAKQAVALTANLYRAFTDKDMSLLEINPLVLTRDDRLVCLDAKVGFDSNALFRHPEVVQLRDESEEDFKEIEASRYDLSYIALDGTIGCMVNGAGLAMATMDIIKLYGREPANFLDVGGGATKEKVTAAFKIITADPNVEGILVNIFGGIMRCDVIAEGVIAAVRQMGLNVPLVVRLAGTNVEEGKKIIRESGLNVIPADDLDDAAQKIVAAVKKEAA

SEQ ID NO: 31846 - protein, 75 aa, Fragaria x ananassa
VLIHNGKPVCESVIALQYIDEVWTNKPLLPSDPYLRSQARFWADFVDKKIYDFGRKTWTTKGDEQEAAKKEFIDC

SEQ ID NO: 31847 - protein, 424 aa, Chlorobaculum tepidum
MNIISVGVNHKTAPIEIRERIALSEVQNKELVTDLVSSGLASEAMVVSTCNRTELYVVPGMPEVNCDYLKDYIISYKNARNAVRPEHFFSRFYCGTARHLFEVSCAIDSLVLGEGQILGQVKNAYRIAAEVGTAGILLTRLCHTAFSVAKKVKTRTKLMEGAVSVSYAAVELAQKIFSNLSMKKVLLIGAGETGELAAKHMYAKNARNIVITNRTQSKAEALAEELGTNRVLPYESYKEHLHEFDIIITAVSTKEYILNAAEMQQSMAKRRLKPVIILDLGLPRNVDPEVGALQNMFLKDIDALKHIIDKNLERRRAERQSDAALRIGDAVEHRQALDRADDELRSAAESSVHILVAERPRHVGELADQPLIDVVSRFDDAPNGFIAGNEGKDKRRRRDQAVEGHFLCAGTDGRPPGFDQHIGR

SEQ ID NO: 31848 - protein, 427 aa, Coxiella burnetii
MTELTGVSIVTYQHIKVPSEGEKITVNKAVLEVPDRPIIPFIEGDGIGIDITPVMKNVVDAAVEKSYAGKRKIEWMEIYAGEKATKAYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSASQFAKAIIKHIL

SEQ ID NO: 31849 - protein, 534 aa, Porphyra yezoensis
MKKKIVHPIVLAILDGWGHTNIQQGNAIKIAKTPTIDSLIQAYPSTLLAASGQEVGLPKGQMGNSEVGHTTIGGGRVIQQELVKIGNSIVDNSFFNNLELNEACEYANNNKASLHLIGLCSNGGVHSHIDHLLALIDLADSKQVTNLYLHLITDGRDTSSNSAKYFIKIVADHIEHKQFATISTISGRYYAMDRDFRWSRTQAAYNILTSNNSIKLNASVNYGDLIDHYYNKGISDEFIPPSRINLGSIKDNDAIVFFNFRPDRMRQIVQAFVQKPFNCFATKPLYNLRVVTFTNYDTSLNTTIAFHPHILNNFLGEVLYKYGLKQFRVSETEKYAHVTYFFNGGAEEPFPGEDRELVSSPDVTTYDLSPDMSAELVTQKSISAIKKAIYSCIVINYANADMLGHTGKLKETIQSIETVDRCITELLDAVSKLNGTLIITADHGNAECMFTDEGNPCTAHTTNLVPLILIEGEQEAISGHGGQVKLRNNGSLADIAPTILDILHLKKPPEMTGKSLIINSRYETRNIEKTSIEL

SEQ ID NO: 31850 - protein, 449 aa, Oryza sativa Japonica Group
MRRMLRCFFGGGGDETGGDEEKKASAAAVVKNKKAVRRMRSATGRLRSLSLEDLSRTLAQSGLQAFTLAELKAATRSFSGSNFIGEGGFGPVYKGFIDAKLRPGLLQPQHVAVKYLDGEGDQGHREWLAEVVYLGMLSHPHLVKLIGYCCQDDHRMLVYEYMARGSLEHHLFKNLLSSLPWATRLKIAVGAAKGLAFLHDADTPVIYRDFKASNILLDSDYTAKLSDFGLAKEGPQGDATHVTTRVMGTHGYAAPEYILTGHLTAKSDVYSFGVVLLELLTGRRSVDKRRRGREQNLVDWARPYLRRPERLHRVMDPSLEGGYSDKAAGKAAMVAYHCLHSVPKSRPHMRDVVAALEPLLQTSCGDVLAGPFVYTVPSAAAVVVAAKDDGKKAAAAAGEDGEEEVAAAAKAKRRYVASAVHAEGAMRKGEHRYASSVSGSPRQSRDRGG

SEQ ID NO: 31851 - protein, 519 aa, Oryza sativa Japonica Group
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 31852 - protein, 279 aa, Staphylococcus aureus subsp. aureus Mu50
MLNEIQILNNGYPMPSVGLGVYKISDEDMTKVVNAAIDAGYRAFDTAYFYDNEASLGRALKDNGVDREDLFITTKLWNDYQGYEKTFEYFNKSIENLQTDYLDLFLIHWPCEADGLFLETYKAMEELYEQGKVKAIGVCNFNVHHLEKLMAQSSIKPMVNQIEVHPYFNQQELQEFCDRHDIKVTAWMPLMRNRGLLDNPVIVKIAEKYHKTPAQVVLRWHLAHNRIIIPKSQTPKRIQENIDILDFNLELTEVAEIDALDRNARQGKNPDDVKIGDLK

SEQ ID NO: 31853 - protein, 220 aa, Oryza sativa
MSDAQAQPIRPGDVYPPSAADHHQARRERDKAVAADQGGGGGDLRVTEADLPAAGKRVVTATAGGQVMAQFTVPVPSAEEETTDAVTIGEALQAAGSDDNEPVGLADAAAVQAAEMRTTGLAGVVPGGVAAAAQQAAEANMRRRPDGDDGENKATTTTLMKDVVGGAAEALPADMVATREDADRVAAAAARNAARRGGGGGKGVAEAVAAAAEMNEGRMV

SEQ ID NO: 31854 - protein, 478 aa, Bradyrhizobium japonicum USDA 110
MTFVARHALWSDEQKDAAQRMRRIVEEKNLEVIRLAFPDQHGILRGKTIIAAEAIASLESGCSITTTMLAKDTSHRTVFPVFTSGGGFGMKEMEGAADVLMVADPTTFRVLPWAPTTGWVLCDLHFNDGRPVPFATRGLYRKVLDELAGRGHDFVAGLEVEFHIFKLDDPHMRAEDAGQPGTPPSVSLLSHGYQYLTEQRFDQMEPVLEILRRDVVALGLPLRSVEVEFGPSQCEFTFAPRKGLEPADNMVLFRSAVKQIARRHGYHATFMCRPKLPNLFASGWHLHQSIVSRTSGENQFMAQAGGEPLSAFGRAYLAGLLDHARASAVFTTPTINGYKRYRSYSLAPDRAIWGRDNRGVMIRVLGAAGDAATRLENRIGEPAANPYLYMASQILSGLDGVDRKLDPGPSADTPYETKAPLLPKSLRDAVAALKEDPFFREKFGAEFVDYYTHIKNAEIDRFLAEVTDWEHREYFEMF

SEQ ID NO: 31855 - protein, 344 aa, Thiomicrospira crunogena XCL-2
MTIANKPLTIAVLGAGAWGSALAIHLSRIGHQVKLWDHNPENAATLESARENVRYLKGVPFPDALSVQSDLKVTLADVDAVLMVVPSQAFREVLQKMHHIMMGSKSHYHLAWATKGFEPETSLMLHEIVQQELGEQISFAVLSGPTFAAEVARGLPTAMVSASRDQQEAQFWADAFHCDTFRMYTQSDVVGVEIGGAYKNIMAIATGLSDGLRLGANARAALIGRGMVEMMRFGDALGAKHETMMGLSGLGDLVLTCTDDLSRNRRFGLMLAQSQRPAEDVIEEIGQVVEGVKAVKAVKLIADKYQLDLPIMEQVYNIIVGQSTAEQAVKELMRRHGRSELEFG

SEQ ID NO: 31856 - protein, 521 aa, Thiomicrospira crunogena XCL-2
MTKAVQIKNRPTGLIILDGWGHREATQHNAIAQAHTPNWDNLLKDYHHTLINTSGLAVGLPEGQMGNSEVGHMNLGAGRVVYQELTRIQKDIDDGRFFENNALVKAIDAASNRDHKVHILGLLSDGGVHSHISHIKASIKMAHDRGAKVYVHIFTDGRDTAPQSALQYIEELETFMKELGGGRIASVTGRYFALDRDNRWERVKKAYDAIACGSAEFEAKDAKEAVELAYARGENDEFIQATVIPRNNGKPARVKDGDSVIFMNFRSDRARQLTEAFIMDDFADFHRCKTPVLSAFVTLTEYKKNFEKFGALVAYRPTSLRNTFGEYVSKKGLKQLRIAETEKYAHVTFFFNGGVEEPNDNEVRILINSPQVATYDLQPEMSLPELKEKLIDAIKSGEYDTFICNIANPDMVGHTGDFNACVQAAEAVDEALGEILATIKAVDGEAIVTADHGNMEMLFNEETGKPLTSHTTFPVPFVYFGKKGYPLKDGGALCDVIPTLLDMMGIEKPEEMTGTSLIDKA

SEQ ID NO: 31857 - protein, 365 aa, Aspergillus niger
MAEFVRAQIFGTTFEITSRYTDLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAACIFAEMLEGKPLFPGKDHVNQFSIITELLGTPPDDVIQTICSENTLRFVKSLPKRERQPLASKFKNADPDAVDLLERMLVFDPKKRIRAGEALAHEYLAPYHDPTDEPVAEEKFDWSFNDADLPVDTWKIMYSEILDFHNIDQANDAGQVLVEGAVADGQQAFA

SEQ ID NO: 31858 - protein, 470 aa, Thiomicrospira crunogena XCL-2
MGNVRQFLELDRQLPSKKDAMERKGNFEEIYTEFDPQRAMAQADRCLHCGNPYCEWACPVHNYIPNWLKLVSEGNIIEAAELSHQTNSLPEMCGRICPQDRLCEEACTLEDTNFGAVTIGAVEKYITDTATDMGWTPTLDNVTMTDKKVAIIGSGPAGLGCADILIRNGVKPIVFEKEQEIGGLLTFGIPQFKLDKDIVVKRRKILEGMGVEFHCNTEIGKDIAFDTLLSDYDAVFLGMGTYKPMAGRFPGEDLPQVYKALDFLIGNVKNELKMEQRPEPFVSMKGKRVVVLGGGDTTMDCTRTSIRQGASEVYCVYRRDEENMPGSRAEVKNAKEEGVQFKFNLAPVEVIEKDGQVAGIKVIQTRMGEPDENGRRRAEMVEGSETIIDCDAVIVAFGFQPSPPEWFNDFDINLTDWSTVVAEEESEFPFQTSNPKIFAGGDMVRGSSLVVHAIAEGRKAAEGILDYLDV

SEQ ID NO: 31859 - protein, 475 aa, Bacillus subtilis subsp. subtilis str. 168
MNLQENSSQQLKRTMKSRHLFMISLGGVIGTGLFLSTGYTLHQAGPGGTILAYVIGGLMMYLVMQCLGELSVANAVTGSFQKYATTFIGPSTGFMVGIMYWINWVVTVGSEFTASGILMQRWFPDSSVWMWSAIFAALLFICNAFSVKLFAETEFWFSSVKIVTIILFIILGGAAMFGLISLNGTADAPMLSNFTDHGGLFPNGFLAVFIAMISVSFAFSGTELIGVTAGESANPQKDIPRSIRNVAWRTVIFFIGAVFILSGLISWKDAGVIESPFVAVFAEIGIPYAADIMNFVILTALLSVANSGLYASTRMMWSLANENMISSRFKKVTSKGIPLNALMISMAVSCLSLVSSIVAPGTVYVVMVAIAGFAGVVVWMSIALSQLLFRKRFLKKGGDVKDLTFRTPLYPLMPIAALLLCSASCIGLAFDPNQRIALFCGVPCIILCYLIYHFKRNVTKAKKISQEEYPADHIL

SEQ ID NO: 31860 - protein, 278 aa, Wallemia ichthyophaga
NSLVIKHLRHENIISLLDVFISPGEDIYFITELLGTDLHRLLSSRPLERQFVQYFLYQMLRALKFVHPAGVVHRDLKPSNILINENCDLKICDFGLARLQDPQMTGYVSTRYYKAPEIMLTWQEYDSAVDIWSVGCIFAEMIDGRPIFPGKDHVHQLTVITELLGSPPEDVINTITSENTRRFVDALPKRHKISFADRFPNANAEEIDLLEKMLDFNPKKRITAADALAHPYLAPYHDPEDEPTANERFDWSFNDADLPTDQWKVMMYCRDLNRIPAA

SEQ ID NO: 31861 - protein, 369 aa, delta proteobacterium MLMS-1
MSFAQFDFDATLTANIAACGYQAPTPIQTQAIPEIRRGRDIMGLAQTGTGKTAAFVLPLLQKLSAGPRGRVRAVIVAPTRELAEQIHVNIGELGRQTGIRSVAVYGGVSKFGQLKAFKAGVEIIVACPGRLLDHLDSRDVNLGAVEMLVLDEADMMFDMGFMPAIKKLLKYLPAKRQNLLFSATMPAEIRHLADSILKDPARVQINHTQPTALVAHKLYRVEKQGKGALLKQVMQESAFSSALVFTRTKHAAKKLALNLEKAGHRAVALQGNMSQNKRKAAMEGFKQGRFNIMVATDIAARGIDVAGISHVINYDMPATVEAYTHRIGRTGRAERNGEAYTFATAEDKVIVRQIERAIGSQMITLETPR

SEQ ID NO: 31862 - protein, 278 aa, Wallemia muriae
GRGNSIKHLRHENIISLLDVFISPGEDIYFITELLGTDLHRLLSSRPLERQFVQYFLYQMLRALKFVHPAGVVHRDLKPSNILINENCDLKICDFGLARLQDPQMTGYVSTRYYRAPEIMLTWQEYDSAVDIWSIGCIFAEMIDGRPIFPGKDHVHQLTVITELLGSPPEDVINTITSENTRRFVDALPKREKIPFQQRFPNANEEEIDLLEKMLDFNPKERITAADAIQHPYLAPYHDPSDEPVANERFDWSFNDADLPVDQWKVMMYSEILITSEF

SEQ ID NO: 31863 - protein, 278 aa, Wallemia sebi
GRGNSIKHLRHENIISLLDVFISPGEDIYFITELLGTDLHRLLSSRPLERQFVQYFLYQMLRALKFVHPAGVVHRDLKPSNILINENCDLKICDFGLARLQDPQMTGYVSTRYYRAPEIMLTWQEYDSAVDIWSVGCIFAEMIDGRPIFPGKDHVHQLTVITELLGSPPEDVINTITSENTRRFVDALPKREKIPFQQRFPNASEEEIDLLEKMLDFNPKERITAADAIQHPYLAPYHDPSDEPVANERFDWSFNDADLPVDQWKVMMYTEILITSEF

SEQ ID NO: 31864 - protein, 387 aa, Mycobacterium sp. MCS
MSNTSETRSGSRIDGAVALLVLEDGRVFTGVPYGAVGQTLGEAVFSTGMSGYQETLTDPSYYGQIVVATAPQIGNTGWNHEDAESRDDRIWVAGYAVRDPSPRASNWRATGTLDEELVRQGVVGIAGIDTRALVRHLRTRGAMKAGIFSGDESAAPMSELLERVRSQPGMLGASLADKVSTDDVYIVEPEGAHRFTVAAIDLGIKTNTPRNFARRGIRSHVLPARATFEQIADLKPDGVFLSNGPGDPAAADHVVEVTREVLGAGIPLFGICFGNQILGRALGRGTYKMVFGHRGINVPVMDHATGRVAITAQNHGFALEGEAGERFDTPFGAAVVSHTCANDGVVEGVKLVNGRAFSVQYHPEAAAGPHDANYLFDQFVDQMSEEK

SEQ ID NO: 31865 - protein, 370 aa, Legionella pneumophila str. Lens
MINKSAILALADGTVYEGLSVGAIGESVGELVFNTSMTGYQEMLTDPSYARQIITLTTAHVGNTGCNMEDMESTKVWAAGLVMRNCTAVPSNFRAEQSFPDWLSKNGVVAISGIDTRALTLKLREKGSIGACISTNVEKPEIAVAKAKSFAGLQGADLALEVTRQTIERWHEGRGMWSLDKQPQQLHVVAYDFGVKHNILRILHDKGCHITIVPAKTSAEEVLAMNPNGVFLSNGPGDPQACDYAIKATQVFLDNNIPLFGICLGFQILALACGGITKKMKFGHHGSNHPVVETTGKKGVFITSQNHGFAVDEDSLPDCLEVTHRSLFDNSLQGIRHKTKPAFGFQGHPEASPGPHDIDILFNEFVNLMK

SEQ ID NO: 31866 - protein, 278 aa, Sinopodophyllum hexandrum
MGSTSTPASSTNRLQDKVAIITGGAGGIGETTAKLFVRYGAKVVIADISDDHGQKVCNNIGSPDVISFVHCDVTKDEDVRNLVDTTIAKHGKLDIMFGNVGVLSTTPYSILEAGNEDFKRVMDINVYGAFLVAKHAARVMIPAKKGSIVFTASISSFTAGEGVSHVYTATKHAVLGLTTSLCTELGQHGIRVNCVSPYVVASPLLTDVFGVDSSRVEELAHQAANLKGILLRAEDVADAVAYLAGDESKYVSGLNLVIDGGYTRTNPAFPTALKHGLA

SEQ ID NO: 31867 - protein, 886 aa, Xanthobacter autotrophicus Py2
MTKWVYTFGDGKAEGKADMKNLLGGKGANLAEMSNLGLPVPPGFTIPTEVCTYYYAHGQTYPAELKGDVEAALAQVGQLTGKSFGDAANPLLVSVRSGARASMPGMMDTVLNLGLNDETVEAVARLAGDRRFAYDSYRRFITMYSDVVLGVSHHHFEEILEHYKLQKGFNLDTELSADDWAALVVKYKEKVAAELGKPFPQDPHEQLWGAIGAVFSSWMNARAITYRRLHSIPESWGTAVNVQSMVFGNMGETSATGVAFTRNPSTGENALYGEFLVNAQGEDVVAGIRTPQDLTEKARKTAGSDKPSMELALPEAFKEFERISHVLENHYRDMQDLEFTVEKGKLWMLQTRSGKRTAKAALRIAVELAAEGLITEEEAIGRVDPAALDQLLHPAIDPKAERKVIATGLPASPGAAAGAIVFTADEAEAAKEKGQKVILVRVETSPEDIHGMHAAQGILTARGGMTSHAAVVARGMGKPCVSGAGSLRIDAAAQTLTVNGQVFKKGDHITIDGGTGQVLSGEVAMLQPELSGEFATLMGWADKVRKLKVRANAETPADARMARSFGAEGIGLSRTEHMFFDAGRILAVREMILADDEAGRRAALAKLLPMQRDDFVELFEIMKGLPVTIRLLDPPLHEFLPHTAEETEEVAKSLGVDVERIERRNKELHEVNPMLGFRGCRIAIAFPEIAEMQARAIFEAAIIAAKKTGEAVVPEIMVPLIATKAEFDIVDAVIRKTADAVEKETGAKLTFQVGTMIELPRAALRAEEIAKGAEFFSFGTNDLTQTTFGVSRDDAGTFLGPYVQKGIIEVDPFVSIDVDGVGELVKIGVERGRKSRPDIKLGICGEHGGDPASVAFCHEVGLNYVSCSPFRVPIARLAAAQAALKK

SEQ ID NO: 31868 - protein, 427 aa, Coxiella burnetii
MTELTGVSIVTYQHIKVPSEGEKITVNKAVLEVPDRPIIPFIEGDGIGIDITPVMKNVVDAAVEKSYAGKRKIEWMEIYAGEKATKVYGKDNWLPDETLEAIKEYQVAIKGPLTTPVGGGIRSLNVALRQQLDLYVCLRPVRYFTGVPSPVKTPEKVNMVIFRENSEDIYAGIEWPAGSPEAVKLINFLQNEMGVKKIRFPETAGIGIKPVSKEGTSRLVRRAIQYAIDNDRDSVTLVHKGNIMKFTEGAFKDWGYEVAVKEFGAKPLDGGPWHVFENPKTGQKITIKDVIADAFLQQILLRPAEYSVIATLNLNGDYISDALAAEVGGIGIAPGANLSDTVGLFEATHGTAPKYAGQDKVNPGSLILSAEMMLRYLGWKEAADLVVQGIEGAIESKTVTYDFARLMTGAKEVSASQFAKAIIKHIL

SEQ ID NO: 31869 - protein, 828 aa, Oryza sativa Japonica Group
MRPQSYAFLGLVLLLFSLLPLAPCSAANLNNDTLLAGQALAVGDKLISNNGKFTLGFFQPDAGTSKSSDTSTNSPGWYLGIWFNKIPVFTTVWVANRERPITIPELNLTQLKFSSDGNLVIFNHATESIIWSTRVIIDSHRTQETSSTNTSVVLLNTGNLVIESTTNVVLWESFDSPTDVVLPGAKFGWNKITGLNRQCISKKSLIDPGLGSYSVELDTNGTKGVILMLRNPPKVYWYGLTSPTLIPELRSLLAMDPRTRGLIIPTYVDNSQEEYYMYTLSNESPSSFLSLDMSGQIMLNVWSEANQSWQIIYAQPADPCNPFATCGPFTICNGNSNPVCECMESFTRKSSQDWDLGDRTGGCSRNTPLDCTISGNRTSSADMFHPIAHVKLPYDSESIQDATTQSKCAQACLSSCSCTAYSYQNNICSVWHGDLFSVNQNDGIENHFDDVLYLRLAAKDLQSLSKNKRKPIVGVVTTISIIILVLLIMLMVLVMVWRNRFKWCGVPLHRSQGGSGIIAFRYSDLDHATKNFSEKLGEGGFGSVFKGVLRDLTVVAVKRLDGARQGEKQFRAEVSSIGLIQHINLVKLIGFCCQGDKRLLVYEHMLNGSLDTHLFQSNATILTWSTRYQIAIGVARGLSYLHQSCHECIIHCDIKPQNILLDESFTPKIADFGMAVFVGRDFSRVLTTFRGTVGYLAPEWISGVAITPKVDVYSYGMVLLEIISGMRSLPNVHSSNSHHAAYFPVQAISKLHEGDVQSLVDPRLSGDFNLEEAERVCKVACWCIQDNEFDRPTMGEVVLVLEGLQEFDMPPMPRLLAAITRSSNVAEM

SEQ ID NO: 31870 - protein, 113 aa, Brassica napus
  misc_feature (9)..(9): Xaa can be any naturally occurring amino acid
  misc_feature (20)..(20): Xaa can be any naturally occurring amino acid
SQEHFVTLXDLMLTEHEGGXRLSNRLFYLSIPPNIFVDAVKCASSSASSISGWTTVIVEKPFGRDSKTSAALTKSLMQYLEEHHIFRIDHYLRKDLVQNFSVLRFSGLIFEPL

SEQ ID NO: 31871 - protein, 457 aa, Clostridium thermocellum ATCC 27405
MYDLQRKDLEYIWHPCSQMKDYEDFPPIVIERGEGPYIFDVLGNRYIDAVSSWWVNLFGHCNKRINDAVKRQLDSLEHVIFANFSHRPAIELAGKIVEITPQGLNKVFFADNGSSAVEIALKLSFQYHLQTGSCEKKKFVALSDAYHGETLGALAVGGLDLYSKIYKPLMMSTIKVPGPDCYRCKYGKERTCCEAECFCEMEKILEEKHREICGVIIEPMVQAAAGMKIYSAKYLIKLREACSYYNIHLIADEIAVGFGRTGKMFACEHGGISPDIMCLSKGLTAGYMPLSLVVTTQKIYDAFYSDYIELKAFLHSHSYTGNPLACAAALESLKIFEDDDVLNKNREKSGLFRKLAESLAHSHPYVGEFRQIGMIAALELVENKAQKKEFDWKKRVGYNIYKLALKKGLLLRPLGNVLYFMPPYVVGQKDIEDIVSGAFYAINEYFGLDFKYKRMFP

SEQ ID NO: 31872 - protein, 813 aa, Oryza sativa Japonica Group
MPSLYIFLGLLLFSLQAPPCPAATDTLKAGQVLSAGDKLVSRNGKFALGFFNPSANISKSSDNISSSWYIGIWFNKIPVFTVVWVANRERSIAEPDFKLTQLKISQDGNLAIVNHANESIIWSTRIVNRTEASMNTSVLLHDSGNLVIQSTSNAVLWQSFDYPTDVALPNAKIGWNKVTGLNRVGVSKKSLIDMGTGSYSVQLYTNGTRRVTLEHRNPSIEYWYWSPDESGMKIPALKQLLYMNPQTRGLVTPAYVNSSEEEYYSYNSSDESSSTFLLLDINGQIKFNVWSQDKHSWQSLYTQPVDPCRSYDTCGPFTICNGNSQPFCDCMENFTRKSPRDWDLGDRTGGCSRNSPLDCTRNTSSTDIFHPLIHVTLPRNPQTIQEATTQSECAQACLSSCSCTAYSYQNTSTCSIWHDELFSVNQDDGIEIHSQDVLYLRLAAKDLQSLRNNKRKPNVAVVIAASVIGFVLLMVGMFLLIWRNRFEWCGAPLHDGEDSSGIKAFRYNDLVHATKNFSEKLGAGGFGSVFKGMLIDLTTIAVKRLDGDRQGEKQFRAEVSSIGLIQHINLVKLIGFCCEGRKRLLVYEHMLNGSLDAHLFQSNAGTLNWSIRYHIALGVARGLGYLHQSCHACIIHCDIKPQNILLDASFTPKIADFGMAAFVGRDFSRILTTFRGTVGYLAPEWISGVAVTPKVDVYSFGMVLLEIISGRRNSPNEYTSDNYHVSYFPVQAINKLHEGDVRNLVDPQLCDDFSLEEAERVCKVACWCIQDDEHDRPTMSEVVRVLEGMQELEMPPMPRLLAALTKCSDVGSI

SEQ ID NO: 31873 - protein, 310 aa, Oryza sativa Japonica Group
MSETDSSAAAAEGRKPRRLRGHKKGAVTCCVASSSRPGVVASSGEDGCLCWFDLRTKDVLFTMEATNQPISSVCFKAGNEDLVYASAGNEILSFDVRMIAVSSKGFLAAADDSGDVKISELPCFGAIEGSPEMQNGSSGGQCFNPPFVHSIAVSEEGILGGSYKVCAVARGDGAVDVVDLEYELAPAKSKGLPRMADLSLSSKRTDLGDGCGSQSQGNRIHLDYTVGGHTSSVSCVTFSAFGEKGKFLVSGGNDSSIKLWDWSKGFSSETNNSAELVLDIKVNWLCTTPTDSDNLIVCDTSKVVKVYNLP

SEQ ID NO: 31874 - protein, 384 aa, Burkholderia pseudomallei K96243
MPTTPTLLSRLPEVGTTIFTVMSALAAEKGAVNLGQGFPDFDCDPRIVDAVAHAMRDGRNQYPPMAGVAPLREAIADKIERLYGRRYDAATEITVTAGATQALLTAILCAVHPGDEVIVIEPTYDSYLPSIELAGATPVFVTLNAPDYAIPFDKLAAAITPKTRAILINTPHNPTGTVWREADMRALEDIVRGTGLLIVSDEVYEHMVYDGARHESVARYPELAARSIIVSSFGKTFHVTGWKIGYVAAPAPLTAEFRKVHQFNVFTVNTPMQFGLADYLRDPEPYLTLPAFYQQKRDFFRAGLANTRFALLPCAGTYFQCVDYSAISDLPEAEFAKWLTTEIGVAAIPVSAFYHEPHESGVVRFCFAKREDTLATALERLARL

SEQ ID NO: 31875 - protein, 373 aa, Legionella pneumophila
MNALTSWIKAWSQKFFPNQKKNENKEEEADLTQEKKVRPNADFYENYFSLVAAGTRLKLIEAMFGVNLFSLFENKVWVFEKDIIEKLQLMPIRARKWLHLLSSEHFLIHIKVNGQQAYQLPEEFIELIHSEEFPAMEMFFKTWLVSTEENLTDVLRFGKVKTSVSWPPKTQQEAEWLEDWMTRTSDQPTYCLLQSINFKKVNKLLDVGGGDGTMACTFVKKYPHLKAAVYNLPMSAEMAKKNIESRKLNHRVHVIEGDFIEEDAFPLGYDLILFTRVLFDWDDQVCRKLLRMAYQALPKNGLVGICEFYKEDNNDICLASEYRYIFHDDFGVNLMKRASEYQNMLEKIGFTIVQPHKVKGMHFYYCSLILAQK

SEQ ID NO: 31876 - protein, 262 aa, Oryza sativa Japonica Group
MSAAAAATDGTYSPAAAAGEKRRERKEELRRHLAEDADWPRADGRSFHDCRPAFMQTGPTTAASGSAYAEFGKTKVIVSVFGPRESKKAMLYSDTGRLNCNVSYTTFATPIRGQGMDNKEYSAMLHKALEGAVMLHTFPKTTVDVFALVLESGGSDLPIIISCASLALADAGIMIYDLVTSVSVSCFGKNIIIDPTSDEEAWQDGSIMVAYMPARKEITQLTLTGEWSDGKITNAVELCMDACSKLCDILRERLKDAASLAE

SEQ ID NO: 31877 - protein, 106 aa, Streptococcus mutans
MSRKPIIAGNWKMNKTAAEAREFIDAVKNNIPSNNLVDTVIGSPALFLEGMKKGVKDTELQVAAQNCYWEDFGAFTGETSPAALAALGVDYVIIGHSERRDYFHET

SEQ ID NO: 31878 - protein, 354 aa, Oryza sativa Japonica Group
MTPAADGDDDETTCIRALELIFTFVVPMTLKATIKLGLLDALTGGGHALTADELAAAAQLPAEAASSVDRMLRLLASLDVVKCAPTDTGGEAAVRRYTPAPVCRWFAGERSLAPLAMFLLDDDYLSTWNQLPAAVAGGDGQVAFEKARGMPMFEYMGTNRRLNTLFNQAMVQQSTVVIGKLLERFQGFDGVSVLVDVGGGTGATLEMITSRYKNITGVNFDLPHVIAQAPSLPGVKHIAGNMFESVPNGDAIFLKSMLHLHNDEDCIKILKKCHQALTHNGKVIAVEILLPAIPEPVPTAQNPFRMDMIMLNNHWGGKERTEPEFAKLAVECGYTGVFQATYIFANYWALEFSK

SEQ ID NO: 31879 - protein, 714 aa, Ralstonia metallidurans CH34
MSSIQYQKDQDGIVTLTVDMPGQSANTMNQAFRTDFSAVASQLESEQDGITGVILTSGKKTFFAGGDLNGLLAVTPEQKEELFKRATELKAAMRRIELLGKPVVAAINGSALGGGFELCLACHARFSLASPQIALGLPEVNLGLLPGGGGVVRLVRYLGLEAAMPLLLEGTSLSPAQALAKGLLTSIADDAAGLVKMARDWIKENPEAAQPWDKKGWGLPGSTEQSPASLTFLRTAPVALMKKTRGCYPAPLAILSAAVEGAVVNFDTASLIETRYFVGLATGPVAKNLISTFFFQMNDIKANKGRPADVPPATFKRVGILGAGMMGAGIAYASAMRGIEAVLKDVSLDHAGKGKLHSEKLLEKGVSKGKISPSKRDEVLQRITPTADASGLAGCDIIIEAVYEKRELKAEVTREAEPHLAENGLFASNTSTLPITGLAEASASPENFIGLHFFSPVDRMPLVEIIKGKKTSSRTLAHAIDFVKQIGKTPIVVNDSRGFFTSRVFGTFTKEGAAMLSEGVPAAVIENAALSVGMPVGPLAVMDETSMALSLSVKRQTETDLASEGKSMPQHPGWAVIERMADGLKRPGRAGGGGFYEYPKDGQKYLWPGLVSEFGKSAGDVPLDDLRDRILYIQALESIRILEEGVIDTTRDANIGSILGIGFPRWTGGVLQYVNMVGTRRFAERSAELAQRYGERFTPPALLLEKAERNERFQ

SEQ ID NO: 31880 - protein, 590 aa, Synechococcus sp. CC9605
MRRNFLLLRGLLLALSLRTTLPAAAAPISRDDPESSDTSSRGISTARGSAVVVTANPLASKAALAALKNGGNAIDALVTAQAVLAVVEPQSSGLGGGGFLLHWEAKQRQLAVLDGREVAPERSRPADLLDAAGNPLPWRQATSKANAIGIPGTVALLWEAHQNHGQLPWAQILQPSIRLASDGFLPSPRLLRSILLAQRFGVAHSPDFQALYLPGGQPPAADQRFRNPALARTLRLLARGGGPAFYQGPLAQQILGGINALQASEPNFRGWSSADLSSYAVVRRTPLCSQQLQHRICTVPPPSSGGLALLQTLALLNQTTHLASSSAGEPQVWRQLARAQAWADADRLYWVHDPIDGAVPSAALLDPAYLDSRARAMQRANGERPAPGLPPGIDRYPYGRPDQDIEQGTSQITIVDASGNIASYTSSVETIFGSRHLIGGMVMNNQLTDFAFKPSLGGKPVANRRLPGRRPMSSMAPTLVFRKGEPVLALGSPGGRSIPHLLSRVLLASLVWNDPPARAVGLPHLSRRGTTLVLESNPPLPWPFPLQQLKSEASPRLQSIGSGTALIQKIDAGWQGAADPRREGTALVLP

SEQ ID NO: 31881 - protein, 412 aa, Glycine max
MATHAALASTRIPSNTRFPSKASHSFPTQCALKRLEVTEFSGLRSTSCVTYANSARESSFFDLVASQLTPKTNGSTPVRGETVAKLKVAINGFGRIGRNFLRCWHGRKDSPLEVVVVNDSGGVKNASHLLKYDSMLGTFKADVKILDNETITVDGKSIKVVSSRDPLKLPWAELGIDIVIEGTGVFVDGPGAGKHIQAGAKKVIITAPAKGADIPTYVVGVNEGDYTHEISNIISNASCTTNCLAPFVKILDAEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYRLVGT

SEQ ID NO: 31882 - protein, 426 aa, Chlorobium tepidum TLS
MNIISVGVNHKTAPIEIRERIALSEVQNKELVTDLVSSGLASEAMVVSTCNRTELYVVPGMPEVNCDYLKDYIISYKNARNAVRPEHFFSRFYCGTARHLFEVSCAIDSLVLGEGQILGQVKNAYRIAAEVGTAGILLTRLCHTAFSVAKKVKTRTKLMEGAVSVSYAAVELAQKIFSNLSMKKVLLIGAGETGELAAKHMYAKNARNIVITNRTQSKAEALAEELGTNRVLPYESYKEHLHEFDIIITAVSTKEYILNAAEMQQSMAKRRLKPVIILDLGLPRNVDPEVGALQNMFLKDIDALKHIIDKNLERRRAELPKVKAIIDEELVAFGQWLNTLKVRPTIVDLQSKFLEIKEKELERYRYKVSEEELRRMEHLTDRILKKILHHPIKMLKAPVDTADNIPSKVNLVRNIFDLEEPNQSLQ

SEQ ID NO: 31883 - protein, 577 aa, Arabidopsis thaliana
MSLVRTVTIVLFIIAFLQNAAAQKRQQSIVKSRGAVATDDGRCSVIGMRVLREGGNAIDASVAAALCLGVVSPASSGIGGGAFTVVKIAGGKEIAYDSRETAPLRATEVKRVLNMYGGNVDLKKKGALSVGVPGEVAGLFTAWKQHGKLPWKRLVTPAEKLAEGFKISKYLYMQMNATRSDILADKGLSDLFVSNGELKKPGTICHNPKLALTLKLIGEYGPKAFYNGTVGVNLARDIKKSGGIITLKDLQSYRVKIKEPLSADILGYRVLGMPPPSSGGAAMMLVLNILSQYGIPSGVSGPLGVHRLIEALKHAFAVRMNLGDPDFTDVTKVVSDMLSPKFAKDLKSKINDQKTFDPKYYGGMWNQIDDHGTSHLSIIDRERNAVSMTSTINGYFGALMLSPSTGIVLNNEMDDFSIPMKSNGNLDVPPPAPANFIRPGKRPLSSMSPTIVLKDGKVKAAVGASGGANIIAGTTEVYLNHFFLKMDPLSSVLAPRIYHQLIPNRASYENWTTVFNDHFEIPKATRVVLEKKGHVLSPIAGGTIAQFIVQESGENSGGRSELVAVSDPRKGGFPSGY

SEQ ID NO: 31884 - protein, 447 aa, Arabidopsis thaliana
MALQRQLLKRATSDIYHRRAISLLRTDFSTSPSIADAPPHIPPFVHQPRPYKGPSADEVLQKRKKFLGPSLFHYYQKPLNIVEGKMQYLYDESGRRYLDAFAGIVTVSCGHCHPDILNAITEQSKLLQHATTIYLHHAIGDFAEALAAKMPGNLKVVYFVNSGSEANELAMMMARLYTGSLEMISLRNAYHGGSSNTIGLTALNTWKYPLPQYGTSGKVAGFIAETIQGVGGAVELAPGYLKSVYEIVRNAGGVCIADEVQTGFGRTGSHYWGFQTQDVVPDIVTMAKGIGNGLPLGAVVTTPEIASVLASKILFNTFGGNPVCSAGGLAVLNVIDKEKRQEHCAEVGSHLIQRLKDVQKRHDIIGDVRGRGLMVGIELVSDRKDKTPAKAETSVLFEQLRELGILVGKGGLHGNVFRIKPPMCFTKDDAGKFLMHWTIPSPGCEQG

SEQ ID NO: 31885 - protein, 418 aa, Magnetococcus sp. MC-1
MKRVDVALIVLKFGGTSVGSIERIRNVARMAMAEQQAGNQVVVAVSAMSGETNRLVGLVEDLTQFYNKREYDVVVSAGEQISIGLLATAIESMGQKAKSYLGWQVRFITDGSHSKARIKEVEAFRIQADLDAGAIVIVAGFQGVDSHNNITTLGRGGSDTSAVALAAALKADRCDIYTDVDGVYTTDPRIVTKARKMDRISYDEMLELASLGAKVLQTRSVELAKKYSVPVRVLSSLEPGSGTMLTKEEDTMESVVVSGLAYDKNEAKITILGVPDKPGVAANLLGRLGDANINIDMIVQNVSPAGDATDMTFTVPKADFPQAMKVMEDAVKDVGARQLQGNSDIAKISAVGVGMRSHSGIAQKMFKALADEGINILMISTSEIKISVVIEEKYTELAVRALHDAFELEKDPSDRINA

SEQ ID NO: 31886 - protein, 338 aa, Zea mays
  misc_feature (323)..(323): Xaa can be any naturally occurring amino acid
MAKIKIGINGFGRIGRLVARVALQSDDVELVAVNDPFISTDYMTYMFKYDTVHGQWKHHEVKVKDSKTLLFGEKEVTVFGCRNPEEIPWGSVGAEYVVESTGVFTDQEKAAAHLKGGAKKVVISAPSKDAPMFVVGVNEKEYKSDINIVSNASCTTNCLAPLAKVINGKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAESEGSLKGILGYVEEDLVSTDFQGDSRSSIFDAKAGIALNGNFVKLVSWYDNEWGYXSTRVVDLIRHMNSTK

SEQ ID NO: 31887 - protein, 401 aa, Kineococcus radiotolerans SRS30216
MRALTWQGKRSVSVQDVPDPRIVDPTDAVVRITSTAICGSDLHLYEVLGPYMSKGDVLGHEPMGVVEAVGPAVANLQVGDRVVIPFNISCGHCFMCTRGLQSQCETTQVHEQGSGAALFGFSSLYGSVPGGQAEYLRVPHADYGPVKVGREGDGGLPDDRYLFLSDIVPTAWQGVQYADVPDGGTLAVLGLGPVGQFAARIGRHLGYEVIGVDPVAERRQMAQRHGVTAIDLTDGDADVVTQLRERTDGRGPDAVLDAVGMEAHGGAEGAVAKAAQTAVGLLPDALAQKVTETAGVDRLWAVRSAVEAVRRGGTVSLSGVYGGEADPLPMKTMFDKQLQFRMGQCNVRRWIDDLLPLVEDPADPLGVEDLTTHRVSLEDAPDAYEMFQEKRDGCIKVVITP

SEQ ID NO: 31888 - protein, 300 aa, Mycobacterium sp. MCS
MPFQFSVDEGAEVIRRKLRDLPRREVHPEVEAQDRTIPGPAGDIPIRVYRPATAESSPPVVVFFHGGGFAAGDLDTHDGECRHHAVAADAVVVAVDYRLAPEHPYPAAVEDAWAALTWVAGHGAELSVDTNRLAVAGDSAGGNLSAVMTHRARTRGGPPIAFQLLWYPVTMWDMSLPSVTENAGAPILDRTAMDGLSRWYAGELTDPGHELAPGLADDFTGLPPAYIAVAGHDPLRDDGIRYAELLSAAGVPVEVHNAETLVHGYLGYAGVVPSATAATDRGLAALRAALHPEAGQRPEK

SEQ ID NO: 31889 - protein, 352 aa, Gibberella zeae PH-1
MSRLYNTGDGTILSGSTNGRLDTTNYGGPIGRLTPETLIESVSEVLDIAQIAIVNFTGGIDGASSANAGSDRFLNISMDAHKRLCSPDSDIVGAIMIHGTNTLADTVFGVDLTLNCSKPFVTTGSMRPNSALSADGSSNFYDAVRTAIHPEARDRGALIAMNNHLVSAFYATKTNGNTVSTFLAPDQGYIAQFMSGQPYFFYSPPLPKARNYLNPFKLSSPLPKVDIFYGYQGFDADLLYSAAKNGAKGIVIMGVGPSALSMAAFEAAEIFTAKALSQSLRSVRISDSQFPAPNWKRCNISSGVLRGEKALIHLQLALGAGYDFKGIQKLFEGEVRKAVYNDATAFFNGTVL

SEQ ID NO: 31890 - protein, 175 aa, Oryza sativa
  misc_feature (54)..(54): Xaa can be any naturally occurring amino acid
  misc_feature (150)..(150): Xaa can be any naturally occurring amino acid
PPPPPRNFLFLFYLIFPLLSSLRTSAEERDVQLFYFYFIFLILGGASMADCIKXPGLGIAARYMFTMAVGRSLRTVTFLATILPSARPWCAEARYQIPDHPHPWAQKYYAPYASDPDAIRRVIQEDMPYGQPIQLYSEYRPKGGHIAFLXTFLRATVEKGALWVLFFKKAKGGCP

SEQ ID NO: 31891 - protein, 247 aa, Oryza sativa Japonica Group
MDTASLCTVEKRGAVHVITLTGAGEHRLGPPLLSALRSAVAAVRAAAAAGSGGALVIARRGQVLLQRVRPGLGAHRARRAARLHGRRLPGPRRRPPRSPGAHRRRRHRPRRAAGCALALAHDAVVMRASRGFLYMSEVDAGLKIVDFFAELIRQKVPDAVNRRDLVLRGDKMTAADALRRGIVDAAVDGGVDDVVAAAVREAEALAARGWDGEIVAETRKAIWPELWAKVKDHATDEPPPPPPRPLL

SEQ ID NO: 31892 - protein, 422 aa, Legionella pneumophila str. Lens
MHIHKIQAREILDSRGNPTIEADVILENGIIGRASVPSGASTGSREACELRDNDPKRYAGKGVQKAVKHVNEEINQALQGLSVSDQENLDRILCQLDNTENKSHLGANAILATSLACARARALSLNQPLYMTLNQGDMMTMPVPMMNILNGGAHADNNVDIQEFMIMPIGAPDFPVALQMGTEIFHVLKSVLKKQGLNTAVGDEGGFAPNIQSNRQALDLLSEAIEKAGFRLGEDIVFALDVAASELFNEGFYHMSSENQKFDSHQLIEYYANLISSYPIASIEDGLDEKDWSGWKQLTTLLGNKVQLVGDDLFVTNPKILQEGIAQGIANAILIKVNQIGTLSETRQAIKLAYDNGYRCVMSHRSGETEDTFIADLAVASGCGQIKTGSLCRTDRTAKYNQLLRINELASLPYAGKNILKR

SEQ ID NO: 31893 - protein, 510 aa, Arabidopsis thaliana
MEMLLGGQATNGALRSKTKIICTLGPVSRSVEMIEKLLKAGMNVARFNFSHGSHSYHQETLDNLRTAMDNTGILSAVMLDTKGPEIRTGFLKEGKPIQLNQGQEITISIDYMIEGDSNVISMSYKKLAEDVKPGDVILCSDGTISLTVLSCDKSFGLVRCRCENSAILGERKNVNLPGIVVDLPTLTEKDKEDIIQWGVPNKIDIIALSFVRKGSDLTEVRRLLGEHSKNIMLMSKVENQEGVMNCEKILENSDAFMVARGDLGMEIPIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMVSLPLSPIESLAASVVSTAQSVFASAIVVLTKGGYTAELVAKYRPSVPILSVIVPEIAQGNDMEMSCSDSVAHAARRGLIYRRIIPVVATGSSARDSNKDATEEMINLAIGFAKTKGICKNGDSIVALHKIDGSSVVKIVTVE

SEQ ID NO: 31894 - protein, 625 aa, Isatis tinctoria
MGNTCVGPSRNGFLQSVSAAMWRPRDADDSVSQSNGDTASEAVSGELRSPSSDQVQNKPPEQLTMPKPGTNIEIKAKSDVEIQPEIKLETQEVTKPESKPETKSETKPETKSETKPETKSETKPETKADTPAKPKKPKHMKRVSSAGLRTESVLQRKTENFKEFYSLGRKLGQGQFGTTFLCVEKTSGKEFACKSIAKRKLLTDEDVEDVRREIQIMHHLAGHPNVISIKGAYEDVLAVHLVMECCAGGELFDRIIQRGHYTERKAAELTRTIVGVVEACHSLGVMHRDLKPENFLFVSKHEDSLLKTIDFGLSMFFKPDDVFTDVVGSPYYVAPEVLRKHYGPEADVWSAGVIVYILLSGVPPFWAESEQGIFEQVLHGDLDFSSDPWPSISESAKDLVRKMLVRDPKRRLTAHQVLCHPWVQIDGVAPDKPLDSAVLSRMKQFSAMNKFKKMALRVIAESLSEEEIAGLKEMFNMIDADKSGQITFEELKAGLKRVGANLKESEILDLMQAADVDNSGTIDYKEFIAATLHLNKIEREDHLFAAFTYFDKDGSGYITPDELQQACEEFGVEDVRIEEMMRDVDQDNDGRIDYNEFVAMMQKGSITGVPVKMGLEKSFSIALKL

SEQ ID NO: 31895 - protein, 315 aa, Legionella pneumophila str. Lens
MHWFAQAPANIALIKYMGKKDENSNLPDNSSLSYTLSNLLSSVKLERLPTKKDIWEPLTIPGAPEFNLSVEAQKRFIDHLVRLKEYFGYVGGFLIQSSNNFPHSSGLASSASSFAALTKCASIALSELTQKPLPSIDEQAQWSRLGSGSSCRSFYAPWALWTGDKVSAIDLPYKDLLHQVIVISSQEKEIPSRVAHKLVKTSPFYETRSERAEANLKLLLNAFENKDWTSIYQICWHEFLDMHQLFKTCEKPFSYITDNTLHILSVIEKFWNEKGDGPVVTMDAGPNVHLLYRSDQTDLARQFKSDHLVGNYDVL

SEQ ID NO: 31896 - protein, 345 aa, Cytophaga hutchinsonii ATCC 33406
MSRYSRQTILPEVGIEGQQKLTNASVLVVGAGGLGCPVLLYLAAAGVGRLGIIDADKVDITNLQRQVLYVTEDEGKSKAETAAKRLSALNPEINIDVYPVWLSKENALEIFSSYDIIVDGSDNFATRYLVSDACVILNKPLVFGSIFKFEGQVSVFNYKGGPTYRCLFPEPPAAGEVPNCSEIGVIGVLPGIIGTLQANEVIKIILKKGDVMSGVLYMYDALSNMVQQLKVFRDPVASVVTELGTYEEVCETSPDIDKRTFDVWKEKNVVYQLIDVREPHEFENKNIGGELIPMNTVKDNLNRIREDIPVIVHCQMGGRSRKIVDFLYEKGFKNVYNLKGGLREF

SEQ ID NO: 31897 - protein, 507 aa, Mycobacterium smegmatis str. MC2 155
MTVFSRPGAADARMSFESRYDNFIGGEWVAPVDGRYFENPTPVTGQVFCEVARSSSADIEKALDAAHAAAPAWGKTAPAERALILNRIADRMEQNLEALALAEAWDNGKPIRETLNADIPLAIDHFRYFASAIRAQEGSLSQVDEDTVAYHFHEPLGVVGQIIPWNFPILMAVWKLAPALAAGNAVVLKPAEQTPASVLYLMSLIADLVPAGVVNIVNGFGVEAGKPLASSNRIAKIAFTGETTTGRLIMQYASQNLIPVTLELGGKSPNIFFSDVMAAADDFQDKALEGFTMFALNQGEVCTCPSRSLIQSDIFDEFLELAAIRTKAVRQGDPLDTETMIGSQASNDQFEKILSYIEIGKSEGARIVTGGERADLGGDLSGGYYIQPTIFTGHNKMRIFQEEIFGPVVAVTSFSDYDDAISIANDTLYGLGAGVWSRDGNTAYRAGRDIKAGRVWTNCYHQYPAHAAFGGYKQSGIGRENHKMMLDHYQQTKNLLVSYSDKAQGFF

SEQ ID NO: 31898 - protein, 141 aa, Polaromonas sp. JS666
MAIERTLSIIKPDAVAKNVIGQIYARFEAAGLKVVAAKMAHLSKGEAEAFYAVHKERPFFKDLVSFMISGPVMIQALEGEGAILKNRDLMGATDPKKAAAGTIRADFADSIDANAVHGSDAVETAQAEIAFFFPGMNIYSR

SEQ ID NO: 31899 - protein, 419 aa, Vitis vinifera
MPFIDYPTLPLFPSGPTPSIILNSVVLLLKISMRFQIGTARRETYDVNATQGHNAEILPLSWVASSLMDLVSTDSSIHGSQAFSPIKSQASSVLPSPSHSSDTSFPIIAIAVIGILATAFLLVSYYIFVIKCCLNWHRIDLLRRFSFSRSRHREDPLMVYSPAIESRGLDESVIRSIPIFQFRKGGGREFGERSHCECAVCLNEFQEEEKLRIIPNCSHIFHIDCIDVWLQSNANCPLCRTSISTTPRFPVHQIIAPSSSPQDPSPYANNYIGGDEDFVVIELGNDSSADSSLLRPPERLNSRELSAPSISPSPRKLEQRIVPKKARKFHHVASMGDECIDTRGKDDQFSIQPIRRSFSMDSSNDRQLYLAIQEILQQNRPVSDFSPSEGCSSRFRRSFFSFGHGRGSRSAVLPIPMDP

SEQ ID NO: 31900 - protein, 772 aa, Zea mays
  misc_feature (81)..(81): Xaa can be any naturally occurring amino acid
MAWHLDILVMVTTCLIFFSISEQSSQSELLQQLRKQLEYPRQLEAWGSPSSDPCYTQPTAVLAVTCEENAIRELKIIGDRXITKPPKFSGFSVPNVTLSEAFVLDSFVTTLARLTTLRVVILVSLGLWGPLPDKIHRLSSLEVLDLSSNFLYGSIPPKLSVMSKLHTVTLDGNYFNGSVPDWLDSFSNLIVLRLQSNQLKGSIPASIGKAAMLTELALAGNSISGDVPNLVNLNKLEMLDLRDNKLDGELPEMPTSVVTILLSKNSLKGEIPEQFGQLNRLQHLDVSFNFLVGSPPAELFALPNISYLNLAANMLSGSLLSSLTCSSTLGFVDLSTNRLTGDLPSCLNGNLNNKVVKFDGNCFRVDPAHQHEDKYCQQSHNGRGSKKDVGLVVTVVGILFVILVLSLLLMASNKRSCQKVLAEQQIQQKHTQDNLLSGMSSELLVNARCISQAVKLGTQIQPSYHIFSLEELKEATKSFERSAFLGEGAIGKLYKGRLENATLIAIRCLPLHQRYSIRNLKLRLDLLAKLRHPNLVCLLGHCIDSAVDESTVKRVFLVYEYVPGGTLSSYLSACSPDKTLKWCDRLQVLIAIAKAVHFLHTGIIPGSLSNRLKSSSILVDEHHTAKLSDYGLSIITEEIYRHEVIGQKEKYLQNDATEMENLEDDVCSFGYILLEVLMGPKLHEKGGPFILKDLVVSMSTLEERDQVVDPVIIGTCSQDSLSIVVSIMIKCLSIECSARPSMEEVLWNLQYAAQVQTMADSDQRSEVSSQAC

SEQ ID NO: 31901 - protein, 544 aa, Polaromonas sp. JS666
MNQPDHPASDLPPTQPGEDENKPAATEKSGQDAPDLIADKPQEKAVALAQPAGQPVAQPATSTIRFEDVVTGQFDADEDDVALELPKRVLSPQPETPKLHKVLAQAGLGSRLEMEQLILEGRISVNAEPAHIGQRIQFGDTVKVNGKPIRVRIDPPPPRVIAYHKPSGEVVTHDDPQNRPTVFRRLPKLFQGKWQSVGRLDLNTEGLLLLTSSGELANKLMHPRFGLEREYAVRVLGALSNEEKKRLLEGVTLDDGVAQFSSIEAGGGEGANCWYRVTISEGRNREVRRMFEAVGHAVSRLIRIRYGAMLLPRGLKRGAFVELDERDIWALTNAVTRSESRADPRGAPKHPGHVRGDEGGEFRPGRGPRRNERSRGDRGRLPAPESGQADDFQPADADAEQEPNELQPPMHRTDSAPRGNRRRGGKGRGQGGNPGSPPRFGQAAGNGPQGPKRRDDRGDRGDKSAGGAQQPDPMKTSFGYIGADTFTRQRQGQGQGQGQGQRRSGGGGSGMGGAGGGQRRGGGGGGGNRGGGNRGGGGNRGGNR

SEQ ID NO: 31902 - protein, 333 aa, Cytophaga hutchinsonii ATCC 33406
MKVAINGFGRIGRISYRALLKKKNIEVVAINDLTDTKTLAHLFKFDSSHGVFDGEVSYDAENLIINGKKVKVLSVKNPADLPWKALGVDVVLESTGFFTEKEKAEAHITAGAKKVIISAPATGDLKTIVLGVNDNILDGSETVISNASCTTNCLAPMVKVLEDNFGIESGFMNTIHAYTSDQRLQDAPHKDLRRARSAALSIIPTSTGAAKALGLVIPSVQGKLNGTSLRVPVPVGSITDFTATLKRTVTKDEINAAFKKAAEEGSLKGYLAYSEDPLVSVDIVGNPASSIFDSELTMVQGNNVKVFGWYDNEFGYSNRTADLIELVGKQIKA

SEQ ID NO: 31903 - protein, 273 aa, Chlorobium tepidum TLS
MSVQDIWSLIREEACLECEREPEIRLFLEQHILRYEEFAPALAMLLSVKLGSKHFPPPVLEGIFEDFYRQSPESVRCAACDMEATRERDPAAVNYFEIMLFLKGYQALQSYRLAHWLWQNDRKSLAYFLQNRMSEVFAVDIHPAAKIGKGILLDHATSLVIGETAVVEDNVSLLHEVTLGGTGKDSGDRHPKVGKSVMIGAGAKILGNIKIGEGAKVGAGSVVLDDVPPHYTVAGVPAHIVGRTEVPEPSLDMNQRLIFPEKQKPKGEQHSCL

SEQ ID NO: 31904 - protein, 178 aa, Rhodobacter sphaeroides
KPAVYFGGKARIIDFALSNAMNSGIRKMAIATQYKAHSLIRHIQRGWNFFREERNEYLDILPASQRVDENRWYLGTADAVTQNIDIVDSYDIKYVIILAGDHVYKMDYEIMLRQHCETGADVTIGCLTVPRAEATAFGVMHVDANLRITDFLEKPADPPGITGDEANALASMGIYVFK

SEQ ID NO: 31905 - protein, 351 aa, Agrobacterium tumefaciens
MRVLVTGGAGFIGSALVRYLVSEVGADVLTVDKLTYAGNLASLKPIENAPNHRFLQADICDRAAMNDAFATFQPDYVMHLAAESHVDRSITGAADFIQTNINGTFTMLEAARQYWSSLADDAKANFRMLHVSTDEVYGSLGDDGLFEETTPYDPSSPYSASKAASDHLATAWQRTYGLPFVISNCSNNYGPFHFPEKLIPLIILNALEGKPLPVYGNGANIRDWLYVEDHARALWLIVQKGLAGEKYNVGGRNEQKNIDVVNCICSILDELRPQSKPYANLIQYVTDRPGHDARYAIDATKLETELGWKAQENFATGIRKTVEWYLDNAWWWQPLREGVYSGERLGVLTKG

SEQ ID NO: 31906 - protein, 224 aa, Mycobacterium sp. MCS
MAHPLIAPSILSADFARLADETAAVTGADWLHVDVMDNHFVPNLTLGLPVVESLLKVTDIPMDCHLMIENPERWAPPYAEAGAHNVTFHAEATDNPIAVARDIRAAGAKAGLAVKPGTPIDPYLEILREFDTLLVMSVEPGFGGQKFIPEVLPKVGIVRRLVDSGELTVLVEIDGGINEDTIAAAAEAGVDCFVAGSAVYSAQDPAAAVRSLREQAAAASKHLS

SEQ ID NO: 31907 - protein, 287 aa, Glycine max
MEEEGIGLVLARATELRLKISNCIQRATANGPSPHADDDDDEATERLLNICDALEALETQLSSLQVLQQQQQYEREIALAEIESSRKMLIDKLREYKGKELEVINEASTFASETVEPNNDLLLPPYPSHPPYSVSMDKEYLSQIPSVNKSGRNGLITLDPMIEVSNSLSEKEQNHVENGAKNSRKGLGFFITSAAKTMLTVVGVVSILSLSGFVPKLGTRFSVQGWCHRVENERSTTKNGGERSNIQCPPGRILVWENGEARCQVKERVEIPFSAVAATPDINYGCG

SEQ ID NO: 31908 - protein, 439 aa, Mycobacterium sp. MCS
MTRLDSVERAIADIAAGKAVVVIDDEDRENEGDLIFAAEKATPELVAFMVRYTSGYLCVPLDGAICDRLGLLPMYAVNQDKHGTAYTVTVDAKHGVGTGISASDRATTMRLLADPTSNADEFTKPGHVVPLRAKDGGVLRRPGHTEAAVDLARLAGLQPAGTICEIVSQKDEGAMAQTDELRIFADEHDLALISIADLIEWRRKHERHIERIAEARIPTRHGEFRAVGYTSIYDDVEHVALVRGDVAGPHGDGHDVLVRVHSECLTGDVFGSRRCDCGPQLDAAMAMVAREGRGIVLYMRGHEGRGIGLMHKLQAYQLQDAGDDTVDANLKLGLPADARDYGIGAQILVDLGVRSMRLLTNNPAKRVGLDGYGLHVIERVPLPVRANAENIRYLMTKRDRMGHDLTGLDEYDEANSMDDYDEGVYLLGERRPTDLGGSR

SEQ ID NO: 31909 - protein, 160 aa, Mycobacterium sp. MCS
MSGGAGVPDLPQIDASGMKVGIVASTWHSTICDALLDGALKVTESANVSEPTVVRVLGAIEIPVVAQALAADHEAVIALGVVIRGQTPHFDYVCDAVTQGLTRVSLDASTPVANGVLTTNTEEQALDRAGLPGSAEDKGAQAAAAALSTALTLQGLRGRS

SEQ ID NO: 31910 - protein, 172 aa, Glycine max
  misc_feature (138)..(138): Xaa can be any naturally occurring amino acid
MAFHVACPITCRRICFCTLGFPRALHAAPDAAANAFVHDVASLRDFLADTRRDDATVQVPVPKVLPPPPPPPPPSDAVSLGADALDESASMKAKRIALQRKGAAAMIAAEEYARRFESGDVVNTPGNVTGDDQGQANXELLVEFANVEKNEGSEKAEKMLSVQSCGKKYHRN

SEQ ID NO: 31911 - protein, 476 aa, marine gamma proteobacterium HTCC2143
MSEQHSSVDYEQVPEDYLQQRQLKSGAAGWILLAGLGVSYVISGEFAGWNFGLEHGGFGGMLLATIAMAIMYGAKVLSLAELSAALPTAGGGYSFARRALGPWGGYLTGSAILLEYVIAPAAIAVFIGAYVGELVGVDGPLVYAVFYAVFVGIHLLGTGEALRFMMVVTVIAVAGILVFVVAAIPHFSVANLFDIAVNESASGASTFLPQGYLGVWAAIPFAMWLFLAVEGVPLAAEEARDPARDLPRGIITAMLILLVFGGCVLVLVPGIAGADAMKAHGAPLVGALQSVYGEDSGAAMFVNVVGLAGLVASFFSIIYAYSRQVFALSRAGYLPRFLSVTGRRKVPTLSLIVPGFIGFGLSLSGEGDLMITIAVFGATISYALMTLSHIVLRQKEPNLLRPYKTPGGVFTSGIALVLSVVAFASTFVVNQEAALWSGLIYLLMIAYFGLYSRHHLVASAPEEEFEAIARAEQELI

SEQ ID NO: 31912 - protein, 461 aa, marine gamma proteobacterium HTCC2143
MKVMNARDVKTVADARQLVEQRGLQHIKVGLFDVDGILRGKYMSKEKFFSALEGGFAFCDVVLGWDSNDQLYQTPDVKITGWHTGYPDAPVRIVPESCRELPMENDGLLFLCDFEGEAANICPRSTLEKVVKKAENMGYDALAGFEYEFFLFDETPDTVREKGFRNLKPISPGFFGYSVLRNSVHSEIYQELLSLAQEMDFPIESLHTETGPGVLEAAITVDSARAAADKAALFKTFVKVWAQRRKMMATFMAKWSNDYPGQSGHIHLSLRRRDGSGSAFYDPSQPMNMSATQRHFIAGQQRLMPELLAMYAQTVNSYSRMVPGFWAPTDATWGCENRTTALRVIPGSDKSQRTEFRLGSADANPYIALAAALGSGLYGIEHKMEPTEMVRGNAYEQKHPVELALGRDIYTAAAALSASAAARELFGDAFVEHYAATREWEGKEFSRHVTDWEMARYFEII

SEQ ID NO: 31913 - protein, 472 aa, Mycobacterium bovis AF2122/97
MTRRGKIVCTLGPATQRDDLVRALVEAGMDVARMNFSHGDYDDHKVAYERVRVASDATGRAVGVLADLQGPKIRLGRFASGATHWAEGETVRITVGACEGSHDRVSTTYKRLAQDAVAGDRVLVDDGKVALVVDAVEGDDVVCTVVEGGPVSDNKGISLPGMNVTAPALSEKDIEDLTFALNLGVDMVALSFVRSPADVELVHEVMDRIGRRVPVIAKLDKPEAIDNLEAIVLAFDAVMVARGDLGVELPLEEVPLVQKRAIQMARENAKPVIVATQMLDSMIENSRPTRAEASDVANAVLDGADALMLSGETSVGKYPLAAVRTMSRIICAVEENSTAAPPLTHIPRTKRGVISYAARDIGERLDAKALVAFTQSGDTVRRLARLHTPLPLLAFTAWPEVRSQLAMTWGTETFIVPKMQSTDGMIRQVDKSLLELARYKRGDLVVIVAGAPPGTVGSTNLIHVHRIGEDDV

SEQ ID NO: 31914 - protein, 254 aa, Mycobacterium smegmatis str. MC2 155
MIELKTPAEIDKMRTTGRFVAEVLRELSEMAAVGVNLLDLEHRARDMIAERGATSCYWDYHPSFGSGPFRNVICLSVNDAVLHGLPHSYVLRDGDVLSLDFAVSIDGWVADAARTVIVGTPDAEDERLVQATRDALAAATAAAVPGNRLGDISAAIGAVADDYGYPVNLEFGGHGLGRTMHEDPHVPNRGRPGRGMRLRDGMTLALEPWFARTTDRIRFDRDGWTIRSADGSRTAHTENTVAITADGPLVLTAD

SEQ ID NO: 31915 - protein, 65 aa, Glycine max
MTTSKRLADRKIARFERNISKKGSESSKKGYAYPVGPIVLGFFVFVVVGSSLFQIIRTATSRGMA

SEQ ID NO: 31916 - protein, 363 aa, Pinus sylvestris
MRDRRMYYISKKKAIMTPATVFVSIFVIVYGSAVNALPTPVAGLSWTFYNTTCPSVESIVWQRMEVYLSADITQAAGLLRLHFHDCFVQGCDGSVLLNSTSGEQTAAPNLSLRAQALKIINDIKQNVEAACSGIVSCADIVALAARDSVAIAGGPFYPLPLGRRDSLTFANQSTVLANLPGPTSNVTELISFFDPKGLNLTDLVALSGGHTIGRGNCSSFDNRLYNSTTGAQMQDATLDQSFAKNLYLTCPTSTTVNTTNLDILTPNLFDNKYYVNLLNKKTLFTSDQSFYTDTRTQNIVINFEANQSLFFHQFLLSMLKMGQLDVLTGSQGEIRNNCWASNPSRSYSILDPEASQESASYSM

SEQ ID NO: 31917 - protein, 356 aa, Saccharomyces cerevisiae YJM789
MSVSYKGTISKTHSVFKPEKGRYYIYGALGCPFTHRAILARSLKKLEPVLGLVLSHWKLDSKGARFLSAPHRPEKYKERFFTATGGIASAKLDESEELGDVNNDSARLFVDGAFDPVENISRLSELYYLNDPKYPGTKFTVPVLWDSKTRKIVNNESGDIIRILNSGVFDEFIQSEETNVIDLVPHDLIDEIDKNIKWVHPKINLGVYKVGLAENGKIYETEVKTLFENLQKMECVLKENYKRLEEQFSGNKQKILAKYFVLGQRLTEADIRLYPSIIRFDVVYVQHFKCNLKTIRDGFPYLHLWLINLYWNYAEFRFTTDFNHIKLFYIRMEVSRNKINQFGIVPLGPKPDISRL

SEQ ID NO: 31918 - protein, 475 aa, Polaromonas sp. JS666
MSKQFDVIVIGGGPGGYIAAIRAAQLGFNVACIDEWKNAKGGPALGGTCTNVGCIPSKALLQSSEHYEQAGHHFADHGIEVKGLSLDLAKMVGRKDTVVKQNNDGIVYLFKKNKVTFFHGRASFAAAKDGLYDIKVAGAAEETLSGKHIIVATGSNARALPGAPFDEESILSNDGALRIGAVPKKLGLIGSGVIGLEMGSVWRRLGAEVTVLEGLPTFLGAVDQQIAKEAYKAFVKQGLKIELGVQVGEVKSGKNGVSVAYVDAKGQAQKIDVDKLIVSIGRVANTIGLAPETVGLKLDERGAIVVDDECKTNLPNVWAIGDVVRGPMLAHKAEEEGVAVAERIAGQHGHVNFNTIPWVIYTNPEIAWVGQTEEQLKAAGRAYRAGTFPFMANGRARALGDTTGMVKMLADTATDEILGVHIVGPFASELIAECVVAMEFRASSEDIARICHAHPSLSEATKEAALAVDKRTLNF

SEQ ID NO: 31919 - protein, 502 aa, Arabidopsis thaliana
MAAILSVDFQNCFIFIVLCLFSLFCYSLFFKKPKHPRGCDLPPSPPSLPIIGHLHLLFSPLTHKSLQKLSSKYGHLLHLRIFNVPVILVSSASVAYEIFRAHDVNVSSRGVAAIDESLLFGSSGIITAPYGDYWKFMKKLIATKLLRPQSLESSRGIRGEELTRFYNSLLDKARMTESVEISTEAMKLVNNTLCRMSMGRSFSEENGEAEKIRGLVGESYALTKKMFLASLLRKPLKKLRISLFEKEIMGVSDRLDELLERILVEHEEKLHEEHQGTDMMDVLLAASGDENAEYNITRNHIKSFFVEIFIGATDTSVQTTQWTMAEILNHPNVLERLRKDIDSVVGKTRLIHETDLPNLPYLQAVVKEGLRLHPPGPLLVRTFQERCKIKGFYIPEKTTLVINAYAVMRDPDSWEDPDEFKPESGQEEKPFKYLPFGGGRRGCPGGNLAYIFVGTAIGVMVQCFDWKIKGDKVNMEETFEGMNLSMVHPLKCTPVLRSQPFF

SEQ ID NO: 31920 - protein, 422 aa, Polaromonas sp. JS666
MAIVEVKVPQLSESVAEATMLQWKKKIGEAIAIDEILIEIETDKVVLEVPAPSAGVLTELVVADGGTVVSDQVIARIDTEGKAGAGAPAPAAAAAAAPAAAASSVPAPAAGGSMAGVPMPAAAKLMADANLAAGSVPGTGKDGRVTKGDVLGATAAGAVKSVAASPVPTGAPTTSLPQVAAQVKPADLGDRPEQRVPMSRLRARVAERLLQSQSTNAILTTFNEVNMAPVMEMRKRFQEKFEKEHGVKIGFMSFFVKAAVHALKKYPVLNASVDGNDIVYHGYFDIGIAVGSPRGLVVPILRNADQMSFADIEKKIAEYGAKARDGKLGIEEMTGGTFSISNGGVFGSMLSTPIINPPQSAILGVHATKDRAVVENGQIVVRPMNYLAMSYDHRIIDGREAVLGLVAMKEALEDPARLLFDI

SEQ ID NO: 31921 - protein, 418 aa, Saccharomyces cerevisiae YJM789
MAKTTKVKGNKKEVKASKQAKEEKAKAASSSSSESSSSSSSSSESESESESESESSSSSSSSDSESSSSSSSDSESEAETKKEESKDSSSSSSSSSSDSSSDEEEEEEKEETKKEESKESSSSDSSSSSSSDSESEKEESNDKKRKSEDAEEEEDEESSNKKQKNEETEEPATIFVGRLSWSIDDEWLKKEFEHIGGVIGARVIYERGTDRSRGYGYVDFENKSYAEKAIQEMQGKEIDGRPINCDMSTSKPAGNNDRAKKFGDTPSEPSDTLFLGNLSFNADRDAIFELFAKHGEVVSVRIPTHPETEQPKGFGYVQFSNMEDAKKALDALQGEYIDNRPVRLDFSSPRPNNDGGRGGSRGFGGRGGGRGGNRGFGGRGGARGGRGGFRPSGSGANTAPLGRSRNTASFAGSKKTFD

SEQ ID NO: 31922 - protein, 245 aa, Chlorobium tepidum TLS
MVGNWKMNNTIAESVDLATAIAEKVGADGVQCEVGIAPTFPALYEVCKVIEWSGIRLCAQNCHYESDGPFTGEVSTRMLAAAGCSYVILGHSERRQLFGETNATVNLKVKKALAEGLSVILCVGETLDERERGVTGQIVTAQVVEGLIDVTDISKLVIAYEPVWAIGTGKTATKEQAQEVHALIRAKVTELYGQKAADHLRIQYGGSVKPSNAAELFAMPDIDGGLIGGASLNADDFMAIVEAAG

SEQ ID NO: 31923 - protein, 394 aa, Deinococcus radiodurans R1
MIRKERAILALEDGTVYRGYAFGYRGETVGEVVFNTSMTGYQEIMTDPSYNGQIVTITYPHVGNYGVAIYDMESNKPYVRGFISREFSGEYSNYRAQQSLEAFMQQYGVVSIQGIDTRALVRRLRSGGVVKGVIAHRSFTHPEDPYGEFTPAEEQIYVQRARDHQDIDGFDMTKEVTTALPYAFPTLRQGKRVVLMDFGIKHTIIERLAEVGIEPIVVPAHTTPAQIMALQPHGLFLSNGPGDPAPLEYAHKTAWEMMGLLPTFGICLGHQILGLAAGGQTFKMKFGHRGGNQPVKNLLTGNVEITSQNHGYAVDLDSIPNGAFVATHVNLNDGTLEGMAHSRYPVFSVQYHPEASPGPHDSRYLFDRFIEEIDAFDGGNGTPIIKANPGRLGV

SEQ ID NO: 31924 - protein, 416 aa, Salmonella enterica subsp. arizonae serovar 62:z4,z23:--
MESKVVVPAEGKKITLQNGKLNVPENPIIPFIEGDGIGVDVTPAMLKVVDAAVEKAYKGERKISWMEIYTGEKSTQVYGQDVWLPAETLDLIRDYRVAIKGPLTTPVGGGIRSLNVALRQELDLYVCLRPVRYYQGTPSPVKHPELTDMVIFRENSEDIYAGIEWKADSADAEKVIKFLREEMGVKKIRFPEHCGIGIKPCSEEGTKRLVRAAIEYAITNDRDSVTLVHKGNIMKFTEGAFKDWGYQLARDEFSGELIDGGPWLKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMDGAKLLKCSEFGDAIIANM

SEQ ID NO: 31925 - protein, 169 aa, Oryza sativa
MASSATTVAPFQGLKSTAGMPVARRSNSSFGNVSNGGRIRCMQVWPIEGIKKFETLSYLPPLTVEDLLKQIEYLLRSKWVPCLEFSKVGFVYRENHKSPGYYDGRYWTMWKLPMFGCTDATQVLKELEEAKKAYPDAFVRIIGFDNVRQVQLISFIAYKPPGCEESGGN

SEQ ID NO: 31926 - protein, 215 aa, Zea mays
MSAQDPLSSTNPSSVTNNTQDASGRQPSSAAAGSSELSSAKISLRKSLRSFPDFPIPGINFVDIMPLFADPTAHATLVEALELQIAEAFPTKPDIIVGLDARGFLFGPGLALRLGVPFAAVRKQGKLPGPCVTAEYIKEYGKDLFQMQEDAVREGQKVLIVDDIIATGGSAKAAAELVQQLKGEVMGYLFILEIPGLNGRDKLGAPPTKILLEDA

SEQ ID NO: 31927 - protein, 458 aa, Ashbya gossypii ATCC 10895
MNISEAGRLLGHSRLRHIPGRRYNSMGKIRGNNYFAETTRDVWTIINEAAAKAAAESVANGGSGAGKGMKVLNLGQGFFSYSPPDFAIAGAQRALENAMNNQYAPTRGRPALVEALLKLYRPMYGDLAAENVQVTTGANEGIFACLAGLVNPGDEVIVFEPFFDQYIPNIELLGGVVRYVPIRPPAELSKRVTEGTEWVIDYDMLRQTINEKTKAVIINSPHNPIGKVFTREELLKLGNICVEKGIYIISDEVYEHLYFTDEFTRIATLSEEISQHTLTVGSAGKSFAATGWRIGWVISRNKELLALASKAHVRICFSSPAPLQEACAVAIEHALKTTYYADTRAAYQKKYERFQKPFDDLGLPYTRAEGSYFLLVDFSRLPLPADYHFPEELADKGRDFRVAYWLINELGLVAIPCSSFFIPDHREASENMLRFAICKDDTYLDEAIERLMVLKNYL

SEQ ID NO: 31928 - protein, 853 aa, Mycoplasma mobile 163K
MKNFKNILVELKNKLNREQFNYLNEKNNFQEKIKENFKAKSKDLHFRNNFSLEPKSGLLNDPNGLVFFNDFYYIFFQNSPHINKHDLKVWSLYKTKDFLNYTYEGQKISPSIEKDADGIYSGGSIVENDELYLFYTGIEKKYFRKINIEKIKNFFSLADFILESNMHKTLKEIYLESLISKIIKFIENLEESNIFLAKRNTSENFDKTFLFKRDRNLYTRHFRDPLALKKDNNFYLLIGAQLKETLKGVISVYKSKKVDKDYRLIGNIKFKNFSIESYMLECPEFLRINNKDIIIFSTQGKSYFNFRKNNESIHNAIYLVGKMNWNTLEFDVEFQDFLDYGFDFYAPQVFKNVDENILIGWNGRPDISFHDENLGWSFNLSIPRKLYLKNNELIQEPIFQLENEVLNVESNKISKKQNGLYEIRFEKEKNFSEISIFNEKHNISIKLDWDNLFINVNRTNMEVNYGENIGTNWVRKMPKKYSKMNLIVDNSLIHFYFDEGKFHFTFYYFIKKSNIKFKNFSNITFRQIKSLKIKDKSKKVLLIGEALIDTYKQNFEISRQVGGAPLNVSLALSKKGVQNSFFGVIGKDEDASLILEYFKRNNLDTSLLKIDPKLKTTVANVSINDEGERNFTFVRGADENLNFEYDALINQYDLVCFSSATAFLGGKLYKSYIKALNLSLDANIDVVFDPNYRDSLYSKNIEDFKQKAKYFITKSNVVKMSLEELEIIYKLKWNSKNDTETLHKEMKKIIENDQQFFLITLGKDGTLFIDKNKIKIIPSIKVKQVDTTGAGDVFLGSFISKYINRNNKDSNSKDFHNEIFEIIKYANVNGALATTIIGVENALKTEEEINELI

SEQ ID NO: 31929 - protein, 634 aa, Mycobacterium sp. MCS
MAGCSDAEQAPPTPPPVPCEMVSNGTPTPKTPAAAPPGQAGEDLANEPEVGTGYRKDMTAVRTARYSVSTANPLATQAACRVLRNGGTAADAMVTAQATLGLVEPQSSGVGGGGFLLYYDAASGAVQAYDGREVAPAAATENYLRWVSDTDRTPPKPDARASGRSIGVPGIVRLLQTAHEAHGKTTWRELFEPAVQLADGGFDVSPRLAAAISDSRAELSGDTAAGKYFLNADGKPKTAGSRLTNPAYAKTLSAIASDGADAFYTGAIAEAVVEAAADTSGGRTPSAMTLQDLAAYKVEVRQPLCRPYRGKEICGMPPPSSGGLAVLATLGMLERFPMADHRPDDIDRNGGRPDAMGVHLISEAERLAYADRDRYVADTAFVPLPGGTADTLLNSAYLAGRAALINEQRSMGVAKPGEFGPPAAPTPQPREHGTSQVSIVDSYGNAASLTTTVESQFGSFHMVDGFLLNNQLTDFAAEPAGPDGVPVANRVQPGKRPRSTMAPTLVFDASTGPPGTRGPLYAVLGSPGGAVIIQFVVKTVVGMLDWGLDPQQAVGMVDFGADNSPETNVGGEHPNVDIADNGDHDPLVTGLRRLGHRVDLADQSSGLSAIVRDDTGWIGGADPRREGMVMGDGR

SEQ ID NO: 31930 - protein, 460 aa, Salmonella typhimurium
MATGKIVQVIGAVVDVEFPQDAVPRVYDALEVQNGNERLVLEVQQQLGGGIVRTIAMGSSDGLRRGLDVKDLEHPIEVPVGKATLGRIMNVLGEPVDMKGEIGEEERWAIHRAAPSYEELSNSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSILQRYQELKDVIAILGMDELSEEDKLVVARARKIQRFLSQPFFVAEVFTGSPGKYVSLKDTIRGFKGIMEGEYDHLPEQAFYMVGSIEEAVEKAKKL

SEQ ID NO: 31931 - protein, 173 aa, Glycine max
  misc_feature (170)..(170): Xaa can be any naturally occurring amino acid
MATLADSFLADLDELSDNEAEIPEDNDVDAADMEEDVDGDLADLENLNYDDLDSVSKLQKTQRYTDVIQKVEEALNKKESEVLFQVVDIEDDPEYQLIVDCNALSVDIENEIVIIHNFIRDKYRLKFPELESLVHHPIDYARVVKKIGNEMDLTLVDLEGLLPSAIIMGXSVT

SEQ ID NO: 31932 - protein, 346 aa, Legionella pneumophila str. Lens
MKAFIYQGPGKKAIEERPTPIITNPTDAIIKVTKTTICGTDLHILKGDVVTCVPGRILGHEGIGVVDKVGQGVTEFQKGDLVLISCITSCSKCEYCRKGMYSHCAKGGWILGNTIDGTQAEYVRIPYADTSLYKIPEGIDEDVLVMLSDILPTGFECGVQNGKVQPGNTVAIVGAGPIGLSTLLTAQFYSPAEIIVIDLDDNRLEVAKRFGATATVNSSDGKAVDKIMQMTNGRGVDTAIEAVGIPATFVMCEDIVAPGGTIANIGVHGVKADLHLERLWSQNISITTRLVDTVTTPMLLKTVSAKKINPMLLISHRFKFAKILDAYETFAHAADTHALKVIINVS

SEQ ID NO: 31933 - protein, 589 aa, Neisseria meningitidis MC58
MTVQTKTKGLAWQEKPLSDNERLKTESNFLRGTILDDLKDPLTGGFKGDNFQLIRFHGMYEQDDRDIRAERAEAKLEPLKFMLLRCRLPGGIIKPSQWIELDKFARENSHYRSIRLTNRQTFQFHGVPKAKLQTMHRLLHKLGLDSIATAADMNRNVLCTSNPIESELHRQAYEYAKKISEHLLPRTRGYLDVWVDGKKVQSSDDFLQEDEPILGKTYLPRKFKTAVVIPPLNDVDCYGNDLDFVAVSDGNGQLAGFNVLAGGGLSMEHGNTKTYPNISLELGFVPPEHALKAAEAVVTTQRDFGNRSDRKNARTRYTIQNMGLDNFRAEVERRMGMPFEPVRPFKFTGRGDRIGWVKGIDGNWHLTLFIESGRLVDEGGKQLLTGVLEIAKIHKGDFRITANQNLIVANVAEADKAKIEEFARTYGLIRNDVSKLRENAMSCVSFPTCPLAMAEAERVLPDFIGELDKIMAKHGTSDDYIVTRITGCPNGCGRAMLAEIGLVGKAVGRYNLHIGGDREGVRIPRLYKENITLPEILAELDDLIGKWAAERNIGEGFGDFAIRTGIVKPVLNAPVDFWDASKAVAIARA

SEQ ID NO: 31934 - protein, 293 aa, Brassica napus
  misc_feature (242)..(242): Xaa can be any naturally occurring amino acid
EEEEVWRGMDSREIRKSSAALGYTEWFLSKDQLRVGDTVRSRKPANSFKHENMDVPEGTVVGLERDTDPDEFALVKVHGVHDPLRVHVSVLERVTNGLAAGDWVRLKDGEDKRHSLVGVIHSIDREGNVAVGFIGLPTLWKGTSSQLQMAKGYSVGQFVKIKANVVIPRFKWMRKGRGIWATGRISKVLPNGCLEVEFPGAWPFGEERGSSCLADPAEVEVVDFNTCEGVVKKYQHLEDFHXAVRPLLIAMGLLTAMKLGLFVGKKAGRSKDGKQRVLLTGKAVTVMKGSVLV

SEQ ID NO: 31935 - protein, 192 aa, Glycine max
  misc_feature (148)..(148): Xaa can be any naturally occurring amino acid
MASTDKPGGDPEYRTSSTPAPAGVDYFKFDVILRFLLFAASLVAVVVIVTANQTEVIRVPQPVPWPAKFRYSPAFVYFVAALSVTGLYSIITTLASLFASNKPALKTKLLLYFILWDALILGIIASATGTAGGVAYLGLKGNRHVVGXNKICHVYDKFCRHVGASIAVALFGSVVTVLLIWLSAYSIHSRVP

SEQ ID NO: 31936 - protein, 470 aa, Acinetobacter sp. ADP1
MSNEMHGQPSGEGELSRSLSNRHLQLIAIGGAIGTGLFMGSGKTISLAGPSILFIYLIIGVMVFFVMRALGELLLSNLQYKSFIDFSTDLIGPWAGYFVGWTYWLCWITIGIADLSAIIYYLQFFNNGMPFTPTEGAMISVAAIFFIMGLNLMTVKLFGELEFWFAMIKITAIVVLILVGLWMIFTGFTSTSGEVASFTHLWANGGFFPTGMHGFLAGFQIAIFAFVGVELVGTTAAETKNPEINLPKAVNSIPIRIIIFYVLALLIVMSVTPWNRIDPNISPFVNLFSQAGIAAAAIIMNLVVLSSVMSSMNSGVFSTSRMLFGLSKEKQAPQAFGALNKGRVPANALYFSTVCLLLGAALQYVVPNTVEAFTLATTLSTILFICVWLMIIWSYMVYYKKRPELHAKSIFKLPGGLFTCWILIIFFVGMIYVLSLEPDTMKALMVSPIWLVILVIGYFGFYKPRLKSKK

SEQ ID NO: 31937 - protein, 324 aa, Vitis vinifera
MTLNLKHAAYPDLDASTSFFGVYDGHGGKVVAKFCAKYLHQQVLKNEAYTAGDLGTSVQKSFFRMDEMMRGQRGWRELAVLGDKINKFTGMIEGLIWSPRSSSDGNDHVDDWAFEEGPHSDFAGPTSGSTACVAIIRNNQLVVANAGDSRCVISRKGQAYNLSRDHKPDLEVEKERILKAGGFIHAGRVNGSLNLARAIGDMEFKQNKFLPPEKQIVTANPDINTVELCDDDDFIVLACDGIWDCMSSQQLVDFIQEQLILESKLSAVCERVLDRCLAPSTAGGEGCDNMTMILVQFKKPITATPSGEQSSSCNQADTEPKPTE

SEQ ID NO: 31938 - protein, 196 aa, Streptococcus thermophilus LMG 18311
MIPVVIEQTSRGERSYDIYSRLLKDRIIMLTGPIEDNMANSIIAQLLFLDAQDNTKDIYLYVNTPGGSVSAGLAIVDTMNFIKSDVQTIVMGMAASMGTIIASSGTKGKRFMLPNAEYMIHQPMGGTGGGTQQTDMAIAAEHLLKTRNNLEQILADNSGQPIEKVHVDAERDNWMSAQETLEYGFIDEIMTNNQLK

SEQ ID NO: 31939 - protein, 513 aa, Glycine max
MLPRSRTLPSRIHQGIIEERHDVRPYVQVEVRPNNIQTETQAMNIQSNYSKCFDDDGRLKRTGTFWTATAHIITAVIGSGVLSLAWAVAQLGWVAGPVVMFLFAVVNLYTSNLLTQCYRTGDSVNGHRNYTYMEAVKSILGGKKVKLCGLIQYINLFGVAIGYTIAASVSMMAIKRSNCYHSSHGKDPCHMSSNGYMITFGIAEVIFSQIPDFDQVWWLSIVAAIMSFTYSSVGLSLGVAKVAENKTFKGSLMGISIGTVTQAGTVTSTQKIWRSLQALGAMAFAYSFSIILIEIQDTIKSPPAEHKTMRKATTLSIAVTTVFYLLCGCMGYAAFGDNAPGNLLTGFGFYNPYWLLDIANLAIVIHLVGAYQVFSQPLFAFVEKWSVRKWPKSNFVTAEYDIPIPCFGVYQLNFFRLVWRTIFVLLTTLIAMLMPFFNDVVGILGAFGFWPLTVYFPIDMYISQKKIGRWTSRWIGLQLLSVSCLIISLLAAVGSMAGVVLDLKTYKPFKTSY

SEQ ID NO: 31940 - protein, 286 aa, Physcomitrella patens subsp. patens
MADRGDDVAVGASRHERNPLGTSAQTREKDYIEPASSPFIDPVELGRWSFWRAGIAEFFASFLFLYITVQTVMGHNRGDACAGVGIQGIAWAFGGMIFTLVYCTAGISGGHINPAVTFGLFLARKVTFPRTVLYIVCQCLGAICGAGAVKGFQPDFYQSVGGGANTVAHGYTKGDGLGAEIVGTFVLVYTVFSATDAKRNARDSHVPLLAPLPIGFAVFLVHLATIPITGTSINPARSLGAAVIWNRDQAWNDHWIFWVGPILGATLAAMYHTLVIRAIPFSANRA

SEQ ID NO: 31941 - protein, 418 aa, Picea sitchensis
MTKKAVLVGCNYPGTKAELKGCVNDVNRMYKCLVERYCFEEENIRVLIDTDDSYPQPTGANVRRALKTLVEGSRAGDIIFFHYSGHGVRLPAETGDKDDTGYDECIVPCDMNLITDDDFREFIDKVPRDCFCTIVSDSCHSGGLIERAKEQIGESTKDGDERPEQKKQGGFGFRDLLSESVHGAFESRGIHLPSRHEHKDRRESDEGETQEIEYHGKGRVKNRSLPLSTLIEILNEKTGRHDIDVGKIRPTLFDMFGDDASPKVKKFVKVLVTKLQSCDNEGGLLGAIGNLAQQFLKQKLDGSDEGSQYVKPALQEEVSSTQEIYAGSGKRGLPDMGILVSGCQSDQTSADANPTGNPAHAYGALSNAIQTILAEHDGPIPNRQLVMKARQILSKQGFAQRPGLYCTDRLANAPFICD

SEQ ID NO: 31942 - protein, 100 aa, Zea mays
RVPHIYKNPDSYDPDRFGPGREGDKAAGAFFFISFGGGRHGGLGEPFPFLQIKGIWAPLLGNFGFEVVLPFPENDWNALVVGLKGGGVVYFKGGELFVGN

SEQ ID NO: 31943 - protein, 549 aa, Mesorhizobium loti MAFF303099
MPAVTGEANGLRGVAASEGVAIGPAFAHFPPEIAAQGRVLQASEIVGEIDRFRAAVAAVQARMDRALAQDSLSAGDRGIVAALRDIAADDSLTGEAEKAIRGGNDAVSAVITAAATIAADFSAVDDHYLNARADDVHAVGRQICLVLLGQDDVSLESMPEGAILIADDIGAWDLARAPLKRIGGVICGHGGATSHIAIIARSHGIPAVLGLGDQVNALRTARDVALDGNTGHVIVDPDAATRADYGGRVEAAAKERAGLTTFKTVTPKRADGKVIEVAANIGSLEEIEAAQEAGAMGVGLFRTELLFMRHMHLPSEDMQAETYAALAKAFAPHPVIVRTLDIGGDKPIAGIEFPDEDNPFLGWRGIRMCLDRPDIFKRQLRALLRAAVQGNIKVMLPMVSDISEVTRTRALVDECAAELKAEGVPHATFDLGVMIETPAAVLIAPALAKEVAFFSIGTNDLTQYIMAADRLNPTVAKLNDVTNPAVMSAIELTAKAGVAAGIMVGMCGEAAGRPDLIPAFIEMGLTELSMSPASIQRAKKTITAMAAGE

SEQ ID NO: 31944 - protein, 359 aa, Zea mays
MVPTHGDTAGPSSSQDDPAASVKKRNSNRPQYHPFTQQQLPACKPILAPQTVIPVLLFVGVVFIVIGLGCIAASNRVVEVVYEYETSCIPRHMLGNKVAYIQNPSIDKTCTWILKVPRDMKHPIYVYYQLDKFYQNHRRYVKSRSDKQLRDPKEANSTQQYCKPEATTEHGSAVVPCGLVAWSLFNDTYSFARGNNRALRVHKRGISWRSEREHIFGKQVFPRNFQKGALIGGGTLDPRIPLSEQEDLIVWMRTAALPTFRKLYGRIEADLRAGELVTVTTQNNYNTYSFGGKKALVLSTAGVLGGRNGFLGRGYAVVGLACLLLALLLTMLCLVFPLKEEHLALQYPLLRPATVTMHA

SEQ ID NO: 31945 - protein, 340 aa, Mycobacterium sp. MCS
MTIRVGVNGFGRIGRNFFRALDAQKAEGKSTDIEIVAVNDLTDNATLAHLLKFDSILGRLPYEVSLEGDDTIVVGDTKIKALEVKEGPAALPWGDLGVDVVVESTGIFTKRDKAQGHLDAGAKKVIISAPASDEDITIVLGVNDDKYDGSQNIISNASCTTNCLGPLAKVLNDEFGIVKGLMTTVHAYTQDQNLQDGPHKDLRRARAAALNIVPTSTGAAKAIGLVLPELKGKLDGYALRVPIPTGSCTDLTAELAKPGTAEEINAAMKAAADGPLKGILKYYDAPIVSSDIVTDPHSSIFDSGLTKVIDNQAKVVSWYDNEWGYSNRLVDLVALVGKSL

SEQ ID NO: 31946 - protein, 537 aa, Brassica napus
MASRRVSSLLSRSLISSSSLFSLRGKDPLLNRGARRYSNLAASLEDTITPPVKVEHTQLLINGKFVDSASGKTFPTLDPRTGEVIAQVAEGDVEDVNRAVVAARKAFDEGPWPRMTAYERSKILFRFADLIEKHNDEIAALETWDNGKPYEQSAKIEVPMLARVFRYYAGWADKIHGMTVRGDGSHHVQTLHEPIGVAGQIIPWNFPLLMLSWKLGPALACGNTVVLKTAEQTPLSALLVGRLLHEAGLPEGVVNIVSGFGPTAGAAIASHMDIDKVAFTGSTGRPTRPLELASKSNLKAVSLELGGKSPFIVCEDADVDQAVEMAHFALFFNQGQCCCAGSRTFVHERVYDEFVEKAKARAINRAVGDPFKSGIEQGPQVDSEQFEKILKYIRHGVDSGATLQAGGDRHGSKGYYIQPTVFSDVKDDMLIAKDEIFGPVQTILKFKNLDEVIARANNSRYGLAAGVFTQNLDTANRLMRALRVGSVWINCFDVFDATIPFGGYKMSGIGREKGIYSLNNYLQVKAVVTSIKNPAWL

SEQ ID NO: 31947 - protein, 211 aa, Moniliophthora perniciosa
MVALVQRPAPGFKATAVIEGLFQEVSLSDYLGKWVVLFFYPMDFTFVCPTEILAFNDALAEFQNLETVVLGVSTDSQYSHFAWANQPRKEGGLGPNLKLPLIADRSMSISRDYGVLLEEQGIALRGLFIIDPKGTLRQITINDLPVGRSVEETIRLVKAFQFTDKHGEVCPANWSEGGKTIKADPKSSLEYFGSAGDDASLGSAKKRPRTE

SEQ ID NO: 31948 - protein, 407 aa, Mycobacterium sp. MCS
MAVKTLEDLLNDGDREIAGRGVLVRSDLNVPLDDNGAITDPGRIIASVPTLEALAEAGAKVIVTAHLGRPKGGPDPKYSLKPVAAALSEKLGRHVQLAGDVVGTDALARAEGLTDGDVLLLENIRFDPRETSKDDGERRKLAEALVELVGDDGAFVSDGFGVVHRKQASVYDIATLLPHYAGTLVAAEVKVLEQLTSSTDRPYAVVLGGSKVSDKLAVIESLAKKADSLVIGGGMCFTFLASQGVSVGKSLVQPEMIDTCRELLDTYGDVIHLPVDIVVAPEFSADAEPETVAADRIPEDKMGLDIGPESVKRFTNLLSNARTVFWNGPMGVFEFPAFAAGTKGVAEAIIGATAKGAFSVVGGGDSAAAVRQLGLAEDGFSHISTGGGASLEYLEGKELPGIQVLES

SEQ ID NO: 31949 - protein, 887 aa, Brucella suis 1330
MAKWVYTFGDGKAEGAASDRNLLGGKGANLAEMSSLGLPVPPGFTITTEVCTYYYNNDRVYPSELDAQVQAALAHIATLTGRNFGDAEKPLLVSVRSGARASMPGMMDTVLNLGLNDETVQAIARESGDERFAYDSYRRFIQMYSDVVLGVDHGFFEEILEDTKADLGVEVDTALSADDWKNVIGLYKAKVEEELGQPFPQDPREQLWGAIGAVFSSWMNARAITYRRLHNIPAAWGTAVNVQAMVFGNMGETSATGVAFTRNPSTGENKLYGEFLVNAQGEDVVAGIRTPQNITEEACIAAGSDKPSLEKVMPEAFAEFLKVANRLEQHYRDMQDLEFTIERGKLWMLQTRSGKRTARAALKMAVEMAAEGLISEEEAVLRIDPAALDQLLHPTIDPRAERQVVGMGLPASPGAATGEIVFSSEEAEQAKAEGRNVILVRIETSPEDIHGMHAAEGILTTRGGMTSHAAVVARGMGKPCVSGAGSLRVDYRNGTMLAAGQTFRKGDVITIDGASGQVLKGSVAMLQPELSGDFGKLMEWADRARRMKVRANAETPADARTARSFGAEGIGLCRTEHMFFDGSRIVAMREMILSDTEEGRRLALAKLLPMQRSDFAELFEIMKGLPVTIRLLDPPLHEFLPHTDEEVDEVARSMGVDAAKLRDRADALHEFNPMLGHRGCRLAVSYPEIAEMQARAIFEAAVEAGKKTGEPVVPEVMVPLVGLKAELDFVKARIDAVAKEVMSEAGIKIDYMVGTMIELPRAALRAAEIAESAEFFSFGTNDLTQTTFGISRDDAAGFLTTYQNRGVIEQDPFVSLDVDGVGELVQIAAERGRKTREKIKLGICGEHGGDPASIAFCEKTGLDYVSCSPFRVPIARLAAAQAAVRKV

SEQ ID NO: 31950 - protein, 338 aa, Haemophilus influenzae Rd KW20
MAILVTGGAGYIGSHTVVELLNVGKEVVVLDNLCNSSPKSLERVKQITGKEAKFYEGDILDRALLQKIFAENEINSVIHFAGLKAVGESVQKPTEYYMNNVAGTLVLIQEMKKAGVWNFVFSSSATVYGDPKIIPITEDCEVGGTTNPYGTSKYMVEQILRDTAKAEPKFSMTILRYFNPVGAHESGLIGEDPNGIPNNLLPYISQVAIGKLAQLSVFGSDYDTHDGTGVRDYIHVVDLAVGHLKALQRHENDAGLHIYNLGTGHGYSVLDMVKAFEKANNITIAYKLVERRSGDIATCYSDPSLAAKELGWVAERGLEKMMQDTWNWQKNNPKGYRD

SEQ ID NO: 31951 - protein, 261 aa, Mycobacterium sp. MCS
MARKPLIAGNWKMNLNHFEAIALVQKIAFSLPDKYFDKVDVTVIPPFTDLRSVQTLVDGDKLRLSYGAQDVSQHDSGAYTGEISGAFLAKLGCSFAVVGHSERRTYHHEDDALVAAKAAAAFRHGITPIVCIGEHLKVREAGNHVEHNVEQLRGSLAGLTSEQIGQAVIAYEPVWAIGTGRVAGAADAQEVCKAIRDELGKLSSPQLAAGIRVLYGGSVNAKNVGEIVAQEDVDGALVGGASLDGEQFATLSAIAAGGPLP

SEQ ID NO: 31952 - protein, 342 aa, Mycoplasma mobile 163K
MIKENKTVNKTNKISIIGSGAMATAMAKVLYDSGNTNIFIYGIDEKELEDLKIGKNAKYFSTDIKLPSFNTTKDLKIALDKTDYIVLAIPSIFIQATFLEILKLLNSKVLVISVSKGFYPNSFLSIHEGLSKDSKSNEFVRGVVTVTGPSFAEEIIKEQLTTICAVDSNIKNAQEVQKLFSNKYFKLYVQSDVIGAEVGASFKNVLAIFSGIANQQGYGINTLASILSRGLKEMKLYNDKVGGKLSTLLGLTGVGDLILTATSPLSRNFSFGKEFVINKSKALETVKTVEGLKALENIYRSNKKYGLDLPIISSLYELIFENISLEEFKEKIWNRTLKSEFE

SEQ ID NO: 31953 - protein, 393 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALQYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 31954 - protein, 523 aa, Mycobacterium sp. MCS
MVAVNRPVPGVPTPAPAGWRNPLRDKRDKRMPRIAGPCGVVIFGVTGDLSRKKLMPAIYDLANRGLLPASFSLVGFARRDWADEDFGQVVYEAVKKHARTPFRQEVWDRLAEGIRFVQGTFDDEAAFATLAETLEKLDVERGTGGNHAFYLSIPPKAFPVVCEQLRRSGLARPQEGRWSRVVIEKPFGHDLESAVELNSVVNSVFPEESVFRIDHYLGKETVQNILALRFANELYEPVWNNNYVDHVQITMAEDIGLGGRAGYYDGIGAARDVIQNHLLQLLALTAMEEPVSFHPHELQAEKIKVLSAVRLAQPLDQTTSRGQYTGGWQGGEKVVGLHDEEGFSKTSTTETFAAITLDIDTRRWAGVPFYLRTGKRLGRRVTEIALVFRRAPHLPFDATMTEELGQNALVIRVQPDEGITLRFGSKVPGSAMEVRDVNMDFSYGSAFAEDSPEAYERLILDVLLGEPSLFPVNAEVELSWNILDPVLDYWASHGKPDPYESGTWGPESAFEMLRRDGREWRRP

SEQ ID NO: 31955 - protein, 69 aa, Zea mays
MADWGPVIVATVLFVVLTPGLLCTLPGRGRVAEFGSMHTSGLAILVHAVLYFALITIFLIAIGIHVYAG

SEQ ID NO: 31956 - protein, 331 aa, Triticum aestivum
MARQEAVGAATGVDFHLPDEILAVIPTDPYEQLDVARKITSMAIASRVSRLEADVARLRRDLADRDRGEADLRARLADSDARLLAALDENAKLVKERDTLALTAKKLSRNLAKLEAFKKQLMKSLSEDNLLQLSETGEDRDVDAENNGTARIPSWKDEVSSSHTSSNTSSRSTITESAQGYQFSITPYVAPQITPGSTPIISSSSGSPLAYSTGPSTPKFYSGPTSPTRSRSEDQSAFSSWNGSSHQYSAPVSPQRRSFAGRPRIDGKEFFRQARTRLSYEQFGAFLANIKEFNAQKQSREDTLSKAEEIFGTEHKDLYISFQNMLNRNQS

SEQ ID NO: 31957 - protein, 605 aa, Vibrio sp. Ex25
MSQPILSQINVFPVKSVGGLSLSSVWVEKQGLSFDRRFMIAKADGAMITARKYPQMVTIKSALLSDGVVFSSLGMEPLKIRYQDFKMQETPATVWKDTFTAYTTTDDADDWFSRVLGQRVELLFSGEQSNRVREKLGQNVSFADGYPVLVISQASLDELNRRSSEQHSMDQFRTNLVVSDTKPFEEDSWKRIRIGEVEFESLKPCERCILTTVNTQRGTFRESKEPLKTLQQFRANDVGGVFFGQNLVARNEGIIRQGDKVEVLEYKEPEFYADNSPVRMTLTCVEREEIAQDFVTLWLEPNKGSLPNYLPGQHLPIEVNIDGKKVGRRYTLSSSPSRPGRYAISVKRIAGGRVSNSLLDNLQVGDVLEAEQPDGQFHLKTHEAQPLLLLSAGSGVTPMLSMVRYLADHNQLENVVFYHQCRAENDIPCRSELEQLKRKHPGLEVKICLTQPAVDWFGLKGRLSLSHIKQIKDIEQRQVFVCGPDGFMEKAKNLLLRKGLPEENYHQEAFGVSSVTSRPEKSIAIDFNGTKVVGNNQKTLLEQLEDAGKVVSNSCRAGLCGACKVQLTSGQVHHPDVPALTDEERAMGTVLACCAVPETDVTVTN

SEQ ID NO: 31958 - protein, 513 aa, Yarrowia lipolytica CLIB122
MIIIETLIGAVVFVAVYVAFVKLDYYRRKAKFETSDMPVAYNGLLGWKGLRHMLTVFNNDIGPVGWREVFATYGKTLKYYAFPSNTILTYDPDNIKAMLATQFKDFSLGLRKEALAPSLGYGIFTLDGSSWSHSRALLRPQFSREQISRLESVETHVQEMMSCIDRNQGAYFDIQRLFFSLAMDTATDFLLGEAVGNLQEILHPEMPRTGTTFQVAFDRAQRLGSLRIICQEAFWVVGSLFWRRDFNNTNQHIHDYVDRYVDKALLARKEKSEIYTNPDKYIFLYELARETTNKITLRDQVLNILIAGRDTTASTLSWIFMELAKKPDIFHKLREAILNDFGTSCESISFESLKKCDYLRQVLNEGLRLHPVVPVNLRVAVRDTTLPRGGGPQGDKPIFVAKGQKINYAIFWTHRDKEYWGEDAEEFRPERWETTSGGALGKGWEFLPFNGGPRICLGQQFALTEMGYVITRLLQEYSDISIQPSDAAVKVRHSLTMCSAQGINISLTRAKEE

SEQ ID NO: 31959 - protein, 830 aa, Arabidopsis thaliana
MATSETRVLFLSLCLILGKVVLSQFDELWLVGDDDPLNALQTRRERREERCDYSVGKWTFDETYPLYDSSCPYLSSALSCQRNGRPDSYYQKWRWIPKACSLPRHTPHSSYFLHYFFLKFLSHQVKKLVYIGFAWFDALKFLGKMRGKRIMLVGDSMMRNQWESLVCLVQSVLPTHRKKLTYNGPTMSFHSLDFETSIEFCWAPLLVELKRGVDRKRVLHLDSIEDNARYWRGVDVLVFDSAHWWTHSQRWSSWDYYMDGNKIFKAMDPMVAYERGLTTWAKWVEINLDPSKTKVIFRTVSPRESGQMCYNQKHPLPSLSSSTKPHVPQQSRVLNKVLRTMKYRVYLYDITTMSAYRRDGHPSVFKRAMHEEEKHHRIAGPSSDCSHWCLPGVPDIWNEMLSSIILTNAIHMATEKWVFMVTAQTPTNIAVIKYWGKRDEVRILPVNDSISVTLDPDHLCTVTTVAVSPAFDRDRMWLNGKEISLSGSRYQNCLREIRGRAGDVEDMEKGIKIRKKDWEKLNLHIASHNNFPTAAGLASSAAGFACLVFSLAKLMNVDEDPSHLSAIARQGSGSACRSLFGGFVKWTMGSKEDGSDSVAVQLADEKHWDDLVIIIAVVSSRQKETSSTSGMRESVETSLLLQHRAKEVVPKRILQMEEAIKNRDFASFTQLTCTDSNQFHAVCLDTSPPIFYMNDTSHRIISLVEKWNRSEGTPQVAYTFDAGPNAVLIARNRKVAVQLLQGLLYYFPPKSDTDMKSYVVGDNSILKEAGLDGASGVENLQPPPEIKDNIGSQDQKGEVSYFICTRPGKGPIVLHDQTQALLDPETGLPK

SEQ ID NO: 31960 - protein, 310 aa, Streptococcus thermophilus LMG 18311
MNMTIYNSITELVGRTPIIKLNSIVPEGSADVYVKLEAFNPGSSVKDRIALRMIEDAEKAGIIKPGNTIIEPTSGNTGIGLAWVGAAKGYKVVIVMPDTMSVERRKIVQAYGAELVLTPGSEGMKGAIAKAKEVAAERDGWVPLQFANPSNPAAHADTTGQEILEDFGADGLDAFVAGIGTGGTISGVSKTLKAANPNIKVYGIEADESAVLNGDKPGPHKIQGISTGFIPDTLNTKSYDSVIRIPSDEAISTSRTLGSKEGFLAGISSGAAIAAALKVAAELGEGKKVLTLLPDNGERYLSTTLYDFQN

SEQ ID NO: 31961 - protein, 356 aa, Yarrowia lipolytica CLIB122
MSKPKPSEVRTLAFNVSDHYQILDMVGEGAYGIVCSALHTPSGQKVAIKKITPFGRSMFCLRTLREIKLLRHFSHENIIGILDVQKPASFESFNEVYLIQELMDTDLHRVIRTQELSDDHCQYFVYQTLRAIKALHSANVLHRDLKPSNLLLNASCDLKICDFGLARSAASTEDNFGFMTEYVATRWYRAPEIMLTFKEYTKAIDMWSIGCILAEMLGGRPLFPGRDYHSQLTMILDVLGTPTMEDYYSVKSRRAREYIRSLPFKKKLPFSQLFPKANPLAIDLLEKLLTFNPAKRITVEEALVHPYLEQYHDADDEPTAEPIPDEFFDFDRNKDELSVEQLKTLIYNEIMYWKRP

SEQ ID NO: 31962 - protein, 560 aa, Oryza sativa
MPAPIARSLCPLALSASPTATTGSGAAPESGGGGRSGIRRGSAATEGHTGAQQGRALGAMDAKKGSGEPEFFSEYGDASRYEVTEVVGKGSYGVVAAAVDTHTGGRVAIKKINDVFEHISDATRILREIKLLRLLRHPDIVEIKHIMLPPSRREFRDIYIIFELMESDLHQVIKANDDLTPEHHQFFLYQLLRGMKYIHAASVFHRDLKPKNILANADCKVKICDFGLARVSFDDTPSAIFWTDYVATRWYRAPELCGSFFSKYTPAIDIWSVGCIFAEMLMGKPLFPGKNVVHQLDLMTDLLGSPSGETISRIRNEKARRYLGNMRKKPRVPFSQKFPGADPMALHLLERLLAFDPKDRPTAAEALTDPYFTGLANSEREPIAQPISKLEFEFERRKLAKDDVRELIYREILEYHPQMMQKYLRGGDQSNFLYPSGVDRFKRQFAHLEEGVAQGDKTSPQLRQHVSLPRERVVRNGDEPDPTADYCIKLHVGEQPGHSSVTDGLNKPLLSARNFLKSESIGASQCVVIKEKREKDEESMSEYMNEAADGVPHKIAQLKT

SEQ ID NO: 31963 - protein, 423 aa, Acinetobacter sp. ADP1
MSLSYEIENNGAWQTYLAQVDRVAPYLEADLIPYINTLKRPKRALIVDVPIVMDDGAIQHFEGYRVQHNLSRGPGKGGIRYHPDVELNEVMALSAWMTIKTAVLNLPYGGAKGGIRVDPKKLSARELERLTRRFTSEISPIIGPQNDIPAPDVGTNADIMGWMMDTYSSIKGHTVTGVVTGKPVHLGGSLGRVRATGRGVFVTGLEVAKKINLSIENSRVAVQGFGNVGSEAAYLFNKANAKVVCAQDHTGTIFNDDGLDVKSLQEHVAQTGGVAGFPDSSKIEDAEFWNVEMDILVPAALEGQITAERAQTLKAKLVLEGANGPTYPDADDVLGQRNIIVVPDVLCNAGGVTVSYFEWVQDMSSYFWTEDEINARLDKLMIQAVDDVWKKAQEKSCTMRTAAYILACERILKARKERGIFPG

SEQ ID NO: 31964 - protein, 83 aa, Raphanus sativus
MASQQEKKQLDERAKKGETVVPGGTGGKSFEAQQHLAEGRSRGGNTRKEQLGSEGYQQMGRKGGSTPDKTDKEDAEDEPSTRT

SEQ ID NO: 31965 - protein, 499 aa, Picea sitchensis
MDKKGSCFSVLKWAFCAKQKSHATKQGKKKGGCCFGSFRHHEPAAPKEDTRVKKTLGEGQEIRNEHEKPLVEVKEEQNSHASAVAVATAAAAEAAAAAAHAVAKVVRLTESYYSTNSPEECAAIKIQTAFRGYLVRRNFHTLRGLMRLQALVQGQSVRRQATNTMRCMQALVRVHSQICSRRIRMFEENQALQHHLQQKYEKELENRTSNSEADHQQDWESSLLTKEEIEARLQSKIEAAIKRERALAYAFSHHLWKNPPKSVQTMLMEIDPDKPHWGWSWLERWMATRPWDNHRMTMKENSTRKLQTIGEIGQKTSHIGLKQHNAEVTNIGTIKSDPFTPLSKPSIPNKMPLTGTDIKSDVNVLRSERPRYSSRYGVAGTSSLRDDESLMSSPRIPNYMASTESAKAKVRSQSTPKQRPGTPDTEPTSYRRKRLSFPLSEASSGPYRSTKGSMFPHTSPSLKGISGTSKSKKSVSSLRDLSIESDNSSLNWGHRKPFR

SEQ ID NO: 31966 - protein, 314 aa, Oryza sativa Japonica Group
MEDGLRRQEPEALALLFFLSSDETTMNQWRDPRRRRMERHRDKGGAGPLLSQGGRCKDAAREEQGAGPLPLKGREAHGRCHRRRDYISIADVWGRRSGAICSRFDLGFEPLGRGGDHWVGFGGEGGEKEEGGKMGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 31967 - protein, 543 aa, Oryza sativa Japonica Group
MDGVPDAQRTTSPSMIKQQNYFNYPYAFNSILLSTPSFLPSFLPSYLYEVPAAEEAMGICCSKGKEELEEGFPWKHDAFFHDQLWSAGVSMHTKQGWKGANQDAMTTCQDFAGHKGQIFCGVFDGHGPLGREVARHVRDVLPMKLSSSLALKTEQDPSSNTDKEALEKSDCTSLSDTSNEKQLLSTWKNIFVKTFEDVDDDLRQNSGIDCICSGTTAVTVVRQGDHLIIANLGDSRAVLCTRDSKDRPIPVQLTTDLKPNLPSEAERILNCKGRVFAMDDEPDVSRMWLPDQDAPGLAMARAFGDFCLKSHGLICTPEVYYRKLSEKDEFLVLATDGIWDVLSNKEVIKIVSSATDHSKAAKQLVERAVRAWRRKFPTSMVDDCAVVCLFLKPSPSSEESTHVDAKAPQVVSFTGSFRKALGGGGGGEAEEVEKIYRRSIRTVTRDIWDKVSARLDCDHISTTHNPDETLLDWWERRTEQNDKDKTKGTRSIHMLLSWEIWCERNRRVFRNKELAISQLVTKILDEINVWIACGAKNLARIVL

SEQ ID NO: 31968 - protein, 340 aa, Picea sitchensis
MSWCTIESDPGVFTELIQQMQVRGVQVEELYSLDLESLNNLCPVYGLIFLFKWRPGEKDDRSVLKEYSPNLFFASQVINNACATQAILSILMNCSEIDIGPELSNLKEFTKNFPPELKGLAINNSEAIRAAHNSFARPEPFVSDEQKVADKEDDVYHFISYIPVDGTLYELDGLKEGPISLGQYNGSRESLEWLKLVQPVIQERIEKYSKSEIRFNLMAIIKNRLDIYKAEQRDLENRKKQIQQQLDASKCNGDDRMDVDNGSGRQSASVEGLNRSLVEIDFELANVEQKLSIEKDKFKKWKTENIRRKHNYIPFLFNFLKILAEKDQLKPLIEKARHKT

SEQ ID NO: 31969 - protein, 115 aa, Zea mays
MLAATDPMLWHKVAAVSGVAALGLGTYGAHMFRPKNPAYKEVWHTASLYHLVHTAALLGAPITKRPNVFGGLLTAGIVLFSGTCYTVAYLEDRKFSSPAPLGGFAFIAAWASLLF

SEQ ID NO: 31970 - protein, 525 aa, Shewanella sp. MR-7
MSDIHEHKILILDFGSQYTQLIARRIREIGVYCELWAWDVTEAQIREFAPNGIILAGGPESVTADNSPRAPEYVFNAGVPVLGICYGMQTMSEQLGGKVIQGVGEGEFGYAQIEMLAQSALFKDIEDAVNSDGKSLLDVWMSHGDKVSAIPEGFVAVAKTDTCPFAAMSCEEKRFYGVQFHPEVTHTRQGMRMLSHFALDICGCAANWKPSSIIEDAIERLKKQVGDDEVILGLSGGVDSSVVAMLLHRAIGKKLTCVFVDNGLLRLNEAKQVMEMFGDHFGLNIVHIDAENRFLDALKGEADPEAKRKIIGRVFVEIFDEEAKKCVNAKWLAQGTIYPDVIESAGSATGKAHVIKSHHNVGGLPDDMELGLVEPLRELFKDEVRKIGLELGLPYNMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEIDGISRVVYDISGKPPATIEWE

SEQ ID NO: 31971 - protein, 296 aa, Desulfitobacterium hafniense Y51
MKIGFIGLGIMGKPMSLNLLKAGHEVVVYNRSPKSVQECVQAGAEAGASPQDVAERCPLIITMLPNSPQVKEVILGPNGVLEGAQPGAMVIDMSSIAPGASQEVAQKLAEKNVRFMDAPVSGGEPKAIDGTLSIMVGGKSEDFEEFLPVLKAMGSSAVLCGDVGAGNVTKLANQIIVAVNIAAVSEALTLATKAGANPETVYKAIRGGLAGSTVLDAKGPMMLERRFDPGFRINLHIKDLNNVLETGHDIGSPLPITATVMEMMQTLKSYDLDHQDHSALVQYYEKLAGIEVKKAD

SEQ ID NO: 31972 - protein, 583 aa, Legionella pneumophila str. Lens
MSFSKISKTLESNSILKKEIDNQEVLGLAQSSGGEEPPMIPDEMLFALLNRVGVNRVQQACIDGNLHVLERMNCDEFEYVDSHGTTTLMLAIEHDHKAIAYYLLRSRMINLNLHKKDNAGRSALSMAKEKGWDDIVDLIRNTMENPVCNNMELYYATINGYLDSVTELLPKIDEPGFATKATWINTYPLFGNIFHAACCGGNLEIVKLLMEHGAEINSRSYNRERHNFYYATTPILVACRYGHAHLVEYLLTQDGIQYDIIELFHIAVEYGHYAVMDLLLRKIRAENIALDLNRGLEFHASWYGTPLDKACRSGQVDIVDRLIAEGIDMKEEDNISAITTAIWNADNPEYPAIDILDRLLAECDRQGISIPLTAPEIAIIACNRNRADILDRLIIRGFDFNLGNRHGEYPLITAAIKGHEAIVDRLLSLSVDVNQRDSEGKTALFQAARHNNLEIVKLLVNNGADINIPDNKGVTPLMYVAETCFTAVVKYLLNSGADTSLKDNQGRSALDCAKPYTFWGQENLALIRDADIQQNSYKSSSSSAQSSNNPYTLWSSNTTSLTEEEGVKSETITEEKALTFQSK

SEQ ID NO: 31973 - protein, 495 aa, Mycobacterium smegmatis str. MC2 155
MNRTPSPVDPCDFVIFGGTGDLAARKLLPALYLRDRDGQLAGATRIIGVAKAGLDDAGYRNTVRAGLARHVEPDLLDSDVVDRFLSRLRFVSVDLTEPSDYAAVGDVLTSPDGGSGHDIRVFYLACAPALFGPICGALGAQGLVTESSRVVLEKPIGRDLASAQQINEAVGAVFAEHQIFRIDHYLGKESVQQLLVTRFGNTWLEPLWNSSRIDHVQITAAESLGVGARGDYYDQSGALRDMLQNHLLQVLCLVAMEPPTHVNRESVRDEKRKVLEALEPLTAEQTQRDTVTGQYGPGLVGDEVVGSYREEVADPHSRTETFVAVKAHIRNWRWAGVPFYLRTGKRMSQRFSEIVVQFKPVPLPMFPGIEGTSEPNRLIISLQPDEAIRLEMTAKEPGSGGRLRPVSLALNYTEAFPERSPDAYERLLMDVVRGDPTLFMRRDEVEAAWAWAEPILRHWQDADRVPRTYPAGTDGPVDAATLIERDGRRWHGGAA

SEQ ID NO: 31974 - protein, 56 aa, Triticum aestivum
  misc_feature (12)..(12): Xaa can be any naturally occurring amino acid
  misc_feature (24)..(24): Xaa can be any naturally occurring amino acid
  misc_feature (29)..(29): Xaa can be any naturally occurring amino acid
  misc_feature (42)..(42): Xaa can be any naturally occurring amino acid
MTTSRRVADRKXAVFEKNITKRGXVPETXKKANDYPVGLTVXGFLPLVVVGHPVPN

SEQ ID NO: 31975 - protein, 648 aa, Candida albicans SC5314
MSKTTEIFCRLPKSVELIQDFKDITPSPKANAECRAALYSKNGDFFAYTQPQEVVILDTTGEAKVYHRIEIPEVFDIYFSPEGTYLCLWCKPIQLNKENGTWNNNLKIFNIKTKTIIAEWSAKHQNAWKPQFTSEENLFARSINQKEIHFFELDPTSDSTVNINQPSFKYKVNDPKATLQAFQISPGRNPSVAIFIPEKSGKPANVSIYNIPNFNQPICFKNFFKAEKCQLKWNSLGTALLALASTDHDTTNKSYYGETNLYLLGIAGSYDSRIDLKREGPIHDITWSPTAREFAVSYGYMPSETTFFDSRGNAIHSLPTAPRNTILYSPHAKFVLVAGFGNLQGTVDVYDRQNKFSKVVTFEASNTSVCEWSPCGRFILTATTSPRLRVDNGCKIWHASGKLIYLKEFPELFSIGWKPQPLDCFPPIRNLEPAPEAHESTKEYLEKRQALASAAAKKPAGAYRPPHARGGGAGSGSGVASSLYQKELQNNLRSNGSTPSPPPGLSRAAGNIPRVRTVVGAPPPVEKESKAAAKNRKKREAKKQAQEKNNSPAPEATTSASPVPAQAQAPISTPAPPAPTPATATAGVIGGVASLEEKKIRSLLKKLRAIEQLKMKQASGETLEDTQVIKISKEDEIRSELQTLGWNE

SEQ ID NO: 31976 - protein, 163 aa, Bacillus cereus G9241
MDKQIGFIGCGNMGMAIVGGMLNKHIVPSNHIICSDLNTTNLENASEKYGISITTDNNEVAKNADILILSIKPDLYPLVINEIKEVIKNDAIIVTIAAGKSIESTENAFNKKLKVVRVMPNTPALVGEGMSALCPNEMVTEKDLEDVLNIFNSFGQSEIVSEK

SEQ ID NO: 31977 - protein, 261 aa, Cucumis sativus
MAISKTLSFGFLLLVSLGLASAARSLLSYDIPPHRSGYDNYDHPVVNPKVGYEHDRRDGYYHDRDHHDAPYGGGAGGGYGAGAGAGSSLGGSGYGSGGGGGSGYGGVGNHEVGYGSGGGGGYGAGVGSDLGGSGYGSGGGGGTGGGYGDLGGRGKGYGSGGGGGSGYGGRGDHGVGYGSGGGGGYGSGVGGGAGVVDHGVGYGSGGGGGAGSGYGGSKGYGGGSGGGGGAGYGGGAHGSGYGSGGGAGSGEEGGYDGGYAP

SEQ ID NO: 31978 - protein, 224 aa, Triticum aestivum
  misc_feature (160)..(160): Xaa can be any naturally occurring amino acid
MATKEAKVVPAGDVDAAVDGEDLVPVLASLEPVYGAGSALDEARLRFARLADRFRALYAAGPALFARSPGRVNLIGEHIDYEGYSVLPMAIRQDMIVAIRRADGGLVRVANVDDKYATCVYPADPDKEIDIKNHKWGHYFMCGYKGVYEYARPKGIDMGXPGALDGRVDGPVPQGSGLSSSAAFVCSGTNCYPGNSRGTNFPKERKRPKFSCKSGPPFGAPSGG

SEQ ID NO: 31979 - protein, 490 aa, Neisseria gonorrhoeae FA 1090
MNQTSRDLTRISHNTKIVATLGPGSNNVELLEDMIRVGGLNVVRFNFSHGTPEFHQENARIVREAAKRAGQEIAIIADLQGPKIRVGKIAGGGIELNKGETLVLDAALEGEGTREAVGLDYRDLPDDVAAGDVLWLDDGLLTLTVESVEGSRIITRVENSHILKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQTEYPEAVSTNLAIAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 31980 - protein, 603 aa, Saccharomyces cerevisiae YJM789
MPRNPLKKEYWADVVDGFKPATSPAFENEKESTTFVTELTSKTDSAFPLSSKDSPGINQTTNDITSSDRFRRNEDTEQEDINNTNLSKDLSVRHLLTLAVGGAIGTGLYVNTGAALSTGGPASLVIDWVIISTCLFTVINSLGELSAAFPVVGGFNVYSMRFIEPSFAFAVNLNYLAQWLVLLPLELVAASITIKYWNDKINSDAWVAIFYATIALANMLDVKSFGETEFVLSMIKILSIIGFTILGIVLSCGGGPHGGYIGGKYWHDPGAFVGHSSGTQFKGLCSVFVTAAFSYSGIEMTAVSAAESKNPRETIPKAAKRTFWLITASYVTILTLIGCLVPSNDPRLLNGSSSVDAASSPLVIAIENGGIKGLPSLMNAIILIAVVSVANSAVYACSRCMVAMAHIGNLPKFLNRVDKKGRPMNAILLTLFFGLLSFVAASDKQAEVFTWLSALSGLSTIFCWMAINLSHIRFRQAMKVQERSLDELPFISQTGVKGSWYGFIVLFLVLIASFWTSLFPLGGSGASAESFFEGYLSFPILIVCYVGHKLYTRNWTLMVNLEDMDLDTGRKQVDLTLRREEMRIERETLAKRSFITRFLHFWC

SEQ ID NO: 31981 - protein, 478 aa, Pyrococcus abyssi GE5
MIAMRLPDHKTKIVATIGPATSSRNMIKKLIENGVSVVRLNFSHGSFEEHAKVIEKVRDISQKLDRRVAILADLPGLKIRVGEIKGGYVELKRGEKVVLTTRDVVGDETTIPVEYKDFPRLVSKGDVIYLSDGYIVLRVEEVRGQDVEAVVVSGGKLFSRKGINIPKAYLPVEAVTPRDMEIIKFAIEQGVDAIGLSFVGSVYDVLKVKSFLEKNDAEDVFVISKIERPDAVRNFDEILKASDGIMIARGDLGVEMPIERLPILQKELIRKANTEGKPVITATQMLVSMTAEKVPTRAEVTDVANAILDGTDAVMLSEETAIGKFPIDAVKMMAKIAKVTEEYRESFGMSRLRELVEDGTRGTIKEAIARSIIDALCTLNIKYILTPTRTGRTARLISRFKPKQWIFGFSTNERVCNNLMFSYGVYAFCLEEGFDERDIIRLIKGLGLVESDDIVLMTEGKPIEKTMGTNSIKIFQIA

SEQ ID NO: 31982 - protein, 332 aa, Saccharomyces cerevisiae YJM789
MVRVAINGFGRIGRLVMRIALSRPNVEVVALNDPFITNDYAAYMFKYDSTHGRYAGEVSHDDKHIIVDGKKIATYQERDPANLPWGSSNVDIAIDSTGVFKELDTAQKHIDAGAKKVVITAPSSTAPMFVMGVNEDKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVDVSVVDLTVKLDKETTYDEIKKVVKAAAEGKLKGVLGYTEDAVVSSDFLGDSHSSIFDASAGIQLSPKFVKLVSWYDNEYGYSTRVVDLVEHVAKA

SEQ ID NO: 31983 - protein, 131 aa, Brassica napus
MASSDGLASVDPWSFRQSFNIDSWLLPDPFSHDSDVLAKALHKSISDPLSPSAYFDSVAVSDLSPPQTISNVSFGSDPEIAVGGGGGGGKRKRGPGVAGGKPAKRRSRVSTKKSQTTFITADAANFRQMVQ

SEQ ID NO: 31984 - protein, 518 aa, Oryza sativa Japonica Group
MAADTSKPFFPAAPNPALLPSGRKPSRLSPEASYWRSFRASELTPANEFNVTHLAFSPSSAPTLAASLSTSVLLFSGDPLSPLPRIPASQDVAFSPSFRSDGSLLAVGDKKGVVRVFRADKKQSSGALRTLTAHTAETRVVRYPVAGGDKVHLFTAGDDALLAYWDVPSETPVFAAPAAHRDYIRAGAASPADHNIFATGSYDRIVKLLGRPHGEDVDAVLLPWRIAGGNVVRIWDVIGGGRLLHSVESHVKTVMALALAKMTNTGETRLLSAGSDGYVKSFDYGELKLTHSMRYPKELLSLACSPCGTVLVAGSSKGTIYMGRRKKKSTGEDEEEGKGVGGELDWAPTKPEKRRLAPSNYRYFLRGQNAKAKEGDLVIEKPKKVKVAEHDKLLRKFRHKDALVSALARNNPRSIVAVMEELVSRRKLVRCIENLDTEELVLLLLFLHRNATLPRYARFLMGVANKVLEMRADDIRSDENLRGCVRNLKRMAAEEIQIQHTLQGIQGMISPMLALASR

SEQ ID NO: 31985 - protein, 804 aa, Oryza sativa
  misc_feature (503)..(503): Xaa can be any naturally occurring amino acid
  misc_feature (749)..(749): Xaa can be any naturally occurring amino acid
MLLPCHVLLGLLLLSLHTPASSAAATDTVSPGHSLAGSDRLVSNNSKFALGFFKPGNESSYTNHNSYLGIWFNKVSKLTPLWTANGENPVVDPTSPELAISGDGNLAILDHATKSIIWSTRANITTNDTIAVLLNNGNLVLRSSSNSSNIFWQSFDYPTDTLFAGAKIGWDKVTGMNRRLVSRKSSVDQAPGIFSLELGLNGEGHLLWNSTVAYWSSGDWNGRYFGLAPEMIGDVMPNFTFVHNDKEAYFTYTLYDDTAIVHAGLDVFGIGFVGMWLEGNQEWFKNYRQPVVHCDVYAVCGPFTICDDNKDLFCDCMKGFSVRSPKDWELDDQTGGCIRNTPLSCGSSKDRTSLTDKFYPMQSIRLPHNAENVQAATSGDECSQVCLSNCSCTAYSYGKDGCSIWHDELYNVKQLSDASSDRNGGVLYIRLAAKELPGSEKKKNRNISGFAIGASTATLFLMILLLILWRRKGKWFTRTLQKPEGGIGVVAFRYINLQRATKXFSEKLGGGSFGSVFKGYLGNSTIAVKRLDGAYQGEKQFRAEVNSIGIIQHINLVKLIGFCCEGDNRLLVYEYMPNRSLDVCLFEANDIVLDWTTRYQVATGVARGLAYLHNSCRDCIIHCDIKPENILLDASYVPKIADFGMAKILGREFSRAMTTMRGTIGYMAPEWISGTVVTSKVDVYSYGMVLFEIISGRRNSSHECFRDGDYSFFFPMQVARKLLNGDIGSLVDASLKGDMNLVEVERACXACWCIQDNEFDRPTMAEVVQALEGLLELDMPPLPRLLSAITGDSHSVTPQYFDSV

SEQ ID NO: 31986 - protein, 192 aa, Physcomitrella patens subsp. patens
KLYIGNLPWQCDSAQLAGICQEFGSVELVEVIYDQESGRSRGFAFVTMATQEDAENVIERLDGHDVGGRPLKVSFPQSKQNRPSFPRGEGYQRSERAPRPAARDDPNKVFVGNLSWGVDNGALQELFSDYGKVVDARVVYDRESGRSRGFGFVTYSDVSEVDAAIDSLDGAEFDGRELRVNLAGNKPASKDY

SEQ ID NO: 31987 - protein, 352 aa, Bacillus cereus G9241
MYKGLLNQYASYLPVNENTPDVSLMEGNTPLIPLLNISKQLGIQLYGKYEGANPTGSFKDRGMVMAVAKAKEEGSEAIICASTGNTSASAAAYAARLGMKCIIVIPEGKIAHGKLAQAVAYGAEIISIEGNFDDALKAVRNIAAEEPITLVNSVNPYRIEGQKTAAFEICDQLQSAPDVLAIPVGNAGNITAYWKGFCEYEKEKGYKKPRIHGFEAEGAAAIVKGHVIEEPETIATAIRIGNPASWSYAVEAAEQSHGEIDMVSDEEILHAYRLLAKSEGVFAEPGSNASLAGVIKHVQSGKIKKGETVVAVLTGNGLKDPDIAISSNTLDIASVSNNIEQIKEHIKGVIMS

SEQ ID NO: 31988 - protein, 248 aa, Mycobacterium sp. MCS
MSTSSGELEDLAVAAAQTGADLCLRRLGEPLIVSTKSAAGDVVTPVDRAAEEAVREILLAARPGDSVLGEELPAHTGVSGLEWVVDPLDGTTNYTRLIPYFATSVAVRRTTDGVWLAGAVTAPALGATWSAARGGGAQLRSPAQRAVLPLQLPATSARLIGTGLSYDPGRRRRQVRELGALVADYTDMRRFGAAAVDLCLVAQGSLHAFVEDDLAVHDWAAGALIAEEAGATVCRPADGDETVSARWG

SEQ ID NO: 31989 - protein, 327 aa, Mycobacterium sp. MCS
MVPMYAIEVSETGGPEVLTHVEKEPPSPGPGQVLIKAEAIGVNFIDTYFRSGLYPREVPFVVGTEVCGTIEAVGDDVAALQVGDRVVTDKAVGAYAEYTVAPADFVAYVPDGVAPAVAASSLLKGMTAHYLIKSTYPVQQGDTVLLHAGAGGVGLILTQWATSLTAKVITTVSTPQKAELSRQAGAIEVLDYPHDPQEFGARIRDLTGGNGVAAVYDGVGAATFDASLASLAVRGTLVLFGGASGPVPPVDPQRLNSAGSVYLTRPSLVHYTRTPDEFSWRAGEVLDAIAKGAITVTVSEHYPLQEAERAHRDLQGRKTVGSVVLVP

SEQ ID NO: 31990 - protein, 364 aa, Physcomitrella patens subsp. patens
SQILHSLPDQLAMKCLARVPLSSLRGVSKTWQNVIYDPYFQSLRTTNGRSQLEWVYALVQSQDKSFRWRAFDPLSSVWYDLPPTPYPMEFQLHNPGCIGVSYFVQCASTLDKLVMVAGLKAKKDGRNRMIMEPALEQPYIFDTRTSEWKLGTRFSVPRKWCVCGVVQEKVYVASGSGKDWDREVSKSAEFYNLVNDNWEKMMSLSTSKFSGEAMTAVTNDNKLYFVSGRGVFSKEGVVYDLATDSWSDMAPGLKRGWTGPCVAVNGRFYLLETPAGRLKVYVLEKDDWDVIMEDARLGNLEMFVGAKGKIVSIVGLGMDTQPSAGSVLRVIDIASEAPQIYDIPVNEGKVISVQVLGMMGRRPN

SEQ ID NO: 31991 - protein, 102 aa, Mycoplasma pneumoniae M129
MVTEIKSLKQLGELFASNNKVIIDFWAEWCGPCKITGPEFAKAASEVSTVAFAKVNVDEQTDIAAAYKITSLPTIVLFEKGQEKHRAIGFMPKAKIVQLVSQ

SEQ ID NO: 31992 - protein, 505 aa, Oryza sativa
MVLSHASSGRDDAVRCTFATRYACETLPRFRMPEQSIPREAAYQIINDELMLDGNPRLNLASFVTTWMEPECDKLIMDSVNKNYVDMDEYPVTTELQNRCVNMIAHLFNAPIKEDETAIGVGTVGSSEAIMLAGLAFKRKWQNKRKEQGKPCDKPNIVTGANVQVCWEKFARYFEVELKEVKLSEGYYVMDPVKAVEMVDENTICVAAILGSTLTGEFEDVKLLNNLLTEKNKETGWDVPIHVDAASGGFIAPFLYPELEWDFRLPLVKSINVSGHKYGLVYPGVGWVIWRSKEDLPEELIFHINYLGTDQPTFTLNFSKGIQEHHAELHGEHSNTKGRHRGDWSIRNPLQGGRCALGGVLAQGQRQVHRVRHLRAPEEVRLDRAGVHHAGQRRARRRPPRRHQGGLQPEPRRAARLGHRQDPARAGRPFGPGAEDLQRHREAAIGRRWRGHQEERPGDREGDLRVLEGPGEEEADRNLLVWLCEKCLNNVACSICAWDGRIGWD

SEQ ID NO: 31993 - protein, 474 aa, Brucella suis 1330
MREMLMRPVVLAGGKGTRLWPMSRSQRPKQFLALTGELSLFQMTLKRLSDPNRYSSPIIITNADYRFLVAEQALECGVELSDVILEPMARNTAPAIAAAALIASKDEQTLIHVVASDHNIEINDAYFQAVDTACNAARMGRLATFGITPTEPATGFGYIEAGELEESGACAIKRFVEKPKEEVAREMLAAGGFYWNSGMFLFRSDVFLDECRRYAPAVYEAAEASVATAQRDLDFVRLNSAEFEKAPDISVDYAIFEKTKLASVVPSPIHWSDLGSWDAVWKESKQDPSGNVARGPVSLHNTNNSLVLSEGVHVAVNGVDDLTIVASEDALYVGKLSEAQGVGTIVKALMKQPATAKLAEEHRTIYRPWGGYTHLLSGDRFQVKRLFIKPGKQLSLQKHHHRSEHWVVVRGVAEIVIDDKSLFLSENESTYISQGAIHRVSNPGKILLELIEVQTGAYLGEDDIVRFEDDFGRV

SEQ ID NO: 31994 - protein, 302 aa, Physcomitrella patens subsp. patens
MENYEKLEKIGEGMYGKVYKARDRRTGALVALKKIKIENEEEGIPATTLREVSLLQMLSKCIYFVRLLGVEHLHKNGKPALYLVFEYIDTDLRRFLDLSWPGLDNPLPQNTIKSFVYQLLKGVAHCHSHGVMHRDLKPQNLLVDWSKGLLKIADLGLGRAFTVPVKSYTHEVVTLWYRAPEILLGASHYSTPVDMWSVGCIFAELCRKTPLFPGNSELQQLLYIFRLLGTPNEQVWPGVTTLRDWHAYPQWRAHDIAQAVPGIEPSGVDLLDRMLQYNPANRISAKEALIHPYFDNLDKSQY

SEQ ID NO: 31995 - protein, 452 aa, Streptococcus thermophilus LMG 18311
MKVIKFGGSSLASATQLEKVLNIVKSDPERRFVVVSAPGKRNDEDTKVTDALIKYYKHYIKGADVKADQEWIINRYQAMVDELGFKSKEMVKIAKAITDLATLPIEDNDFLHDTFLAAGEDNNAKLIAEYFRNNDIEARYVHPREAGILVSSEPGNARILPGSYDKLEELRESDEVLIIPGFFGVTSDNQICTFSRGGSDITGSIVAAGVKADLYENFTDVDGIFAAHPGVVYEPHSIPELTYKEMRELAYAGFSVLHDEALLPAYRGKIPLVIKNTNNPDHPGTRIILEHQGATVPVVGIASDDKFVSINMSKYLMNREVGFGRKVLQILEDLNIRWEHMPSGIDDLSIIIRERELTPIKEQEILSYLTRELGVDEVEIEHGLSILVIVGENMRDHIGVTATAAKALSEKNINLEMISQGSSEVSVMFVIETEQEKEAVRALYDAFFRSNN

SEQ ID NO: 31996 - protein, 265 aa, Mentha x piperita
MASVKKLAGKVAIVTGGASGIGEVTARLFAERGARAVVIADMQPEKGGTVAESIGGRRCSYVHCDITDEQQVRSVVDWTAATYGGVDVMFCNAGTASATAQTVLDLDLAQFDRVMRVNARGTAACVKQAARKMVELGRGGAIICTASATVHHAGPNLTDYIMSKCGVLGLVRSASLQLGVHGIRVNSVSPTALATPLTATIGLRTAADVESFYGQVTSLKGVAITAEHVAEAVAFLASDEAAFVTGHDLAVDGGLQCLPFVAVAK

SEQ ID NO: 31997 - protein, 311 aa, uncultured archaeon
MPLDPQIKPILERIRALSIAASPQELRRQVEEQSRLLTAAVQEPIAETRDVHIPVSGGSIRARVYFPKKAAGLPAVLYYHGGGFVFGSIETHDHICRRLSRLSDSVVVSVDYRLAPEYKFPTAVEDAYAALKWVADRADELGVDPDRIAVAGDSAGGNLAAVVSILDRNSGEKLVKKQVLIYPVVNMTGVPTASLVEFGVAETTSLPIELMVWFGRQYLKRPEEAYDFKASPLLADLGGLPPALVVTAEYDPLRDEGELYAYKMKASGSRAVAVRFAGMVHGFVSFYPFVDAGREALDLAAASIRSGLQPS

SEQ ID NO: 31998 - protein, 256 aa, Chromobacterium violaceum ATCC 12472
MDALHGKARDGFSREAQAYERGRPEYAPELADWLRRQLGLNDRAIALDLGAGTGKFSRLLATVAGETLAVEPVEAMRAQLQARLPSLRALPGTAEAIPLPDASVDAVTCAQAFHWFANERALSEIHRVLKPGGRLGLVWNVRDESCGWVAQISALLAPYEGYTPRFHSGEWRRPFETAGYFAAPALTALPHRHVGPPERVIIDRFLSVSFIAALPDDEKRRFAEALRRLIATHPDLRGRDVVAFPYRTEAYRCVRR

SEQ ID NO: 31999 - protein, 2126 aa, Mycobacterium bovis AF2122/97
MNSTPEDLVKALRRSLKQNERLKRENRDLLARTTEPVAVVGMGCRYPGGVDSPETLWELVAHGRDAVSEFPADRGWDVAGLFDPDPDAVGKSYTRCGGFLTDVAGFDAEFFGIAPSEALAMDPQQRLLLEVSWEALERAGIDPITLRGSQTGVFAGVFHGSYGGQGRVPGDLERYGLRGSTLSVASGRVAYVLGLQGPAVSVDTACSSSLVALHLAVQSLRLGECDLALVGGVTVMATPAMFIEFSRQRALSADGRCKAYAGAADGTAFAEGAGVLVLARLADARRLGHPVLALVRGSAVNQDGASNGLATPNGPAQQRVITAALASARLGVADVDVVEGHGTGTTLGDPIEAQAILATYGQRPADRPLWLGSIKSNIGHTSAAAGVAGVIKMVQAMRHGVLPKTLHVDVPTPHVDWSAGAVSLLTEPRPWHVPGRPRRAGVSSFGISGTNAHVILEEAPAVEPVGAAHGNDPVAVPWVLSARSAQALTNQARRLLAWVGADENVRPLDVGWSLVNTRSLFDHRAVVVGADRTQLMEGLTGLAAGVPGADVVAGRAQTVGKTAFVFPGQGAQWLGMGAQLCATAPVFAEHIHRCERALREHVEWSLLDVLRGAPGAPGLDRVDVVQPALWAVMVSLAELWRSVGVVPDAVIGHSQGEIAAAYVAGALSLWDAAAVVALRSRLLVRLGGAGGMVSLACGQPQAEKLASQWGDRLNIAAVNGVSSVVLAGETDAVTELMQRCEAEGIRARRIDVDYASHSAQVDAIREELIAALRGIEPRTSTVAFFSTVTGELMDTAGVNAEYWYRSIRQPVQFERAVRNAFDGGYRVFVESSPHPVLIAGIEETLVDCDRGATGEPIVIPTLGRDDGGVGRFWLSAGQAHVAGVGVDWRAAFADLGGRRVELPTYAFARQRFWLDGLGAVGGDLGGVGLVGAEHGLLAAVVQRPDSGGVVLTGRISVVAAPWLADHAVGPVVLFPGTGFVELALRAGDEVGCSVLQELTLQAPLVLPADGVRVQVVVGGVEQSGTRNVWVYSAAGQADSSPGWTLHAQGVLGVGSVQPAAELSVWPPVGARAMDVADGYQVLAARGYGYGPAFRGLQALWRRGAEVFADVTLPEGVPIRGFGIHPAVLDAALHAWGIVEGEQQTMLPFSWQGVCLHASGAARVRVRLAPVGRGAVPVELADPQGLPVLSVRQLMVRPVSAAALSRSTAGDRGLLEMIWTPVPLEGGDIGDDAVVWELPPHAGAQAGGDVLAAVYRGVHEVLEVLQSWLASDATGLGVVVTRGAVGPVDDDVTDLAGAAVWGLVRSAQAEHPGRVVLVDTDGSVAVEDAVGFGARSGEPQLVVRRGRVYAARLAPVAAGLTLPSASAGGWRLVAGGGGTLADVVVAPVAPVELATGQVRVAVGAVGVNFRDVLVALGMYPGGGELGVDGAGVVVEVGPGVTGLAVGDRVMGLLGLVGSEAVVDARLVTMVPAGWSLVEAAAVPVAFLTAFYGLSVLAEVAAGQKVLVHAGTGGVGMAAVSLARYWGAEVFVTASRAKWDTLRAMGFDDIHISDSRSLEFEEAFLRATEGSGVDVVLNSLAGEFTDASLRLLPSGGRFIELGKTDIRDGQTVAERHRGVRYRAFDLVEAGPDRIAAMLSEVVGLLAAGVLARLPVKTFDARCAPAAYRFVSQARHIGKVVLTIPDGPGGQSGLAGGTVVVTGGTGMAGSAVATHLVRRHGVANLVLVSRSGEQADRAAEVAALLREGGAQVAVVSCDVADRDALAALLAGLDPRYPLKGVFHAAGVLDDAVITGLTPDRVDTVLRAKVDGAWNLHELTEDMDLSAFVVFSSMAGIVGTPAQGNYAAANAFLDGLVAYRRSRGLAGLSVAWGLWEQASAMTRHLGERDRARMTQAGLAPLTTEQALGFLDTALQADRAVVVAARLDRAALAGAGAALPALFSQLAAGPTRRRIDAADTAVSMSGLVSRLHALTPERRQRELTDLVISNAAAVLGRSSSVDINAHKAFQDLGFDSLTAVELRNRLKTATGLTLSPTLIFDYPTPATLAEHLDSRLVTASGSDQQSLSDRVDDITRELVVLLDQPDLSANVKAHLRTRLQTMLTSLTTEDDDIAAATESQLFAILDEELGS

SEQ ID NO: 32000 - protein, 414 aa, Saccharomyces cerevisiae
  misc_feature (235)..(236): Xaa can be any naturally occurring amino acid
SATLFNNIELLPPDALFGIKQRYGQDQRATKVDLGIGAYRDDNGKPWVLPSVKAAEKLIHNDSSYNHEYLGITGLPSLTSNAAKIIFGTQSDALQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRXXLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYATEAKL

SEQ ID NO: 32001 - protein, 1602 aa, Mycobacterium bovis AF2122/97
MSGTTTHVDYLKRLTADLRRTRRRLSDLEAKLSEPVAVVGMGCRYPGGVDSPETLWELVAQGRDAVSDFPADRGWDVYGLFDPDPDACGKMYTRRGTFLEHAGDFDAGFFGIGPSEALAMDPQQRLLLEVSWEALERTGIDPTKLRGSATGVFAGVIHAGYGGQLSGELEGYGLTGSTLSVASGRVAYVLGLEGPAVSVDTACSSSLVALHLAVQSLRSGECDLALAGGVTVMATPAAFVEFSRQRALARDGRCKVYAGAADGTAWSEGAGVLVVERLVDARRLGHPVLALVRGSAVNQDGASNGLTAPNGPSQQRVIRAALASARLRAVEVDVVEGHGTGTMLGDPIEAQALLATYGQDRVEPLWLGSIKSNIGHTSAAAGVAGVIKMVQAMRHGVMPKTLHVDVPTPHVDWSVGAVSLLTQPRAWSVHGRPRRAGVSSFGISGTNAHVILEQAPVVESVVPEVASPTAASAVPWVLSARSEQALAGQAQRLLAFVAANPDLDPIDVGWSLVKTRAMFEHRAVVVGADRGALLAGLAALAAGESGAGVAVGRARSVGKTVFVFPGQGAQWVGMGAQLYAELPLFALAFDAVAEELDRHLRLPLRNVLWEGDEALLTSTEFAQPALFAIEVALATLLQHWGISPDFLIGHSVGEIAAAHLAGVLSLTDAAGLVAARGRLMAELPAGGVMVVVAASEEEVLPVLVDGANLAAVNAPHSVVVSGCEAAVSDIADHFARRGRRVHRLAVSHAFHSLLMEPMLAEFTRIAAGISVSKPRIPLVSNVTGQMAGAGYGDGQYWVEHARRPVRFVEGVQLLNAVGATRFVEVGPGGGLTALVEQSLPLGEALSVAMMRREHPEVSSVLGAVATLFTAGAQMDWPAVFGSPGRRIELPTYAFQRQRYWLPPTSAGSADISGVGLLAARHGLLGAVVEQPDSDVVVLTGRLSVGEQRWLADHVIAGVVLLAGAAFVELALRAADQVDCGVVEELTVVTPLVLPTVGGVQLQVVVGVGEMGQRPVSIYSRNAESDSGWVLHARGVLGAKAVAPAADLSVWPPLGAAPVDVDGAYQRFAELGYEYGRAFQGLTAMWRRESELFADVAVPDDVDVTLSGFGIHPLVLDAALHAMGMVGEQAATMLPFSWQGVSLHAAGASRVRARIAPAGDGTVSVELADQAGLPVLSVQALVMRSVSSQLLSAAVAAADAAGRGLLEVAWLPVELAHNDISADLVVWELESFQDGVGPVYSATHRVLVALQSWLAQERAGGLVVLTQGSVGQDATNLAGAAVWGLVRSAQAEHPGRVMLVDSDGSMDVGDVIGCGEEQLMIRNGTAYAARLAQLRPQPILQLPDTNSGWRLVAGGAGTLEDLTLASCPAKELAPGQVRIEVRALGVNFRDVLVALGIYPGAAELGAEGAGVVTEVGPGVTGLAVGDPVMGLLGVAGSEAVVDARLVVKLPNRWPLTDAAGVPVVFLTAYCALRVLAQVQPGESVLVHAAAGGVGMAAVQLARLWGLEVFATASRGKWDTLHTMGCDNTHVADSRTLAFEETFWLTTEGRGVDVVLNSLAGEFTDASLRLLPRGGRFIEMGKTEFGTPRSLPRTILGWPTGLST

SEQ ID NO: 32002 - protein, 244 aa, Streptococcus thermophilus LMG 18311
MELKNKNVFVTGSTRGIGLAVAHQFASLGANIVLNGRSEISEDLLAQFVDYGVTVVGISGDISNGEDAKRMVAEAIEKLGSVDVLVNNAGITNDKLMLKMTEEDFERVLKINLTGAFNMTQAVLKPMSKARQGAIINMSSVVGLMGNVGQANYSASKAGLIGFTKSVAREVAARGVRVNAIAPGFIESDMTDAIPEKMKDAMIAQVPMKRIGQAKEVAEVAAFLAGQEYLTGQTIAIDGGMTMQ

SEQ ID NO: 32003 - protein, 255 aa, Zea mays
MAVPMSAIESAWQLATVITFLLHETVFFLSGLPSLLFERFGLFAKYKIQKRSNTSAYQNRCVLRLILYHVSVNLPVMILSYPAFKFMGLRSSLPLPHWTVVVSQVLFYFVLEDFIFYWGHRALHTKWLYKHVHSVHHEYATPFGLTSEYAHPAEILFLGFATVVGPALTGPHLFTLWLWMVLRVLETVEAHSGYHFPWSPSNFLPLYGGSDFHDYHHRVLYTKSGNYASTFVYMDWLFRTDNGYRKAKRPLRSKK

SEQ ID NO: 32004 - protein, 314 aa, Arabidopsis thaliana
MVLYAEPEPTSRRSELPNKENQDEHAAVSPEPTVIVELPDECESTVVHVHRSETPIQAETRNQTCDQVPPLNNQNPQVVQISDANWSPTTSEGYASIDRALLVYRIAHKLSFDFVRDWVYEFSPAKINELFGLEYMDVRTQRMEIARIMDDEVAIYLTDGKEKALKKLVGNTFSNSGKELFKLCCTNWSPTTNDAYAQPDRAKLVFMVAHKTPFDFGKMVFEHIMQLALKAEAKLYIPFPSLVYQLLQSQHPVKVHDEKSVPLVQTKKKTAKKPSTQGVQTGDSTNGSGHRRAMKLAIEVLQTALDAGLVREIV

SEQ ID NO: 32005 - protein, 338 aa, Neisseria gonorrhoeae FA 1090
MTVLITGGTGFIGSHTAVSLVQSGYDAVILDNLCNSSAAVLPRLRQITGRNIPFYQGDIRDCQILRQIFSEHEIESVIHFAGLKAVGESVAEPTKYYGNNVYGSLVLAEEMARAGVLKIVFSSSATVYGDAEKVPYTEDMRPGDTANPYGASKAMVERMLTDIQKADPRWSVILLRYFNPIGAHESGLIGEQPNGVPNNLLPYICQVASGRLPQLSVFGGDYPTPDGTGMRDYIHVMDLAEGHIAAMKAKGGVAGVHLFNLGSGRAYSVLEIIRAFEAASGLHIPYRIQPRRAGDLACSYADPSHTKQQTGWETKRGLQQMMEDSWRWVSRNPGRYGD

SEQ ID NO: 32006 - protein, 494 aa, Burkholderia sp. 383
MKSESEHPGLAAALAWCRSGAKQHFIDGKWVPAASGRTMETLNPATADVLAHIAEGDKADVDLAVAAARRAFESSGWRGMSPHARTAVLLRLADAIEQHADELAALETLDNGMPAWFSAAVVKMTVDTFRYYAGWPTKILGTTVPTDPSAFIYTLREPIGVCGQINPWNVPLLLAGVKFGPALACGNTIVAKPSELASLTCLRLVEIFHEAGLPPGVMNVVTGYGQTVGAAISEHPGIDKVAFTGSTAIGKQILLASAGNLKRVTLELGGKSPHIVFPDADLDKALAAAVNGFTRNSGQICSSGTRLFVHRSIHDEFANEVAKLAARLKVGNPFDADTKLGPLISSKQRDRVMSYVAAGNDEGATLLTGGRQACDAGYYVEPTVFSGVSNAMRIAQEEIFGPVVCVIPFDTEEDVIAQGNDSTYGLAGGIWTRDIGRAHRIAAALKGGRIWINTFGETDPVMPFGGYKQSGLGREFGAESIQTYTEAKSVMLRY

SEQ ID NO: 32007 - protein, 672 aa, Neisseria gonorrhoeae FA 1090
MNKSLSGSVEKYRELTLRGMILGALITVIFTASNVYLGLKVGLTFASSIPAAVISMAVLKFFKGSNILENNMVQTQASAAGTLSTIIFVLPGLLMAGYWSGFPFWQTTLLCIAGGILGVIFTIPLRYAMVVKSDLPYPEGVAAAEILKVGGHEEGDDRQGGSGIKELAAGGALAGLMSFCSGGLRVIADSASYWFKSGTAIFQLPIGFSLALLGAGYLVGLTGGIAILLGISIAWGIAVPYFSSHIPQPSDMEMAAFAMKLWKEKVRFIGAGTIGIAAVWTLLMLLKPMVEGMKMSFKSFGGGAPATERAEQDLSPKAMIFWVLSMMFILGVSFYHFIGDSHITGGMAWLLVAVCTLLASVIGFLVAAACGYMAGLVGSSSSPISGVGIVSIVVISLVLLLVGESGGLLADEANRKFLLALTLFCGSAVICVASISNDNLQDLKTGYLLKATPWRQQVALIIGCIVGALVISPVLELLYEAYGFTGAMPREGMDAAQALAALQATLMTTIASGIFAHNLEWAYIFTGIAIGAVLIVVDLVLKKSSGGKLALPVLAVGMGIYLPPSVNMPIVAGAVLAAVLKHIIGKKAENREGRLKNADRIGTLFAAGLIVGESLIGVIMAFIIAFSVTNGGSDAPLALNLQNWDAAASWLGLAFFVTGMFFFAQRVLKAGR

SEQ ID NO: 32008 - protein, 373 aa, Neisseria gonorrhoeae FA 1090
MSNQDFYATLGVARAATDDEIKKAYRKLAMKYHPDRNPDNKEAEEKFKEVQKAYETLSDKEKRAMYDQYGHAAFEGGGQGGFGGFGGFGGAQGFDFGDIFSQMFGGGSGRAQPDYQGEDVQVGIEITLEEAAKGVKKRINIPTYEACDVCNGSGAKPGASPETCPTCKGSGTVHIQQAIFRMQQTCPTCRGAGKHIKEPCVKCRGVGRNKAVKTVEVNIPAGIDDGQRIRLSGEGGPGMHGAPAGDLYVTVRIRAHKIFQRDGLDLHCELPISFAMAALGGELEVPTLDGKVKLTVPKETQTGRRMRVKGKGVKSLRSSATGDLYCHIVVETPVNLTDRQKELLEEFERISTGLENQTPRKKSFLDKLRDLFD

SEQ ID NO: 32009 - protein, 263 aa, Neisseria gonorrhoeae FA 1090
MNVYFLGGGNMAAAVAGGLVKQGGYRIHIANRGAEKRERLGKELGVETSATLPELHSDDVLILAVKPQDMEAACKNIRTNGALVLSVAAGLSVGTLSRYLGGSRRIVRVMPNTPGKIGLGVSGMYAEAEVSETDRRIADRIMKSVGLTVWLEDEAQMHSITGISGSGPAYVFYLLDALQNAAIRQGFDMAEARALSLATFKGAVALAEQTGEDFEKLQKNVTSKGGTTHEAVEAFRRHRVAEAISEGVCACVCRSQEMERQYQ

SEQ ID NO: 32010 - protein, 230 aa, Arabidopsis thaliana
MEESRFDSEDVDYAEIVVVRHGETSWNAERKIQGHLDVELNDAGRQQAQRVAERLSKEQKISHVYSSDLKRAFETAQIIAAKCGKLEVLTDRDLRERHLGDMQGLVYQEASKIRPEAYKAFSSNRTDVDIPGGGESLDKLYDRCTTALQRIGDKHKGERIVVVTHGGVIRSLYERARPSARKVEKILNTSVNVFRLFDGDKWTIQVWGDVSHLEETGFLQSGFGGDRTSG

SEQ ID NO: 32011 - protein, 257 aa, Oryza sativa
MASKEEVAVETVEGGAAAAKAPYWDPPPAPLLDTSELGKWSLYRALIAEFMATLIFLYVSIATVIGYKNQRATVDACTGVGYLGVAWSFGATIFILVYCTGGVSGGHINPAVTLGLFFGRKLSLVRTVLYVVAQCLGAIAGAGIVGTFILVYTVFSATDPKRTARDSFIPVLVPLPIGFAVFVVHLATIPITGTGINPARSLGAAVLYNQHAAWKDHWIFWVGPVIGAFLAAAYHKLVLRGEAAKALSSFRSTSVTA

SEQ ID NO: 32012 - protein, 303 aa, Deinococcus radiodurans R1
MTSLPLIVSAGEALTDLVTAGGNTWHAHPGGAGWNVARACARLGVPSAFAGAVGQDNFGDDLHRESLEAGLDPRFLQRVPAPTLMAVVYSTRPPQYRFLGENSADLHFDPTRLPGGWLGAARWLHVGGISLARWPLADTLLGVIEAARAAGVRISFDPNARIAHRHPDYPAVFAAVTKRADLLKFSDEDLAFFFPGASEAQALQELRGLNPRCPIVVTRGAAGASLYHSAGRVDLPTVPVEVADTVGAGDSLCAGLLVSATERPDALWTEHLRFGLGAASVTCAHAGAYAPTREEVAALSSGK

SEQ ID NO: 32013 - protein, 312 aa, Mesorhizobium loti MAFF303099
MRPLAVIGNVNVDLIVGPVAPWPKAGTETVVDHDELRVGGQAGNTGLAWQALGIDFEIAANVGDDQFGHWLREAFGSRADKWPVRPESTTLSVGMTHPDGERTFFTTRGHLPRFSLADVFSVLDGTHLTGGYALLCGSFLTDDLTRDYEAFFDWADRHDIAVALDTGWPIEGWTTANCKAARTWLARCDLALFNEVETVTLAGLPDPVEAARQIQSSMKKGATAVVKRGPEGAIAIGPGGALVTATAPDVKVVDTIGAGDVFNAAFLAALAQDQTLTASLAAATQVASRAISTLPRNYGEPMHPREATHERA

SEQ ID NO: 32014 - protein, 2471 aa, Rhodopirellula baltica SH 1
MNSPERDLSERLAKLSPEQRAALRKRLARSSSSTSAPATQRADSGQSKAAVEPIAIVGVSCRFPGAPDLDAYWKVISEGIDATAEIPPERWDVDSLYDPTGQKAGRMSVRRAGMVDNIDQFDPKFFGISPREAARMDPQQRLLLEVSWEAFEIAGIPVTSLAGTPVGAYVGIGGTDYSKVPSTYDGYYQYIDAHVGTGNALSIAANRLSYIMDLRGPSMAIDTACSSSTMAIHLAVQSLRAGECDAALAGGVNAILTPETTIAFSKARMLSPDGQCRPFDADANGYVRGEGCGMLLLKRLSDAERDGDRIWGTILASATNQDGRTSGITAPNGVSQQAVIRTALGEAGLPASRVNYIEAHGTGTPLGDPIEVDALTQVFSGKPGVDPPCYVTSVKANVGHMETVSGVAGIIKLLLMMRHQTIPGQLHLNKLNPRMSLKRSRIVIPAQSPPWPVDDEPLVAGVSSFGFGGANTHLVMQQYLAKQTVEPSASKQSDTKDRTQHVLSLSGKSDAAIAEVASRLIQHLDRTNDHMADVAHTMNVGRVHHTHRTAVVFEDAKQLHRQLTQLSEGKKGPGIRSGQTVTSRATRTAFLFTGQGSQAPGMGRGLFETQPVFRKSMKRCDELLAKVLPKRLLDVLYGEGSDIELVHQTRYTQPALFAIEYSLAQLWLSWGVKPNVVLGHSVGEFAAACVAGVVSLEDALSLIAHRGRLMGELPAGGGMTAMFESAEVITDRLGEFESSVSGSLSIAAENGPQNTVVSGPQSDLDAFAKHCDEAGIASKALQVSHAFHSQLMEPMLDEFRQIAAQCEFKSPRIPLISNLTGEQWTKAWDADYLCDHIRNAVRFEPSMRALAEMDIDVMLEVGPSPILSGMGKRCLPESSATWATSLRSGKDDETTLFEAVGDVHARGGKIDWKAFDQPWKRQRLVLPTYPFDRQRYWLDPSDEIVEDPSRNRTGTGELLHPMLGRFQPSALRSRLYENALSARSPEFLADHAVQGSVNLPGAAFVEVAFAAARDRFGPGKHAVTDANIEQAMFVSEDRWKTFQTIVDESLSLEVYSRDRVDANDSWQRHMSASLVPAEQVGDSVDVEVVPPPPGLATVAQRFVGGKDHDEFYDLMSHRRLEYGPRFRMLHRIDYSIDEALGQVQCDDATCAELDDYILHPVLGDALMQTFSALVPRPDHDTFSEATYMPTKVSRAVVYQRPEGTLRTYGRRSSSGDVLDPEFVEGDVWLVNERDEVVAEWTGVRVTRVGRVGGGKSESLDDSLYQIDWQATESLPAASDLEGKQVWLLGDPGSRRDSLAKQLIGFGAEVVEGDLDEDLKTLAEKSESTLPLAALITLWDPSGKSSNPADDAVAVCQSALKQIRSAITHVPVSKHFRGWWHVTTGTQPVSESESSIDLVHAPLWGMIRVAMMELADLKPSLLETDPSASDQSNGLVIAAEVIAADDEDHVAYRDGTRHLGRLVKRRAPAESGNDTSVTIPSQPHRLRFRQTGSFDSLYFEPMERETPQGSEVELRVNAAGLNFSDVLKVMGLYPGITDKVVPLGIECSGVVTAVGKDAKRFQVGDQVMGVAPFSFGSHAKTPEYTLVKRPAGMDDVEAATIPIAFLTAWYGLVHLADVQPGERVLIHAGAGGVGLAATQIAQYLGAEIIATAGSDEKREFLRECGVKHVFNSRTTEFADDIRRAFSGEGVDVVLNSLPGEAIPKSLGVLNAYGRFLEIGKTDIYQDRKVGLLPFQDNLSYHAIDLDRVLRQRPAKIEKLWAELAERFEAGDLQPIACTEFDQTEMVETFRYMAQRKNIGKVITRMSTIATTDAVPQEEASESTVLITGGTGAIGLKLAKHLIKDGATSIALLSRRQPVGDVAAKIDALKQDADSVQVTVLQGDVGELDSLRSALKQLPGSLPPIRHVYHAAGVLQDGLLMDMTEEQLRVPMGSKIQGGWNLHVATKDLPIETFVLFSSIAACLGSPGQANYAAANGFLDALSEYRREKGLPATSIAWGPWAESGMAATEDRSSQLESRGMRLLPAIACLQTMQQLIDAGDQYVAVMDVDWPAMTKSMRRSRPFFAEFADRSQVDGKASVDQVDHEFRAQLSEVPESERTERLRRYFASELARLMGWEAEQIDVKQKLSELGMDSLIAMELKNNLEQRLAITIPMSALVESPSINSLVGHVVSQFADEDGEMKKASEKSEEPGGDRTALIVPLKADGARSPWLCIHPLGGSTACYSEFSQQVDDDQPVYALVGGGSDGVSEPPTSLDAMMEEYVELVQAQFGDDELRLIGWSAGGVFALELARRLENEGRSNVAVTLLDTPLPSIYRNVDPNDDVQFVADLVQFSNAFSGTDMYLSAEELEDARGTDQIWQRVLEEAQRAGVLSQSASPDMVRKLIDTSRQHVLFIKSYEIDPTSPSVQLILPVKTTALEGSSGERWTDHLDWASHLDSEVIVEQTDGDHFTMLLGEQAKELAKRMEQHAAAK

SEQ ID NO: 32015 - protein, 251 aa, Blastopirellula marina DSM 3645
MKAVITGGSDGIGFAIASAFVAEGAQVWLVARNAEKLATAADSLQSAGTKVMSTVADLSDPGAAEQVGVEVAATWDRVDVLVNNAGMARFTSFSEATPDEIQAQVQLNLLSPYLLTQQLLPLLAAAQGNVINISSTSAHRLIPGRPASVYAMTKGGLNSLTKALALELGPQGVRVNAIAPGTIKTPLTQKMIASFTEERKKEYDQFVRQAFALGRLGEPEEVAHLAVYLASVEAKWTTGSIFIVDGGLSTN

SEQ ID NO: 32016 - protein, 328 aa, Arabidopsis thaliana
MEEEKAAAYYDELTRKGEGAARFKQGLGFSTGANAVPERGSAIASSSSFLNQFVKASNHTKSTDNKDSEIRSIRDKLKKKPEDPRVPERSYRESSERRRYRSRERDERDKSHRRRSRSSERRSSYVDRERRRSRSRSAERRNRYGDRESRRRSNRSRSLSPRRERRSREDVKEKKPDYSRLIKGYDEMSAAEKVKAKMKLQLDETAEKDTSKGAGWERFEFDKEAPVDDEELEEGADDDAALVKRMGQSYRFSAIEAKREEQLKAAHDEAMFGVPTGQTPTENTGDDVTEITNVKDDEGESNSGAISLLSEKVLAKQQGSWRDRARKS

SEQ ID NO: 32017 - protein, 151 aa, Brassica napus
MAAVSGAFVVSQTSLSSSKHHSPSSSPTMLLGVRAFPTNSKTTRGLIRCQLSSSSVSALQQLKKSAFDRYTKERSSIVVIGLSIHTAPVEMREKLAIPVAEWPQAISELSALNHIEEAAVLSTCNRMEIYVLALSQHRGVREVTQWMSKRS

SEQ ID NO: 32018 - protein, 168 aa, Blastopirellula marina DSM 3645
TQSGVLTCEQSRGVIEMDFPVVSQEEVDFPPDLLAALGSSATYVGKTQFDYFVVMEDPEIVRTLSPDFRELKRFPARGVIVTSRSDRSDFDFISRFFAPNAGIDEDPVTGSAHCCLAPYWAKVLGKTEMTAFQASARGGVIHVRVLNGRVILGGQAVSILQGELLTAP

SEQ ID NO: 32019 - protein, 311 aa, Desulfitobacterium hafniense Y51
MSKIARSLTDLIGNTPLLELSNYNRTTELEAKVIAKLEYFNPLSSVKDRIGYAMIKDAEEKGLLNKDTVIIEPTSGNTGIALAFVSAARGYRLILTMPETMSVERRNLLKALGAELVLTPGPAGMKGAIQKAEELAAEYQNSFIPQQFNNPANPEIHRQTTAEEIWRDTDGEVDIFVAGVGTGGTVTGVGEALKKKKPGVKVIAVEPADSPVLSGGTPGAHKIQGIGAGFVPGVYNSEVIDEIFQVKNEEAFETSRKLSKTEGLLVGISSGAAAYAATQIAKRPENKGKNIVVLLPDTGERYLSTVLFQEG

SEQ ID NO: 32020 - protein, 193 aa, Physcomitrella patens subsp. patens
KFLTLPTILTLSRVAAVPVLLAAFYSQETWATTATATIFVLAAVTDWLDGYLARKMGSSSEFGAFLDPVADKLMVATTLVLLCTRPPLAALAKFGPWLLPLPAIAIIGREITMSALREWAASQGKDVRKAVAVNGLGKWKTAAQMMALTLLLAGRDGGYVGGVALGVTGVSLLYVSAGLALWSLVVYIRSLWK

SEQ ID NO: 32021 - protein, 186 aa, Photobacterium damselae subsp. piscicida
MKSRAAVAFGPGKPLEIVEIDVAPPQKGEVLVKITHTGVCHTDAFTLSGDDPEGVFPAVLGHEGGGIVVEVGEGVTSLKPGDHVIPLYTAECGECKFCKSGKTNLCQAVRATQGKGLMPDGTTRFSYNGEPIYHYMGTSTFSEYTVCAEISLAKVNPQAPLDKVCLLGCGVTTGIGAVHNTALLQS

SEQ ID NO: 32022 - protein, 288 aa, Nostoc punctiforme PCC 73102
MREIQTVGVVGAGVMGIGVSQNLAQTGHQVILVDVSEDILNHAKQEIRNNVRFQGFFQKNSEAESPDDILNKIKFSTNYKFLEDAEFVVENVTEKWDLKKEVYAQLDAICPEKTAFAANTSAISITRIASVTKRATRVVGMHFMNPVPMKPMVEMIRGHHTSDETIETAKKMLAQMGKECIIVNDSPGFVSNRVLMLTINEAIFILQDQVASIEEVDKIFKTCFGHKMGPLETADLIGLDTILFSIEVLYESFNDSKYRPCPLLKKMVDAGLHGRKSGKGFYAYSNPN

SEQ ID NO: 32023 - protein, 634 aa, Chromobacterium violaceum ATCC 12472
MIQLKNLSLRRGLKELLIGANLTLNPGYKAGLTGANGVGKSSLFAMLLGELHADGGDMLLPPNWTVAHVAQETPALERSALDYVLDGDKELRALESQLADAEDKHDGNAIGHLHGELANIDAYSAPARAGKLLTGLGFDEAAQQRPVASFSGGWRMRLNLAQALMCRSDLLLLDEPTNHLDLETVLWLEDWLKAYPGTLLVISHDRDFLDAICSHIVEVASQTLTLYTGNYSQFEVMRAEKLARQQGEYEKQQRQIAHLESFINRFKAKASKARQAQSRVKALEKLERIAPAHIASPFDFHFDSPEHLPNPLLKLDKADAGYGDKTILSGISLSVEAGARIGLLGVNGAGKSTLVKLLSGDLAPQAGERINAQMLKIGYFAQHTLETLRPDESPLQHMQRLAPTTRELELRSFLGGFNFRGDAATDPVGPMSGGEKARLALAMIVWQKPNLLLLDEPTNHLDLEMRHALTLALQDFTGALIVVSHDRSLLESTTDVFWLVSGGKVQPFDGDLEDYRQWRIAQLAEGGKPSDGDAQGVNRKEQKRQEAEARQQLAKQRKPLQTRLSKLEQEMNKLSDEKAELEAFMSSSEAYDDANRQKLADSVKRQGEVASRLEIVEEEWMEVQEQLEALAQAD

SEQ ID NO: 32024 - protein, 454 aa, Clostridium tetani E88
MNDINYMLENQKKYFNERKTRDLKFRLNKLRLLKNAIKTREEDIMEALKKDLNKPYFESYETEIAMVIDELNYTIKNLPKWIKTKRIKSSILSFPSKGYIYSEPYGVVLIMSPWNYPFQLSIMPLIGAIAAGNCCIVKPSEYSTNTSRIVEDIVKEVFLSCHVCVIEGDKDISKEILRKKFDYIFFTGSEEVGKIVMKAAAENLTPLTLELGGKSPCIIDSECNLSLSAKRVVWGKFLNAGQTCVAPDYVLVHKSIKEKFINEMRRYINIFYKGESKDFPRIINKFHFQRLINLLSSDGNIEIGGQYNKDTLQLYPTIINNIDWESNIMKEEIFGPILPIIEYDSIDEVIDKINSRAKPLALYYFSSNKENQKKLLERTSFGGGCINDTIMHLTSPYMPFGGVGSSGMGSYHGYKSFETFSHKKSILKRSTKLDINLRYPPYGENIKVLKKIIK

SEQ ID NO: 32025 - protein, 84 aa, Oryza sativa
QNILDLMKKHQASWPFRDPVSLDDVPDYHLVIKEPIDIKTIEKKLSNNEYRDREHFCEDIARIFKNCRIYNQPETSYFKCSNEL

SEQ ID NO: 32026 - protein, 228 aa, Neisseria gonorrhoeae FA 1090
MTVLQERYREVSDRIGKLVLQAGREPHSVSLIAVSKTFPSDGIREVYAAGQRDFGENYIQEWYGKTEELADLTDIVWHVIGDVQSNKTKFVAERAHWVHTVCRLKTAVRLSRQRRSLMPPLQVCVEVNIAGEAAKHGVAPEEAVALAVEVAKLPNLVVRGLMCVAKANSSETELKTQFQTMQKLLADLNAAGVKADVLSMGMSDDMPAAIECGATHVRIGSAIFGKRG

SEQ ID NO: 32027 - protein, 408 aa, Solanum tuberosum
MAASAATATATTSYLSALDKKTPFLFALDKKTPFLCPKSSTKRRSFNGGVKCMAIETTSGFTATKKRSGYELQTLTSWLLRQEQAGVIDAELTIVISSISMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYNPNDECLADHGDDSTLDNIEQKCIVNVCQPGTNLLAAGYCMYSSSVIFVLTLGNGVFSFNLDPMYGEFVLTQENVQIPKSGKIYSFNEGNYQLWDDKLKKYIDDLKDPGPSGKPYSARYIGSLVGDFHRTLLYGGIYGYPRDQKSKNGKLRLLYECAPMSFIVEQAGGKGSDGHQRVLDIQPTEVHQRVPLYIGSTEEVEKLEKYLS

SEQ ID NO: 32028 - protein, 463 aa, Bacillus cereus G9241
MQHTNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPCWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIIATAIVLLVGVILNYLVPAKVFTWLTSISTFGAIWTWGIILVAQIKFRKSLPAQNKQKLSYKMPLYPISSYFSLAFLALVLCIMAYSEDTRIALIVGPIWLIGLAIVYYMKGFHKIDETPNSKIS

SEQ ID NO: 32029 - protein, 482 aa, Neisseria gonorrhoeae FA 1090
MKGDIGVIGLAVMGQNLILNMNDCGFKVVAYNRTIGKVDEFLNGAAKETGIIGAYSLQDLVDKLAKPRKIMMMVRAGSVVDDFVEQLLPLLEEGDIIIDGGNANYPDTTRRTHYLAGKGILFVGAGVSGGEEGARRGPSIMPGGDKRAWEAVKPIFQAIAAKTPQGEPCCDWVGKDGAGHFVKMVHNGIEYGDMQLICEAYQFMKDGLGLSYDEMHRVFAEWNKTELDSYLIEITAAILGYKDEGGEPLAEKILDTAGQKGTGKWTGINALDLGIPLTLISEAVFARCVSSFKEQRVQTGKLFARTATPVEGGKQEWVEALRQALLASKIISYAQGFMLIREAGESYGWGLDYGNTALLWREGCIIRSAFLGNIRDAYEANPDLVFLGADPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 32030 - protein, 609 aa, Bacillus cereus G9241
MEHHTSVLSLMVVVAIAFFVPLLLQRFKLKALPVVVAEIIAGIFVGKSGFNIIEPDMWLQVLSTLGFIFLMFLSGLEIDFSIFKQKGKKNTTNEPNTFQAASIIFLFIFILSYALSLLFVWLGFVDNAMFMTLIISTISLGVVVPTLKENNLGKTAIGQIILLVAVIADLVTMILLAVFVGLNSESGQSMWLLLLLFGAGIVIYFIAKRFKNIPYLDSLKAGSVQIDTRAVFALILILVGLSESVGAENILGAFLAGVLVSLLSPNEDMVEKLDSIGYGFFIPIFFVMVGVNLEVWSIFKEPSSMLMIPILIVGLFISKLLPSLVLRKWYPRNIVLGSAILLTSTLSLVIAAAQIGEKLGIISPSLSASLILSAVITCIFAPILFKKMFPKVETPKPKVSIIGASRITLPLSLDLKREDYDVTLYMMRQNKINDEEAKSHDFPIVKLDDITIASLTEQTAFHADRVVVATSDDEQNLLLAEHAKELGVEHVIASVEDPLLQEKATQEHIAVFSTINSTRILLRALIDKPSLVRLITTANETVREVELRSNKYNGVALRRLPFLGDVLVIQIYRGNKALIPHGDTRLQHGDTLLVTGSKEHIDTLKNILE

SEQ ID NO: 32031 - protein, 162 aa, Arabidopsis thaliana
MMLRQTSRKAYLGLQASPLGLGRRLYHENVIDHFENPRNVGSFNRNDPNVGTGLVGAPACGDLMSLQIKVDDSGQIIDTRFKTFGCGSAIASSSVASEWIKGKTLDEVMTIKNAEIAKHLRLPPVKLHCSMLAEDAIKSAVRDYKEKQAKTNAAAAEETVKA

SEQ ID NO: 32032 - protein, 119 aa, Oryza sativa
MDWAYSGNSYGYGYYSSGTSSPPAGGEDAYMTVSSAPPKRRGGRTKFKETRHPVYKGVRSRNPGRWVCEVREPHGRQRIWLGTFETAEMAARAHDVAALALRGRAACLNFADSPRRLRV

SEQ ID NO: 32033 - protein, 392 aa, Triticum aestivum
  misc_feature (291)..(291): Xaa can be any naturally occurring amino acid
MLQRVGELSHMVDLQAAALVISVVAAEVTSPVPSRPQPTSHLRLASRRQFHSLAMGKIKIGINGFGRIGRLVARVALQSDDVELVAVNDPFITTEYMTYMFKYDTVHGHWKHSDIKLKDDKTLLFGEKPVTVFGVRNPEEIPWGEAGADYVVESTGVFTDKDKAAAHLKGGAKKVVISAPSKDAPMFVVGVNEDKYTSDVNIVSNASCTTNCLAPLAKIINDNFGIIEGLMTTVHAITATQKTVDGPSSKDWRGGRAASFNIIPSSTGAAKAVGKVLPELNGKLTGMSFRXVPTVDVSVVDLTVRTEKAASYDDIKKAIKAASEGKLKGIMGYVEEDLVSTDFVGDSRSSIFDAKAGIALNDHFVKLVSWYDNEWGYRNRFVDLIRHMAKTQ

SEQ ID NO: 32034 - protein, 335 aa, Rhodopirellula baltica SH 1
MHPMKAAFITETGPADALQVGELPDPTPGPGQVVIRVYASAINPIDTYIRNGTIAMELPLPFVPGCDAAGVVESVGPGVKRLSIGDRVWCTNQGLLGRQGTLSELIAVDEHWTFKLPEPVPYEDAAACALVGVTAHLGLFREAQLEPGETILVIGGSGGVGSMVVQMAAATGARVITTAGSEAKAQVCRDLGAEEVILYKDESIADRTKAFAPDGVNVLWETRREPDFDMAIDLMAGRGRMVLMAGRDAKPAFPVGPFYVKECSLHGFVMFKATPMEMKNAAEDISQWLASGKLSANISARFSLDEAAQAHALQESATLEDSSQLAGKIIVTLNT

SEQ ID NO: 32035 - protein, 247 aa, Eriobotrya japonica
GIPVGKLALYTALGGVRPSACLPVTIDVGTNNEKLLNDEFYIGLRQKRATGQEYAELLHEFMTAVKQNYGEKVLVQFEDFANHNAFELLAKYASTHLVFNDDIQGTASVVLAGLLAALKLVKGSLSEHRFLFLGAGEAGTGIAELIALEVSKQTNTPLEETRKNIWLVNSKGLIVSSRLDSLQHFKKPWAHEHEPVRELVDAVKSIKPTVLIGTSGVGRTFTKEVVEAMASLNERPIILALSNPTSQ

SEQ ID NO: 32036 - protein, 256 aa, Haemophilus ducreyi 35000HP
MARRPLVMGNWKLNGSKAFTQQLIAELKTELAEITGCDVAIAPPVMYLSEAEIALAGQSTIRLGAQNVDINTQGAFTGDISTAMLQEFCAKYIIIGHSERRTYHAESDQFIAKKFAALKTAGLTPVLCIGETEAENEAGQTQQVCARQIDAIINSLGVEAFNQAVIAYEPIWAIGTGKSATPAQAQAVHAFIRQHIAEKSQAVADQLIIQYGGSVNDTNAAELFSQPDIDGALVGGASLKATAFAEIVKAAEKAKA

SEQ ID NO: 32037 - protein, 371 aa, Gibberella zeae PH-1
MTTMDLRVGNKYRIGRKIGSGSFGDIYLGTNIISGEEIAIKLESVKAKHPQLEYEARVYKSLAGGVGIPFVRWFGTECDYNAMVLDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGSLPWQGLKAATKKQKYDRIMEKKMTTPTEVLCRGFPNEFAIYLNYTRSLRFDDKPDYSYLRKIFRDLFVREGFQYDYVFDWTVYKYQKNAQAIAQAAGQANPEDDEKARANRTNAATAGQSAAKPNAIPSTRRKMLERGSGAGVDTPDTNRAIGGSDRM

SEQ ID NO: 32038 - protein, 472 aa, Mesorhizobium loti MAFF303099
MAAVRDLKATEMAASGGDDAIELGKRHLIQPWPYAGSVGAEARALIGEGDGIYITDNTGKRLIDGPAGMWCVNVGHRREELARVMYDQAMALSYNTPWYTMNAPSAELAMRIAGHAPDDLSHVFYTTGGSSAVETALRFMQFYNNVRGRPEKKLILSRGGAYHGSTYLSASLNGRPRDRDWMDGADELVIKLSSPDPFRRPQGMSLAAFTDFLVDQFRDTVARVGADKIGAFVGEPVQASGGVVIPPDGYLKRIREICRVNDILYVSDEVVTGFGRLGHVFASGDVFGIDPDMITFAKGVTSGYFPLGGVIISERLLQELRRSNHPDAMFGHGLTYTSHPVGCAVALKNLDLLEESVLAHTQAVAPYFQAQLKTLEELPLVGEVRGAGLMGCVECVADRESKNPLQLDKDVGKRIDAHCHELGLLVRPLINMCVMSPPLIITREQIDDMVGILREGISRTMDDLWKEGVWRG

SEQ ID NO: 32039 - protein, 105 aa, Datisca glomerata
MEKINARFPLERKGLTSSDPKLALAKRCAHEGVMAGAKAAAIASIATAIPTLASVRMMPWARANLNHTAQALIVSTVAGLAYFIVADKTVLATARKNSLNHNSNL

SEQ ID NO: 32040 - protein, 181 aa, Zea mays
LGRLKKAFDRKPGLSNLFLNPQFAQEIIYNQPAWRKVVCLPINNGVSPPGKSPNLAYFDSYPRDRVPSNLVQAQREYFGGPPYKRVDKPGFFPPEWFKIGGNISNNLLIAQRMACPVLTTPVGKEISSRNLFIDFCKLIIYMNKIKAPTAFVWAKKKKKKKKKKKKKKKKKKKKKKKLERG

SEQ ID NO: 32041 - protein, 81 aa, Triticum aestivum
  misc_feature (49)..(49): Xaa can be any naturally occurring amino acid
DTDRQRPTVPIMASKIKKGGILGTGEYILSYVNTYCMTFLNKMGKNVIXAYKIQGFVTALTLHRKRALIAYKSTRVAYNKL

SEQ ID NO: 32042 - protein, 487 aa, Brucella suis 1330
MKAQPKASHFIGGAFVEDKAGKPLPVIYPATDEEIASLYSATPGIIEAAYAAALKAQGEWAALKPVERGRILRRTAEILREKNRKLSKLETLDTGKALQETLVADAASAADALEFFGGIISGFNGEFVELGGSFAYTRREALGICVGIGAWNYPIQIAAWKSAPALAMGNAFIFKPSENTPLSALALAEAYKEAGLPDGLFNVVQGYGDVGAALVNHRLTAKVSLTGSVPTGRRIMAQAGEQLKHVTMELGGKSPLIVFDDADLESAIGGAMLGNFYSTGQVCSNGTRVFVHKNIRERFIERLVERTRKIRIGDPFDEATQMGPLISAAQRDKVLSYIKKGKAEGATLACGGGVPKLQGFDKGFFIEPTVFADVTDTMTIAREEIFGPVMSVLEFSDEDEVIARANDSEFGLAAGVFTADLSRGHHVIGQIKAGTCWINAYNLTPVEVPFGGYKQSGIGRENGIAALAHYSQIKTVYVEMGKVDSPY

SEQ ID NO: 32043 - protein, 363 aa, Haemophilus influenzae Rd KW20
MGFKCGIVGLPNVGKSTLFNALTKAGIEAANYPFCTIEPNTGVVPMPDPRLDALAEIVKPERILPTTMEFVDIAGLVAGASKGEGLGNKFLANIRETDAIGHVVRCFENDDIVHVAGKIDPLDDIDTINTELALADLDSCERAIQRLQKRAKGGDKEAKFELSVMEKILPVLENAGMIRSVGLDKEELQAIKSYNFLTLKPTMYIANVNEDGFENNPYLDRVREIAAKEGAVVVPVCAAIESEIAELDDEEKVEFLQDLGIEEPGLNRVIRAGYALLNLQTYFTAGVKEVRAWTVSVGATAPKAAAVIHTDFEKGFIRAEVIAYEDFIQFNGENGAKEAGKWRLEGKDYIVQDGDVMHFRFNV

SEQ ID NO: 32044 - protein, 472 aa, Alteromonadales bacterium TW-7
MTTDTAQIASLSAQFTSLQNAFLDNPYPSIHSRIAILKKLRSRIVELEEELISAVSKDFGYRTAFDTLLGDILPTVQGLSHIIKKLPKWSKPSKRSVGLSLWPSKVSVTYQPKGVVGVIAPWNYPIQLAVVPVITAIAAGNKVMLKLSEFTPHTNAVLEKLFDDKMSQHVCVVQGGSDVASEFSSLPFAHLLFTGSTGVGKLVMKAASKNLTPVTLELGGKSPVIITEQADVKKAAHALLFGKMANAGQICVAPDYVFVPKTLESQLIKQLCELYKKHFKQGVEGKNLTSIISDSHYARLAEYLVQAQELGANVIKPLEQNQQDADKHRMGLHLVTNVTDDMQLMQDELFGPILPIKSYEKLDDVLDYIKQHPNPLALYILGQDKEAQEYIIKQTLSGTVAVNDTLVQVTADDAPFGGVGHSGMGHYHGKEGFLTFSHAKNTLVSGSFNPRIGLLLKQSKLLTKLLKWLYIK

SEQ ID NO: 32045 - protein, 610 aa, Solibacter usitatus Ellin6076
MTLRLAVSVAVLAAVVVGQQPQRRERPVRLPARGTHGSVAGGTEYATEAGMQMYFKGGNAVDAGIAAMLAATVTEFSHFGLGGEAPILIRTRDGKVHAIAGVGTMPKLATAQFFRDHKLTDEEMVSPPEAGGLKNWVPVAGILPALVPGVVEAAMVALREYGTRSAAEVLQPAIELADGFPIDELRVSSIANSVKYLEAWPDSRRTFLPGGRVPQAGDIFRQPDLARTLRSLADAEKRALANGANRAKAIDAVRDFFYRGEIAHRIDAFSKAHNGLIRYEDMAAFRVEPEEPVSTTFKGYTVYKGGFWSQGPAMLETLNILDGYDIPSLKQNSAEYIHVLVEALKLAYADRDTYYGDPKFSKIPTATLLSKEYAADRRKLIGEMASLDFRPGKIGDTVGKHPFYADIQRYKIPDALMAKDTTCVDAIDKDGVAFSATPSGAWMPTYLAGDTGVPLTQRAQSFLLVPGHPNELAPGKRPRVTLSPTLVTAPDKTIIALSTPGGDNQDQSLLQVLFNSIFFGMNAEGAVEAGRFQTEHLVSSFDNHAMSPGTLLLDERTAAAVVAELQRRKHVVEMRTRFASGAAPVMIRFWPSGLIEAGADPYYFRAAQAW

SEQ ID NO: 32046 - protein, 394 aa, Methylococcus capsulatus str. Bath
MEEFQRIKRLPPYVFNIVNELKAKERAQGKDVIDFGMGNPDQPTPQHIVDKLIESSRKGTNHRYSVSKGIPRLRRAICHWYLNRYGVELDPDSQAIVTIGSKEGLAHLALATVGPGDAVLVPNPAYPIHPYGFVLAGADVRHVPLLPGVDFFAELEMAIKTSWPKPKMLVLNFPANPTAQCVDLEFFEKVVEIAREYKIWVVHDLAYADLVFDGYVAPSILQVPGAEDIAVEFFTLSKSYNMPGWRVGFMCGNRELVSALGRIKSYLDYGTFTPIQVAAITALEGPQDCVENIRLMYQNRRDVLCKGLNDIGWPVEKPKGTMFVWARIPERYQSLGSLEFAKKMLLDAHVAVSPGIGFGEFGDDHVRFGLIENEHRTRQAIRGVRDMMRKDNAV

SEQ ID NO: 32047 - protein, 185 aa, Mycoplasma mobile 163K
MNEKIIEVNIEIPINSNIKYEFDRSKNKIVVDRILRGDFKYPANYGYVAEALDWDGDELDVLVYSSETFVPGSLLRARLVGAMKMIDQGETDTKLIAVHADDYRLDKIKELVDIPKEWLRNVEYFFTNYKNWKGVNQVKINGFEGLKYALAEYEECVHQMEKYGKMPKSEYVKQMQKKHPEKYTI

SEQ ID NO: 32048 - protein, 152 aa, Blastopirellula marina DSM 3645
MERSLILLKPDCVQRRLIGRIISRFEDKGLNIVGMKLMQVTPDLAKQHYAEHVAKPFYPGLEAFITASPVVALVLEGLEAIRVIRDILGATSGLKAAAGTIRGDFSSSRQMNLVHASDGPEAAAREIGLYFTESELCDCTLSLTPWLRADDE

SEQ ID NO: 32049 - protein, 694 aa, Methylococcus capsulatus str. Bath
MRNPRTKAITLAGLAEFLALGLLVDWGTAFAFTAALSALLYGILSIGWVNAQPAGNERMVDIATAIQQGAQAYLNRQYRTIGIVGWLLFFVIGAFLGWSIAFGFVIGAALSGAAGYIGMNISVRANSRTAQAAITGMDEAFSTAFRGGAITGMLVVGLGLLGVAGYYALLKSVGATDPLHALVGLAFGGSLISIFARLGGGIFTKGADVGADLVGKVEAGIPEDDPRNPAVIADNVGDNVGDCAGMAADLFETYAVTIVATMLLGGLLTGGSEAATVYPLVLGGISIVASIIGTFFVRITPGKKIMSGLYKGVIVSGGLAAAAFLPITGFMFGGGVSLGGIDVSWIGIFFSALIGLGLTGLMVVITEYYTATEFAPVRHIAEASTTGHGTNIIAGLGVSMKATAAPVLAVCASIWGAYELAGLYGIAVAATAMLSLTGMIVALDAYGPITDNAGGIAEMAELPDSVRAVTDPLDAVGNTTKAVTKGYAIGSAGLAALVLFADYTHNLGGNVNFDLSNHMVIIGLFIGGMVPYMFGALAMEAVGRAAGGIVNEVRRQFREIPGIMEYTAKPDYSKAVDMLTQAAIKEMVVPSLLPVAIPVLVGLLLGKEALGGLLIGTIITGLFVAISMTTGGGAWDNAKKHIEDGNFGGKGSEAHKAAITGDTVGDPYKDTAGPAVNPMIKIINIVALLIVPLL

SEQ ID NO: 32050 - protein, 1399 aa, Vibrio vulnificus CMCP6
MIQIVIDGKYRIVEAGQTVLQAAKVCGVEIPSLCGMNRSGEKIPCDLCVVEVESGGTRRACELEVYNGLTVNTQSEALSAHRKQALNRIMSDHYADCEAPCKTACPAGVDIQSYLYHIAQNDHQKAIEVIKRTLPMPLSIGRVCPAFCESECRRSLVDDAIAIRQLKRHAADADLAAQEAYTPEKKADKNKRIAIVGSGPGGLTAGYYLTNEGYQVDVFEAMPQAGGWLRYGIPEYRLPKSILDKEIALMCRNGMAIHTDKKLGRDISLSQLSQDYDAVCLAVGASKAVAMDYPGSDLDGCYLGVDYLKDFVTEQRFTTGKKVAVIGGGNTAIDCARTAVRTGADTTLIYRRTRDEMPAEDYEIEEAEHEGVKFHFLTNPAQNIADGDGRVCSVKLEKMALGAPDASGRRRPEATGEYFTEAFDTVIAAVSQQADLSFMQGEALTLPLTRWNTADANPETMHSGTGNIFSIGDFRRGPATAVEAVADGRIAAQAIDRFFDGDMENIPLKPFNSRKEQKLKQVDPLHFSHLQKVARTIMPELTSQQREQSFEEVELGFDNAEAMAEAARCLECGCQVNTSCDLRDYATEYGAEQHFHYSVNIKSHDEWQALRQNDPRHKYPIDHSSEFIVFDANRCISCGQCIQACREQSVQGVLSFMNLEKGRPVVRPDCRPNFGGQGVRMGDSRCVQCGACVQACPVGAMTDARDRSQGRETPLKKVDTICTYCGVGCKLTMHVDEAANRIRYVEGAHSPVNEGMLCVKGRYGFDFVASEERLTTPLIRKDGWLQPASWQEAISLIADKFSTIKQDFGGRALAGFSSAKTTNEDNYAFQKFMRRELGTNNVDHCARLCHASTVTGLEASLGSGAMTNDIPSIKHSDVIFIIGSDTSAAHPVIASHIKQAVRHHGARLIVADPKRIGMADHAELYLAHRPGTDVMLINGVMQQIIKNGWYDMEYIEERVDGFDTMLQEVMSPAYSLDKVELVTGVKANDIFAMARMIGTAKRTAVYYSMGITQHTTGHDNVRSIANLQLLCGNIGIEGGGINPLRGQSNVQGACDMGALPNNYPGYQKVYNPLVREKFVIEWDAPNLSAEPGLTLTEIIDGACRRDVRALYVMGENPVLSDPNQAHVIEGLEALDFLVVQDIFLTETAQYADVVLPSCSFAEKSGHFTNTERRVQRIYPAVNPPGEAKEDWRIIQEIANAMGSDWHYRSVADITNEITRVTPQYAGLKWDNITREGVQWPSNKNNPAGTRIMHQTQFTRGKGQMEAIPFRYAAELPDEEYPLVLTTGRVLEQFHTGTMTRKTQGLNNLAGPRAMISVQDAEALGIGNGDMLKVSTRRGEIEIAAFVTKRMQAGVVFIPFHFVESPVNRLTTTATDPHAKIPEFKVAAVRVEKLHTALVE

SEQ ID NO: 32051 - protein, 289 aa, Arabidopsis thaliana
MSNRPELLAPPEIFYDDTEARKYTSSSRIVEIQAKLSERALELLALPEDGVPRFLLDIGCGSGLSGETLSEDGHHWIGLDISASMLHVAVEREVEGDLLLGDMGQGLGLRSGVIDGAISISAVQWLCNADKSSHEPRLRLKAFFGSLYRCLSRGARAVFQVYPENIAQRELILRQALQAGFGGGLVVDYPHSTKKRKEFLVLTCGTVQTSIQTSKNEYDESCSEDDNSDDEESEEVGVSDRNRPRKRQRTNTKVKGREWVLRKKEQSRRKGKNVPADSKFTSRKRRTRF

SEQ ID NO: 32052 - protein, 450 aa, Streptococcus thermophilus LMG 18311
MVKEYDYIVIGGGSGGIASANRAAMHGAKVILFEGKEVGGTCVNVGCVPKKVMWYGAQVAETLHRYAGEYGFDVTINNFDFATLKANRQAYIDRIHGSFERGFDSNGVERVYEYARFVDPHTVEVAGELYTAPHILIATGGHPLYPNIPGSEYGITSDGFFELDEVPKRTAVIGAGYIAVEVAGVLNALGSDTHLFVRKDRPLRTFDKDIIDVLVDEMAKSGPTLHMHANATEVVKNADDSLTISFDNEETITVDCLIWAVGRAANTSGFGLEKTGVELTERGNIYSDEFENTSVPGIYALGDVTGKLDLTPVAVKAGRQLSERLFNNKVDAKLDYTDVATVVFSHPAIGAIGLTEEKAIAKYGAENIKVYKSSFTPMYTALGDNRQLSTMKLVTLGEDEKIIGLHGIGYGVDEMIQGFSVAIKMGATKADFDNTVAIHPTGSEEFVTMR

SEQ ID NO: 32053 - protein, 315 aa, Rhizopus oryzae
MPSVNITKNNKTTLYISGLDQQVNEAVLHAAFIPFGEIIAVQMATDTEIDSNNIHRGFGFVEYELAEDCQAAMDNMHLSELYGKVIKVQLAKTINVTTTSNRAVWTDESWLQKYGNVEDVEEKQEDEKENNQETTSEKKEVSSYIPSSEKRGKKSRVYLDIQIGNTLAGRIEIELRGDVVPKTAENFRALCTGEAGFGYKKSSFHRIIPQFMCQGGDFTKGNGTGGKSIYGGKFEDENFVLKHTGPGTLSMANAGSNTNGSQFFICTEKTTWLDGKHVVFGQVVSGMNVVREMERCGSASGKPSKRVVIVDCGEL

SEQ ID NO: 32054 - protein, 379 aa, Oryza sativa
MSKQTYNVVVLPGDGIGPEVVEQATRVLELISSKSDSFSINLKPFDFGGAAIDSTGKPLPDDTLEACKTADAILMGSVGGPKWGVGKVRPEQGLLALRKELDLYANIRPCLFPSESLLSHSPLKPEVAKGVSFIVVRELVKGLYFGDRQEANLDDPSSDGAAYDTMVYNKFDVERITKLASYLALQSSPPAPLHSIDKANVLATSRLWRKVVQDTVDTQFASQGITVDHQLVDSASMVMVSNPRKLNGIVLTENMFGDILSDESSVIPGALGLLPSASLSGLPDGKSRCNGLYEPIHGSAPDIAGRGIANPVGTILSAAMLLRYSLHQPELADKVEAAVRKVLDAKDIGGHELRTADLGGKHGSKDVGDAVIAALEALL

SEQ ID NO: 32055 - protein, 397 aa, Neisseria gonorrhoeae FA 1090
MAFLKLTEQNVRGKTVLIRADMNVPFKGGKISDDTRIRASLASVKYCLDNGASVIVMTHLGRPTEGEFHPEDDVAPVAAHLGGLLGKDVKVLNDWRENKPALNAGDVVMLQNVRINKGEKKNDLELGKAYAALCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDEMILDIGPKSAAALADLLKAAGTVVWNGPVGVFEFDQFAGGTKALAEAIAQSKAFSIAGGGDTLAAIAKFGVTEQIGYISTGGGAFLEFLEGKELPAVAALEKTRRVNGLI

SEQ ID NO: 32056 - protein, 471 aa, Bacillus cereus G9241
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVVFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQQTIPQEIN

SEQ ID NO: 32057 - protein, 364 aa, Ajellomyces capsulatus
MTTPAVPSHPLTLDPKYDDYDFPTTAPDAQSGHPGHTTPEQDARVYQLRIMLEQLDYTERLDTLTLLRFLRARKFDVEAAKAMFVECEKWRQEFGTDDLVNTFEYPEKPQVFEYYPQYYHKTDKDGRPVYIEKLGKIDLNAMYKITTADRMLKNLVCEYEKLADPRLPACSRKAGKLLETCCSIMDLKGVGITRVPSVYGYVKQASAISQNYYPERLGKLYLINAPWGFSSVFSVVKGFLDPVTVQKIHVLGSGYEAELLAQVPKENLPKEFGGECECENGCEFSGMGPWQEKEWAKEPKWVTKAPDDTAKEEADKENKGKKGSEGQERQKEAAEAAETAVMQKETEKNEADTVKQKINGEVTA

SEQ ID NO: 32058 - protein, 408 aa, Oryza sativa Japonica Group
MNGASSGGGGGAGAGGDGPLVYQRWKGNNGRFIFGPDARSLYVTMFLIIAPASIFCLFVAKELMNNFSYGLGLPVMISAVVFTAYDLSLLLLTSGRDPGIIPRNAHPPEPEGLDGNAEVGSNQTPPMRLPRVKDVVVNGITVKTKYCDTCMLYRPPRCSHCSICNNCVERFDHHCPWVGQCIGLRNYRFFYMFVFSTTLLCLYVFGFCWVYIVKIRNSEQITIWKAMAKTPASIALLVYTFIAVWFVGGLSVFHLYLMSTNQTTYENFRYRYDQRANPYNRGVMENIKDIFFSAIPASKNNFRARVPVPQEQGLRPRPTNGFMSPNMGRAVGDIEMGRKPVAWDEPRMAADIGDLGAGLGNLLEDKDGRFRSASPDLSRDALAIGGLDDQGSSVMNPGRTSWGVEAGR

SEQ ID NO: 32059 - protein, 336 aa, Physcomitrella patens subsp. patens
MKTKKVVVLGGGSFGTAMAVLLARNKSDMNVTLLLRDYTTCQAINDDHMNFKYFPRHQLPKNVTATTDAREALQDAHYCVHAVPVQSSSEFLCNIAEHVPPTLPILSVSKGLELSTLEMMSQIIPRALGNPRQPIAVISGPSFAIELMDELPTAMVAASRDRELASACQQLLASRYLRVNTSTDVVGVEIAGALKNVLAIAAGIVEGMDLGNNCMAALVAQGCSEIRWLAEKIGAKSHTLSGLSGSGDIMLTCFVNLSRNRSVGMRLGSGEKLEDILSSMSQVAEGVATAGAVISLAKKYRVQMPVLTAVARILDNELTPKTAVLALMSLPQVEEV

SEQ ID NO: 32060 - protein, 551 aa, Magnaporthe grisea 70-15
MTPQGLLAVCTGLLLLKIFISFVSRYRRHQILIRQHGCLPPPKAKLKDPIFGIDVILSNGRAAREHRSLQTFEERFYSIGATYSTKHGFPLIITMEPDNVRAVINQNFHDYALAPFRQPALKHFLGDGIFTTDGEKWHSSRALLRPNFNRDQIANLEAIETHVKDLFALLPRDGATPVDLKGLLLRFTMDSTTEFLFGQSVYSLRRNGARDGDSLEAQFETAFTGAQAECMEFIGMGPLARFARVNSQKQVEIVHRYIDKFVDRAIAFRKEYGKQGHRSESSLTGFVPGPAYRRVVVVDSQPGYPCHAFRKEYEAGGGGPIGTGKEKPKYLFLQELAKQTTDRTRLRSELLNILMAGRDTTASLLGNLFFMISKSPEIMAKLQQEVDSLNGARPSYSSLRDMKYLKYCLRESLRLHPVAPVNTRIAVTDTVLPRGGGPDGSKPVLVPKGTAVGWSVYAMHRRKDLYGPDADRFRPERWETLNTRSEYLPFNGGPRICLGQQYALTEASYVTVRMLQEYEMESRDPGEWEEELAITACNRRGCLVALKARSE

SEQ ID NO: 32061 - protein, 169 aa, Triticum aestivum
  misc_feature (56)..(56): Xaa can be any naturally occurring amino acid
  misc_feature (60)..(60): Xaa can be any naturally occurring amino acid
FFVGKVQRISLFRKIWEPFKIQIPFSPKRHPPEARASESENTPVFQRKKTNGDHGXNNRXSSSPAFMQQQQLAVQQDSYIQSRAEALQNVESTIHELSNIFTQLATMVSQQGELAIRIDENMEETVANVEGAQGQLLKYLNSISSNRWLMMKIFFVLMVFLMIFIFFVA

SEQ ID NO: 32062 - protein, 295 aa, Triticum aestivum
MGPGMVELGPGVVEVGAAEAAQTVPPAKRRRVLAVKTAAAAAAGRRPRRDRRPTAIQRLFQACRAVFKGPGTVPKPAEVALLRAMLDKMRPEDVGLSSNMPFFRNREAATEGTPTITHTTIYKSEKFSMVLFFLPTNAVIPLHNHPGMTVFNKLLIGSMHAKSYDWADPDDPANESGASSPDGKLRLAQLVVDDVFTAPCDTSVLFPTAGGNMHRFRAVAPSAFLDILGPPYSIEEDRDCTYYTDIPYSEHRMTSNEPIGDEQEGRRLAWLKEVEMPKDLKMCSVRYGGPPISGR

SEQ ID NO: 32063 - protein, 446 aa, Shewanella sp. MR-7
MSEAKLLLVEDDASLREALLDTLMLAQYDCIDVASGEEAIIALKQHQFDLVISDVQMQGIGGLGLLNYLQQHHPKLPVLLMTAYATIGSAVSAIKLGAVDYLAKPFAPEVLLNQVSRYLPLKQSSDQPVVADEKSLALLSLAQRVAASDASVMILGPSGSGKEVLARYIHQHSSRADQAFVAINCAAIPENMLEATLFGYEKGAFTGAYQACPGKFELAQGGTLLLDEISEMDLGLQAKLLRVLQEREVERLGGRKTIKLDVRVLATSNRDLKAVVAAGQFREDLYYRINVFPLTWPALNQRPADILPLARHLLAKHAKALNVLDLPEFDEAACRRLLSHRWPGNVRELDNVVQRALILRAGAVITANDIIIDAQDVPLSSDDAEYVNEPEGLGEELKAQEHVIILETLAQCQGSRKLVAEKLGISARTLRYKMARMRDMGIQLPN

SEQ ID NO: 32064 - protein, 480 aa, Kluyveromyces lactis NRRL Y-1140
MSKRSSSVANTPVKRKHLHSTLNHKFVSINSQDDYKHLYRSVVPLDIFVWGTGSMCELGLGPLAKNKEVKRPRLNPLLPRDEAKIVSFAAGGMHTLALDADNNIWSWGTNDSGALGRDTSGAVEKLKDMDANDSDDDEDGDLNEIESTPTKIPRDSLPLDELRCVQIAATDNLSAALFENGDVYAWGTFRCNEGILGFYRDEITVQKTPWIIPNFSKKAKIVQMAAGKDHILFLDETGIVYAWGNGQQQQLGRRILERSRLRTLDPRPFGLDNIKYISSGENHSFALSTDGKLYSWGLNQFGQCGISTELEDGSLVSVPTEVILPEGVEIDSVSAGEHHTLILAKSGDLYSCGRLDMFEVGISKDKLPEYTYKDVHGKARSIPLPTKLEDVPSFKAIAAGSHHSLAIAKNGIVYSWGFGETYAVGLGPSGDDIETPTRIKNTATQDHSIVFIGCGGQFSISGGVKLSDEEAEKRADEMDD

SEQ ID NO: 32065 - protein, 166 aa, Triticum aestivum
RNKDGIIYPSETYQGFRAIGAGVVLSAVGAVFINGGLGPKTIPENTKTGLKLPIYVKNIHKGKHGSDSGVYDANGRFVPEKFEEIFKKHAHTRPDALTDKELKELLQSNREPKDFKGWLGGFTEWKVLYYLCKDKDGFLHKDTVRAVYDGSLFAKMEQEKQSAKKK

SEQ ID NO: 32066 - protein, 429 aa, Ashbya gossypii ATCC 10895
MASPIKTKNQIDGAPTPQNTPASVLKESYLKNGNPLQTQQATTSVPQTINEEEINAALAKNPQLLATIQGKLGSLLGQDSGYIASLPRKVKDRLYALKKLQQDIFQLEKEFQLEMFQLEHKYLLKYAPLHARRAAIVKGADEPTPSAVEAGRLIEKENETPAIIDDDADEGDESDDAEDETGTPGVPGFWLTALENLPMISQTITDRDAEVLHYLANVSMEYLTEGKPGFKLLFDFAPNPFFADPVLVKTYYYQPELGYSGDFIYDHAEGTPIQWASHEANVTVVVEKRKQRNKTTKQVRTIEKLTPVESFFNFFDPPAVPPADESLDADDDDEEVVGLESRLALDYAIGEEIKDKLIPRAIDWFTGVAREFDYDDDEDSDAEGHFDDEDSDVDDDDDHPAEAADESEDDDLAASETRPGDNPPECKQQ

SEQ ID NO: 32067 - protein, 230 aa, Zea mays
  misc_feature (191)..(191): Xaa can be any naturally occurring amino acid
MAGVTATGMAGVPATFSSATAQIGGFLSKKPYAPPLWATHLSPMPCHTFSLGHRDDLSGMQLSGNKVRKLEFLMADAVAQGADCVITVGGIQSNHCRATAVAAKYLNLDCYLILRTSKLLVDKDPGLVGNLLVERLVGAHVDLVSKEEYGKIGSVALADLLKKRLLEEGRKPYVIPVGGSNSLGTWGYIEXIREIEQQIQQSADVQFDDIVVACGSGGTIAGLALGSRLS

SEQ ID NO: 32068 - protein, 321 aa, Escherichia coli
LPNITILATGGTIAGGGDSATKSNYTAGKVGVENLVNAVPQLKDIANVKGEQVVNIGSQDMNDDVWLTLAKKINTDCDKTDGFVITHGTDTMEETAYFLDLTVKCDKPVMVGAMRPSTSMSADGPFNLYNAVTAADKASANRGVLVMNDTVLDGRDVTKTNTTDVATFKSVNYGPLGYIHDGKIDYQRTPARKHTSDTPFDVSKLNELPKVGIVYNYANASDLPAKALVDAGYDGIVSAGVGDGNLYKTVFDTLATAAKDGTAVRSSRVPTGATTQDAEVDDAKYGFVASGTLNPQKARVLLQALTQTKDPQQIQQIFNQY

SEQ ID NO: 32069 - protein, 661 aa, Coccidioides immitis RS
MRYLLGLTEKLIQGPQASILRQIVAGPRLRHPEARLDLCYVTDEIIATSGPSSTYPQRAYRNPTDALVRFLDLKHGENWAIWEFRAEGTGYPDKEVYGRIHHFPWPDHHPPPFSLIPPMMASMRNWLTSKSKGKRVIVVHCKAGKGRSGTATCSYLISEQGWKAADALKQFTERRMRVGFGPGVSIPSQVRYVGYVDRWANKYNKKYVERPVEILEIHIWGLRHGLKVQVEGFVDEGRKIKCFHRFHRSERTTMDGDKETQGKNLPNGNALLAKPNKEETISNPQATTAPTPVETTSPFQAITEPEPLTRTVENISFFSKTPPPRAAFSSVLLRPHKPLIIPTSDINIDFERRATAAYSGWTMVTSVAHVWFNAFFEGGHEHDSGVFEEEWGNLDGIKGTSSKGTRAFDRLKVVWKYTAPSPGEEGAIIPGGPPLAGQVVSEPAPGEEVHEGHAADWRGADVVEEDNLESGEQASSESDENSAPQDTNNKENQTVDRARTKQLRTSSFPSDSLLLKRSPLSVAARRLGLRRRSSATAGIGSPSTSDTDSPAYRAFSLLGAGLLRTHEGVRGLSRSGEPTEQQSSNIILLSLFLGLFHHDLRLCRVLLVPYHHGIVVHRHAHELTSEESVSFGTGLNDFFEEYPGSIIRDVYGEGYSVPETG

SEQ ID NO: 32070 - protein, 183 aa, Zea mays
  misc_feature (134)..(134): Xaa can be any naturally occurring amino acid
  misc_feature (169)..(169): Xaa can be any naturally occurring amino acid
MKFNVANPTTGCQKKLEIDDDQKLRAFYDKRLSQEVSGDALGEEFKGYVFKIMGGCDKQGFPMKQGVLTPGRVRLLLHRGTPCFRGHGRRTGERRRKSVRGCIVSQDLSVLNLVIVKKGEKDLPGLTDTEKPRXMRGPKRASKIRKLVNLGKDDDVRKYVNTYRPQSLXRKVRSEQSPQIQRL

SEQ ID NO: 32071 - protein, 354 aa, Chromobacterium violaceum ATCC 12472
MKIAILPGDGIGPEIIAQAERVLEVLRRDGLKIETEHAPLGGAAYDQYGVPYPEATQKLAREADAVLLGAVGGPAYDKLDRPLRPERGLLAIRKDLNLFANLRPAILYPELANASTLKPEVVAGLDIMIVRELTGDIYFGQPRGIAVNELGEREAYNTMRYSESEVRRIAHVAFGIAMKRNRKLCSVDKANVLETTEFWKEIMIEVAKEYPQVELSHMYVDNAAMQLVRNPKQFDVMVTGNIFGDILSDEASMLTGSIGMLPSASLDQNNKGLYEPSHGSAPDIAGQNLANPLATILSAAMMLRYSFGQEAAARRVEDAVKKVLAQGYRTADIYEAGCEKVSCSGMGDAVVAAM

SEQ ID NO: 32072 - protein, 715 aa, Burkholderia sp. 383
MTTYTTLSFDVDANGIGLATLDQPGRAMNVLAPALMEEFTRVIGHVEQEAGIKGLVITSGKPSFVAGADIDQLSRITSAEQAFQLSEQLKALLRRMETCGKPVVAALNGTALGGGLELALACHARFAIDDPKAKIGLPEVKLGLLPGGGGTQRLPRMIGIQKSFELITQGIELSPAKALGLGLLNELAATREELLQKARAWCVAHPAPVQPWDTKGFRIPGGDSKSPAVVQMLAIAPSIANAKAHGNYPALTHIMSCLFEGCLLDFDTGSQVESRYFAACVMSQVSRNLIGTLWYQLNAIKKGQSRPAGMPPAKVKKVGILGAGMMGAGIAYVSAKAGIDVVLLDTTQENAEKGKAYSQGLLDKALARGKTTQDKRDALLARILPTTRYDDLRGCDLVVEAVFEDRAIKADCTTLAEAVIGDDAVFASNTSTLPITGLAHVSRRPAHFIGLHFFSPVDKMPLVEIIVGAKTSDETLARGFDYVLQIGKTPIVVNDSRGFYTSRVFATYVMEGIAMLAEGVHPRSIEVAGLKAGMPMPPLALQDEVSLGLSLHVTDQTRRDLEAEGKDYPPHPAEAVLRKVGLDLGRVGKKAGKGFYDYQGKEKSLWPELTALYPPRADQPAQQELVDRLMFIQANEAARCFEENVVRSVADTNIGSIFGWGFAPHHGGALQFINAMGAQRFVQRARELAAQYGARFEPAAIVVELARAGGRFEDA

SEQ ID NO: 32073 - protein, 353 aa, Thiobacillus denitrificans ATCC 25259
MKIAVLPGDGIGPEIISQAVKVLEALKSEGAKIEMETAPIGGAGYDAAGDPLPEATLKLAREADAVLLGAVGGPQYDTLDRPLRPERGLLRIRKELNLFANLRPALLYPELASASSLKPEVVSGLDLMIVRELTGDVYFGQPRGIETRNGERVGFNTMLYSESEVRRVAHVAFGIAMKRGKKLCSVEKANVLECSELWKEIMIEVAKDYPEVELSHMYVDNAAMQLIRAPKQFDTIVTGNIFGDILSDAASMLSGSIGMLPSASLDEHNKGMYEPIHGSAPDIAGKNLANPLATILSVAMMYRYTFADLATADRIENAVKQVIAKGYRTGDIWTEGTQKVSCSEMGDAVVVAL

SEQ ID NO: 32074 - protein, 287 aa, Olea europaea
MTKDVESHVEPAEEYSAKDYHDPPPAPLIDFDELSSWSFYRALIAEFVATLLFLYVTVLTVIGYKSQIDPAHGGDDCGGVGILGIAWAFGGMIFILVYCTAGISGGHINPAVTLGLFLGRKVSLIRAVLYMVAQCLGAICGVGLVKAFQKSYYHKYGGGANELAPGYNKGVGLGAEIIGTFVLVYTVFSATDPKRNARDSHVPVLAPLPIGFAVFMVHLATIPITGTGINPARSFGAAVIYNEDKPWDDHWIFWVGPFVGALIAAIYHQYILRAGAIKALGSFRSNA

SEQ ID NO: 32075 - protein, 334 aa, Neisseria gonorrhoeae FA 1090
MSIKVAINGFGRIGRLALRQIEKAHGIEVAAVNDLTPAEMLLHLFKYDSTQGRFQGTAELKDDAIVVNGREIKVFANPNPEELPWGELGVDVVLECTGFFTNKTKAEAHIRAGARKVVISAPGGNDVKTVVYGVNQDILDGSETVISAASCTTNCLAPMAAVLQKEFGVVEGLMTTIHAYTGDQNTLDAPHRKGDLRRARAAALNIVPNSTGAAKAIGLVIPELNGKLDGSAQRVPVATGSLTELVSVLERPATKEEINAAMKAASSESYGYNEDQIVSSDVVGIEYGSLFDATQTRVMTVGGKQLVKTVAWYDNEMSYTCQLVRTLEYFAGKI

SEQ ID NO: 32076 - protein, 394 aa, Magnaporthe grisea 70-15
MADKKNEDFVVRMPDNGTVEKEPFLARSPPARARTGSGGGFGDSFSLARVANNPPAAILAYCLSSISMTVVNKYVVSGSEWNLNFFYLAVQAIVCIIAILFCKQIGIITNLAPFDNVKAKKWFPVSLLLVGMIYTSTKALQFLSVPVYTIFKNLTIIAIAYGEVLWFGGSVSPLALVSFGLMVLSSVVAAWADIQSAIHGGSHPSEASTAISTLNAGYAWMGMNVFCSAAYLLGMRKVIHKMNFKDWDSMFYNNLLTIPVLIVCSLIAEDWSAANLARNFPIESRNALFIGMIYSGLGAIFISYCSAWCIRVTTSTTYSMVGALNKLPIAISGLVFFSAPVTFGSVSAIVIGFISGIVYAWAKARQSSQAKSALPTQQPVMSASSQSNKDASNS

SEQ ID NO: 32077 - protein, 355 aa, Triticum monococcum subsp. aegilopoides
MGNMSIRDDRDPEDIVVNGNGTEPGHIIVTSIEGRNGQAKQTISYMAERVVGNGSFGTVFRAKCLETGETVAIKKVLQDKRYKNRELQTMRVLDHPNVVALKHCFFSKTEKEELYLNLVLEYVPETAHRVIKHYNKMNQRMPLIYAKLYMYQICRSLAYIHNSIGVCHRDIKPQNLLVNPHTHQLKLCDFGSAKVLVKGEPNISYICSRYYRAPELIFGATEYTTAIDVWSAGCVLAELLLGQPIFPGDSGVDQLVEIIKVLGTPTREEIKCMNPNYTEFKFPQIKAHPWHKIFHKRMPAEAVDLVSRLLQYSPSLRSTALEALIHPFFDELRDQTPVCRTAVFFLPSLTLSPMS

SEQ ID NO: 32078 - protein, 306 aa, Streptococcus pneumoniae TIGR4
MSIYNNITELIGQTPIVKLNNIVPEGAADVYIKLEAFNPGSSVKDRIALSMIEKAEQDGILKPGSTIVEATSGNTGIGLSWVGAAKGYKVVIVMPETMSVERRKIIQAYGAELVLTPGSEGMKGAIAKAQEIAAERDGFLPLQFDNPANPEVHERTTGAEILAAFGKDGLDAFVAGVGTGGTISGVSHALKSENSNIQVFAVEADESAILSGEKPGPHKIQGISAGFIPDTLDTKAYDGIVRVTSDDALALGREIGGKEGFLVGISSAAAIYGAIEVAKKLGTGKKVLALAPDNGERYLSTALYEL

SEQ ID NO: 32079 - protein, 561 aa, Burkholderia xenovorans LB400
MTTLKITGMTCDSCAAHVKEALEKVPGVQSALVSYPKGTAQLAIEAGTSSDALTTAVAGLGYEATLADAPPTDNRAGLLDKMRGWIGAADKPSGNERPLQVVVIGSGGAAMAAALKAVEQGAHVSLIERGTIGGTCVNVGCVPSKIMIRAAHIAHLRRESPFDGGIAATVPAIDRSKLLAQQQARVEELRHAKYEGILDGNPAITVVHGEARFKDEQSLVVRLNDGGERVVAFDRCLVATGASPAVPPIPGLKESPYWTSTEALVSDTLPERLAVIGSSVVALELAQAFARLGSQVTILARNTLFFRDDPSIGEAVTAAFRAEGIKVLEHTQASQVAHVNGEFVLTTGHGEVRADKLLVATGRTPNTRSLALDAAGVTVNAQGAIVIDKGMRTSTPHIYAAGDCTDQPQFVYVAAAAGTRAAINMTGGDAAINLTAMPAVVFTDPQVATVGYSEAEAHHDGIETDSRTLTLDNVPRALANFDTRGFIKLVIEEGSGRLIGVQVVAPEAGELIQTAVLAIRNRMTVQELADQLFPYLTMVEGLKLAAQTFSKDVKQLSCCAG

SEQ ID NO: 32080 - protein, 200 aa, Brassica napus
  misc_feature (17)..(17): Xaa can be any naturally occurring amino acid
STTRPINVSTQHYVRTXGPRLLFPAALEDLKSTFLTHQSKTSPQNFKVTTPLIASDREKLLVMSLGEGYVATFKSKLQSSKGELNTMLWSSPVFFFLLFLFGAWHFFAKKKESLTAWGPDDPFTSSSSSASFSEPSRRNNDDLMDLRRRYVSPSRYPPGAAAGTYRSVASNDPTTRGSVDSTNYRATGQGMKYRGVTGLD

SEQ ID NO: 32081 - protein, 647 aa, Oryza sativa Indica Group
MATIGWIRGYRTSLLLTGKWDKPDPFDGRGLLWHLKMYQEDKYSCIDHSTSYLHVQSVRDFPIEKLNAEVVLVRLDSELLCNPLGSCNLSLERTVSTIKYLHKAGAKVLLVTSWTPVLQSVYPVLKSTETFADYMSSLLQVKVVPVNGVPGLTSFNPERWMQNDIILFENLFNFKGENANCNDFSQKLASGAAIFVNDSFSLSHKMLASTVGITRFCHASLAGFHFEEELMQLRKITDTTRRPFIAIIGGSNFLGKAPALNLLASLCDGLFFVGKLSLQIMNGFGIPVPSCFVEKNSTKEVLQLIQTAHNRNIPIYYPTDTWCLNNKNNNHEKLEILDSAELLPGWTPADIGPSTLEKISSLIPLYKKVLWIGPTGFDLTEEFSGGAAQLGRILDKASHDSCDVILVGSAACKAVKGISGSSSKYTTFKNVSVVLEFLKGKILPGVAALDKSYPYQIPWNAIFSDSSQPLVVDIGSGNGLFLFQMARNWEGSNFLGLEMNKKLVVRCLRDVASVDKRNLYFVSTNATSTFRSIVSSYPGQLALVTIQCPNPDFNIEQNRWRMVRRMLVEAIADLLQPNGKVYLQSDVESVLLGMKEQFMTHGKGQLVVDDDGGGDHQMDNPFGAASDWERHVLARGAPMYRTMLRKV

SEQ ID NO: 32082 - protein, 118 aa, Zea mays
  misc_feature (78)..(78): Xaa can be any naturally occurring amino acid
TKEKAAFSPSDPAMQRHVASGRPSGTDGSDFSYRMVVESRYQRVAEGRSRLARLILVQALHLVAGGLLLLLSLSKGGXVNKFAVLVHRGPPGHRGVGDPPWPPPPLPPPFLPCPFPVL

SEQ ID NO: 32083 - protein, 358 aa, Pisum sativum
MAAMFTTRNAIFRFSKSFPNVPSLSLPKPSRVFVASASHQSDWRNAADGKRNSSMDWAYNSTSKARQDADEIADRERKTLNGDVDSEDVKQYVRDAKERTKEAANRAAENADSAGVKSRDYAYDAKEKTKDAANRAAENVESAGEKAKDYAYDAKERTKDAANRAAENAESVGEKARDYAYDAKERTKEAAQNAGETAKDYAYGAKERTKEAAESAGGTARDYAYDATDKTKEAVGTVADKTKEGAKKTAEMTKEGAEKTAETTGEVAGAATEALKSAGEMAKRTAQGAWETAKDATQKIKETVVGKDDDDNDRGGGVGAVVDEYDVELKRKGYGESKGYDMSKGYGENKGYDQNRGY

SEQ ID NO: 32084 - protein, 464 aa, Candida glabrata CBS 138
MAKRRQKKRTHVQVVPDEERGIPKSMVIRVGQTSLGNHSLNQLVKDFRQIMQPHTAIRLKERKSNKLKDFVVMCGPLGVSHLFMFTQSEKTGNVSLKIARTPKGPTITFQVMDYSLGRDIKKYLRRPKSLTKEDVMNPPLLVLNGFTTKPKDENDEKEVERANVDKIVVSMFQNIFPPLNPSRIHINSIKRVFMINKDKETGEISMRHYFIDIREVDISRNLKKLYKAKNNLSKAVPNLHKKEDISSLILDHDIGAYTSESEIEEDSIVKVMDTESVKVKRSVKHKEDDTVEEAKDVDGDEDMKDFESSNIPLEEDDENEQEQAPVSTPRKKAVRLTEIGPRLTLKLVKLEEGICSGKVLHHEFVQKTDSEIRALEKRHKEKMRIKEQRRKEQEENIAKKKAHKEAKRQRKLERRAARKAAAEEGSEEGKDISESESDSSSSESENEYKDVPEDIDSDLYSDIE

SEQ ID NO: 32085 - protein, 444 aa, Brassica napus
MATITVVKARQIFDSRGNPTVEVDVHTSSGVKVTAAVPSGASTGIYEALGLRDGGSDYLGKGASKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGLHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNSKEENNNGSQKISGDALKGLYKSFVSEYPIVSIEDPFDQDDWEHYAKMTAECGDNVQIVGDDLLVTNPKRVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 32086 - protein, 764 aa, Oryza sativa Indica Group
MASQGEPSSSADPKGKKDYSTAILERKKSPNRLVVDEATNDDNSVVALHPDTMERLQLFRGDTVLLKGKKRKDTICIVLADETCEEPKIRMNKVVRKNLRVRLGDVVSVHQCQDVKYGKRVHILPIDDTVEGITGNLFDAFLKPYFLEAYRPVRKGDLFLVRGGMRSVEFKVIETDPTEYCIVAPDTEIFCDGEPIKREDEERLDEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTNGEVERRIVSQLLTLMDGLKARSHVIVMGATNRPNSIDPALRRFGRFDREIDIGVPDEVGRLEVLRIHTKNMKLAEDVDLELIAKDTHGYVGADLAALCTEAALQCIREKMDIIDLEDETIDAEILNSMAVTNDHFKTALGTSNPSALRETVVEVPNVSWEDIGGLENVKRELQEPIYVLEFLQTVQYPVEHPEKFEKFGMSPSKGVLFYGPPGCGKTLLAKAIANECQANFISVKGPELLTMWFGESEANVREIFRPGPPVCAMPDIIDPALLRPGRLDQLIYIPLPDEQSRLQIFKACLRKSPVAKDVDLNALAKYTQGFSGADITEICQRACKYAIRENIEKDIERERRSKENPEAMEEDEVDDIAEIKAAHFEESMKYARRSVSDADIRKYQAFAQTLQQSRGFGSEFRFERTEAGAGAAADPFASAAAVADDDDLYS

SEQ ID NO: 32087 - protein, 98 aa, Spirulina sp.
ATYKVTLISEAEGINETIDCDDDTYILDAAEEAGLDLPYSCRAGACSTCAGKITSGSIDQSDQSFLDDDQIEAGYVLTCVAYPTSDCTIQTHQEEGLY

SEQ ID NO: 32088 - protein, 518 aa, Mycobacterium avium 104
MSPARTAQQWHNPLRDKRDKRLPRIAGPCGMVIFGVTGDLARKKVMPAIYDLANRGLLPPSFSLVGFARRDWSTQDFGKVVYEAVKEHCRTPFRQENWDRLAEGFRFVPGAFDDDEAFGRLAETLDKLDAERGTGGNHAFYLAIPPKSFPVVCEQLHKSGLARPQGDRWSRVVIEKPFGHDLESAQSLNKAVNAVFPEESVFRIDHYLGKETVRNILALRFANQLFDPIWNSHYVDHVQITMAEDIGLGGRAGYYDGIGAARDVIQNHLMQLLALTAMEEPVSFSPLALQAEKIKVLSATHLAHPLDETTSRGQYTAGWQGGEKVVGLLDEEGFAKDSITETFAAITLEVDTRRWAGVPFYLRTGKRLGRRVTEIALVFKRAPHLPFDATMTDELGANAMVIRVQPDEGVTLRFGSKVPGTAMEVRDVNMDFSYGSAFAEESPEAYEQLILDVLLGEPSLFPVNAEVELAWHILDPVLDNWASGGRPEPYEAGTWGPDSAFEMLHRTGREWRGHDTQR

SEQ ID NO: 32089 - protein, 556 aa, Escherichia coli K12
AAPPAPPVSYGVEEDVFHPVRAKQGMVASVDATATQVGVDILKEGGNAVDAAVAVGYALAVTHPQAGNLGGGGFMLIRSKNGNTTAIDFREMAPAKATRDMFLDDQGNPDSKKSLTSHLASGTPGTVAGFSLALDKYGTMPLNKVVQPAFKLARDGFIVNDALADDLKTYGSEVLPNHENSKAIFWKEGEPLKKGDTLVQANLAKSLEMIAENGPDEFYKGTIAEQIAQEMQKNGGLITKEDLAAYKAVERTPISGDYRGYQVYSMPPPSSGGIHIVQILNILENFDMKKYGFGSADAMQIMAEAEKYAYADRSEYLGDPDFVKVPWQALTNKAYAKSIADQIDINKAKPSSEIRPGKLAPYESNQATHYSVVDKDGNAVAVTYTLNTTFGTGIVAGESGILLNNQMDDFSAKPGVPNVYGLVGGDANAVGPNKRPLSSMSPTIVVKDGKTWLVTGSPGGSRIITTVLQMVVNSIDYGLNVAEATNAPRFHHQWLPDELRVEKGFSPDTLKLLEAKGQKVALKEAMGSTQSIMVGPDGELYGASDPRSVDDLTAGY

SEQ ID NO: 32090 - protein, 410 aa, Blastopirellula marina DSM 3645
MSIELKVPEAGESIQEVQIGRWMKKEGDEVNEDESLVELETDKASMEMPAPAKGVLREIFKREGDLVTVGEVIGILDDGAAAAAPAAAPAEKPAAAEVEKPAPTPAPAATSGRGKASRPTIINSSSTPAKPSASSNGESEVKHAPAPAKAEEPKKAPPAPAKSQQLAPRAETSLAPQAGEKIVPMPLIRRRIAETLKSAQHNAALLTTFNQVDMTNVMALRKKYGQWFLDQWGVKLGFMSFFIKATIDALKQQPALNAEIRDGDKIVYRDYYHVGVAIGSKKGLVVPVLRNAERMRFAEIELAIADFAARANENRLSAAELSGGTFTITNGGVYGSLMSTPIVNPPQSGVLGMHTIEERPVARDGQVVIRPMMYLALTYDHCMVDGREAVMTLKRICDAIEEPARMLLEA

SEQ ID NO: 32091 - protein, 406 aa, Streptococcus pneumoniae
MKIAVAGTGYVGLSIAVLMAQHHEVVAVDIISEKVNLINNGKSPIKDDYIEEYLASKPLNLVATLDTNIAYQNADFVIIAAPTNYDSEKNFFDTSAVEAVIETVLETNPNAVMVIKSTVPVGYTQSIRNKYKTNNILFSPEFLRESKALYDNLYPSRIIVGLDMDDAYLKERAETFAELLQEGAIKENIEILYMGFTEAEAVKLFANTYLALRVSYFNELDTYAEVKGLDTKAIIEGVGLDPRIGSQYNNPSFGYGGYCLPKDSKQLLANYKDVPQNMITAIVESNRTRKDFIAEQILKFAGVSSNGEIHPKDVIIGLYRLTMKSNSDNFRQSSIQGVMKRLKAEGTNVIIYEPTLSDDETFLGSKIVNDLEHFKSISNVIVANRYDDLLKDVSDKIYSRDIFKRD

SEQ ID NO: 32092 - protein, 561 aa, Bacillus cereus G9241
MIHLKTQYTVSTYLLDRLSELGIEHIFGVPGDYNLAFLDDVIAHENVEWIGNCNELNAAYAADGYARIKGIAALITTFGVGELSAINGIAGSYAENVPVIKITGTPPTTVMENGALVHHTLGDGKFDHFSNMYREITVAQSKLTPEHAAEEIDHVLRACWSAKRPVHIQLPIDVYNKPINKPTEPILHKPVVSNKDALDKMLLHATSKINSAKKPVILADFEVDRFHAKEYLYQFVEKTGFPIATLSMGKGIFPEKHSQFIGIYTGDVSSPYLRKRIDESDCIISIGVKLTDTITGGFTQDFTKEQVIEIHPYTVKIIDKKYGPVVMKDVLQQLSNVIEHRNEETLDIKPFISESLSITEKFNPKPQMVTQKRFWQQIYHFLQENDVLLAEQGTPFFGSAAIPLPNNTTYVVQPLWGSIGYTLPALLGTQLANVSRRNILITGDGSFQLTVQELSTILRQNLKPIIFLINNNGYTVERAIHGQNEPYNDIQMWDYTKLANVFGSKEKSLTCKVENEIELAEVLTDITLNNKQLTFIEVVMSQGDQPELLAKLGERFGKQNS

SEQ ID NO: 32093 - protein, 508 aa, Mycoplasma pneumoniae M129
MIHHLKRTKIIATCGPALTKKLWTLAMLDDPAYAAMKAEAYANIENIIKNGVTVIRLNFSHGNHEEQAVRIKIVRDVAKKLNLPVSIMLDTNGPEIRVFETAPEGLKILKDSEVVINTTTKEVAKNNQFSVSDASGTYNMVNDVKVGQKILVDDGKLSLVVKRIDTKNNQVICVAQNDHTIFTKKRLNLPNADYSIPFLSAKDLRDIDFGLTHQIDYIAASFVNTTENIKQLRDYLASKNAKHVKLIAKIESNHALNNIDGIIKASDGIMVARGDLGLEIPYYKVPYWQRYMIKACRFFNKRVITATQMLDSLEKNIQPTRAEVTDVYFAVDRGNDATMLSGETANGAFPLNAVYVMKMIDKQSETFFDYQYNLNYYMANSKARHSEFWKQVVLPLAQKTAPKRKLINSDFKYDFVVHATNNLNEIYALSNARLAAAVIILTNDPQVYTGHGVDYGIFPYLIDQKPQSLSKAEFKSLANVAIKHYQQHGEISQLKQCLGVFHNKIISL

SEQ ID NO: 32094 - protein, 130 aa, Carboxydothermus hydrogenoformans
  misc_feature (113)..(113): Xaa can be any naturally occurring amino acid
IDYEKKLFTVDNITVKEGDYLSIDGSTGRVILGTVPMKDPELSPEFIKLLEWADELKRLEVRANADTPEDAQKAREFGAKGIGLCRTEHMFMGPERLPHVQRMILAETKEERXEALSHLLPMKEEDFYGF

SEQ ID NO: 32095 - protein, 273 aa, Mycoplasma pneumoniae M129
MGCTYIGPSGSNFGKKESIEDTAKVLGSMYDGIEFRGFKQSDVDALVKYSGVPVWNGLTDAEHPTQMLADYMTIKELKGDLKGRKIVFAGDIKNNVARSLMIGAAFVGMDIVLVGPKAQHELVQNGAGYKEVFEQCQALFQLNGGSVSFSTDKLQAAKNADVIYTDVWLSLGEDFSLFEERIQELGQFQVDMAMIKAAKSDVIFLHCLPAFHDDHTSFSLEIKQKLGKKYPVVKTGAMEVTDTVFQSKHNMAFIQAENRLHTIKAVILATLGY

SEQ ID NO: 32096 - protein, 640 aa, Neisseria meningitidis MC58
MIEIKNLTLQRGLKVLLDKANATVNPGQRVGLIGKNGTGKSSLFALIKGEITQDGGDVSIPKNWRLASVSQETPDLDISALDYVLQGDAELQAFQTALRQAEAQNDGMKQAEYHAKLEEIDAYTAPARAAKLLNGLGFSQEEHSRPVKSFSGGWRMRLNLAQALICRADLLLLDEPTNHLDLETVLWLENHLASLPCTQIIISHDRDFLNAETTQTIELSQQKLTQYGGNYDFYQNERAQRLAQQQAAYVKQQAQIKHLQSFIDRFKAKATKAVQAQSRMKALAKLERIAPAHLDSEFSFEFYHPDHLPNPLLKLEHADLGYEGKTVLHDITLSLESGARYGLLGVNGSGKSTFIKALAGTIDLLSGSIVRSEKLNIGYFAQHQLDTIRSDQNPVWHIQQLSPEVREQEIRNFLGGFNFVGDMALQKTEPFSGGEKARLALAMIIWQKPNLLLLDEPTNHLDLDMRHALTLALQSFQGALIVVSHDRSLLEATTDSFLLIDKGRLKNFDGDLNDYRQWRLAQENAAVAPAASAQSQSRKDTKRIEAQIRQEKARRGKPIQQKIDRAEKEMAQLSEIQTACEAFLAQEEAYFEENKEKLQDTLSELAKVKTQLAQIEEVWLACQEELEQIETEIEKQFAER

SEQ ID NO: 32097 - protein, 284 aa, Triticum aestivum
MSAAAGGSSSSSSTPAPRLEGKVALVTGGASGIGEAIVRLFRQHGAKVGIADIQDEAGQQLRDSLGGDPDVLFVHCDVTVEEDISRAVDAAAGKFGTLDIMVNNAGITGDKVTDIRNLDFADVKKVFDINVHGMLLGMKHATRVMIPSKKGSIVSLASVASVIGGMGPHAYTASKHAVVGLTKSVALELGRHGIRVNCVSPYAVPTALSMPHLPQGEQKGDAVRDFLAFVGSEANLKGVDLLPKDVAEAVLYLASDEARYISALNLVVDGGFTSVNGNLKAFED

SEQ ID NO: 32098 - protein, 499 aa, Physcomitrella patens subsp. patens
MTTCSVLVALVSSVFLFSRFRKPLQLPPGPKGLPFVGNLLQLGSLPHKTVTELHKKYGHLVYLRLGSVQTIVMDSPELFREITREQDNVFSSRPHLTFTELVAYDAHDFAMAPYGPHWRHVRKICVHELLTNKRLESTAGERKEEWRCMVKAILEAANSGDVVDMRDVFAGVSMTVMCRMLVGRRDFSAREDKPRDFKHLIHELFRLMGVLNLRDFVPALGWLDLQGFERDMRKLRREFDEVFDAVIQEHRDLASGKLPGGKPNDFISVLLDLPGENGEPHLDEKTIKALLQDMLAGATDTSAVTNEWAMAEIIRNQEIQRKLQNELDSVVGRDRNVQESDLPNMPYLMCITKETFRLHPAGPFGIPRETMADTKLNGYHVPKGTRVLMNFYSLGRNPEIWADPLEFKPERWERENLAQVQDPEFRIFPFGNGRRQCPGYILGSSMVLSTLATLYHGFNWSLPPDVARIDMDEAFGCTLPMRTRLRAVATPRLPPYLYA

SEQ ID NO: 32099 - protein, 480 aa, Oceanobacter sp. RED65
MVATAAQLTDEQQQLTYLHDIFAKQKSAYLDAPYPSAKQRQQDLDKLADALREFKEELCQAVNKDFSCRAEGETMIAEIMVSLEGIKYNRKHLKKWMKPSKRHVNPLFAPASNKVVFQPKGVVGIMVPWNYPVQLAVAPLAAALAAGNRAVIKMSEFTPYTNEVLYRMLAKYFPEEQVAVMSGEAAVGAEFSSMHWDHLLFTGSTAVARHVMSACGKNLVPVTLELGGKSPCIVTQKGDIKAAAKSIIFGKATNAGQTCIAPDYILCPQDLIPELKAEIADYYKQCYPTLKNNPDYTAIVNERQFHRLTSVLKDAEDKGAQVQPLNHANEDFSGTRKIPLTLVENTRSDMSIMEDEIFGPLLPILPYSDLNEVVSFINKGPRPLALYLFSHDKREQDFILENTHAGGVTINDCLTHIAQDDMPFGGVGDSGIGAYHGKEGFLSLSHAKSVHKKGRINLGSLVHAPYGRTMHKLIYKFMIR

SEQ ID NO: 32100 - protein, 181 aa, Streptococcus pneumoniae TIGR4
MKKEQIPNLLTIGRILFIPIFIFILTIGNSIESHIVAAIIFAVASITDYLDGYLARKWNVVSNFGKFADPMADKLLVMSAFIMLIELGMAPAWIVAVIICRELAVTGLRLLLVETGGTILAAAMPGKIKTFSQMFAIIFLLLHWTLLGQVLLYVALFFTIYSGYDYFKGSAYVFKGTFGSK

SEQ ID NO: 32101 - protein, 504 aa, unidentified eubacterium SCB49
MNKKALLLILDGYGITQDENVSAVAQANTPFIDSLFKEYPHAELLTHGQHVGLPEGQMGNSEVGHMNLGAGRIVYQDLAKINLAIKNNTLKDEKVLKEAFSHAKETGKKVHLLGLVSDGGVHSHISHIKGLLTAANDYGLDNVFVHAFTDGRDVDPKSGAKHISALQKHMAETTGQIASVIGRYFAMDRDKRWERVQKTYDLLVFGKGQSSENLVQSIEDSYNAGVTDEFIEPIVATKNGNPIAKIEKDDIVIFFNFRTDRGRQLTEALTQENFEDFGMHTIPLHYVTLTNYSASYKNIRVVYDKNNIEDTLGEVLERNNKTQIRIAETEKYPHVTFFFNGGREKPFNGEKRILCPSPKVATYDLKPEMSAFEIKDKIIPEIENETADFICLNFANPDMVGHTGVMSAAIKACETVDTCSKYIIEAALKHGYTTLVIADHGNSETMRNPDGSPNTAHTTNPVPLILVDKDIKHINNGILGDIAPTILDLLEVEKPAAMTQNSLL

SEQ ID NO: 32102 - protein, 320 aa, Zea mays
  misc_feature (312)..(312): Xaa can be any naturally occurring amino acid
MVGLHINMEAQIHILEQEAYSAVLRAFQAQADEFSWDKATVMTNLRKELRISDDENRQLLNNVHNDDLIKRIRDSRPRGGNQVVRHQSLDVHPSPTFSASRKKQKTFQSYPSIGSTRSKSFNNRVVSANEPAEALIGRKVWTKWPEDNSFYEAVVTQYNANEGRHALVYDINTVNETWEWVDLNEIPTKDIRWDGEEDGVTLNVGHGDGTTRGNRRTLSHGGRGRGPRTQPRREHLATENGGGRKFFGGIELFNTDSLVKEVERVFDSNLPDPHELDKAKKLLKEHEQALIAAIARLTDASDYESDGEEPYXHELPMLLG

SEQ ID NO: 32103 - protein, 330 aa, Myxococcus xanthus DK 1622
MAPRIGTLWDSVGNTPLLRIGSLSRQTGCEILAKAEFMNPGGSIKDRAAKGMIQCAEAQGLLKPGGAIFEGTAGNTGIGLGLLGRERGYRVVVTMPDNQAREKYELLEAMGVEVRKVPAVPFANPNHFFHQARVLAEAQGGFWANQFENPANGDYHYETTGPEIWEQCEGRVDVLVASVGSGGTMGGVSRYLKEKNPAVRVVLVDPPGSGLFTYVREGRMEGPGSSITEGIGIMRLTENFRRAQVDEAMRLGDQDMVEMLYHLAREDALVVGTSAALNVRAAWELARRHRGEGLRIVTFLCDHGSRYASKVFNPEFLASKQLEVRPLPVD

SEQ ID NO: 32104 - protein, 267 aa, unidentified eubacterium SCB49
MIIPKTREEIELMREAAQVVSRTLGMLAPLVKPGITTQELNDIAEAYIREQDALPGFLGLYDCPSTLLTSVNEAVVHGLPTDIPLKEGDIVSIDCGAIKHGFYGDHAYTFQVGEVAEETKKLLDITKESLYRGIRQFKKGNRVGDVGFAIQDFCESHSYGVVRELVGHGLGRTMHEDPEMPNYGKRGRGKKFVEGMTIAIEPMINLGTRRIKQLDDGWTIITQDKKPSAHFEHNVALVDGKPQLLSTFDFVYEALGIKSNEEDEFRP

SEQ ID NO: 32105 - protein, 506 aa, Hordeum vulgare subsp. vulgare
MEVEAGAHGDTAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKRGDMAKDKFSKVLWGAVTNYRTWIFVLLYGYCMGVELTTDNVIAEYYFDHFHLDLRAAGTIAACFGMANIVARPMGGYLSDLGARYFGMRALWNIWILQTAGGAFCIWLGRASALPASVTAMVLFSICAQAACGAIFGVAPFVSRRSLGIISGLTGAGGNVGAGLTQLLFFTSSQYSTGRGLEYMGIMIMACTLPVALVHFPQWGSMFFPASADATEEEYYASEWSEEEKGKGLHIAGQKFAENSRSERGRRNVIFATSATPPNNTPQQV

SEQ ID NO: 32106 - protein, 245 aa, Bacillus cereus G9241
MIKLVLIRHGQSLWNLENRFTGWTDVDLSENGLSEAREAGAILKKNGYTFDVAYTSVLKRAIRTLWIVLHEMDLAWVPVHKSWKLNERHYGALQGLNKDETAQKYGEEQVHIWRRSIDVRPPALTEDDPRYEMNDPRYKALKKGEFPLTECLVDTEKRVLAYWHSEIAPKLKNGNKVIISSHGNTIRSLVKYLDNLSSDGVVSLNIPTSIPLVYELDDDLRPIRHYYLSMDGEVPEGEIPKHISF

SEQ ID NO: 32107 - protein, 485 aa, Rhodopirellula baltica SH 1
MNKFEDLGLTGPLLQGLEQAGYETPTPIQAQSIPEILDGNDVLGAAQTGTGKTAAFALPILQIMWEDDQERREPSKRRGGRPGRRPIRTLVLSPTRELSAQIEANFRIYGKKTRLRSTVIFGGVNQNPQVRELQSGVDTLVATPGRLLDLVNQGFIDLKDVEILVLDEADHMLDMGFLPDVKRILKFLPRDRQNLLFSATMPGPIRKLADEILVDPVTIQIAPQKPTVERIEQSICFVAQADKPRLLNHFIETKATGSTLVFTRTKHGADAVARRLVKAGVKAAAIHGNKTQANRVRTLNKFKNDELDVLVATDVAARGIDIDGIQTVINYDTPNTPEAYVHRIGRTGRAGREGETVMFCGGHETKFFIAIEREIKLQIPVATGLPGCQPRPLQDPESGDKASSRSGGRSGGGGQSGGGRSRSGSGAQGGTGGGSKPGGRRRRGRAEGSVSGRGSTVGRKSAGSEAGKSGGSKNNRGRGGRPASR

SEQ ID NO: 32108 - protein, 507 aa, Hordeum vulgare subsp. vulgare
MEVEAGAHGDAAASKFTLPVDSEHKAKSFRLFSFANPHMRTFHLSWISFFTCFVSTFAAAPLVPIIRDNLNLAKADIGNAGVASVSGSIFSRLAMGAICDLLGPRYGCAFLVMLSAPTVFCMAVIDDASGYIAVRFLIGFSLATFVSCQYWMSTMFNSKIIGTVNGLAAGWGNMGGGATQLIMPLVFHAIQKCGATPFVAWRIAYFVPGMMHIVMGLLVLTMGQDLPDGNLASLQKKGDMAKDKFSKVLWGAVTNYRTWIFVLLYGYCMGVELTTGNVIAEYYFDHFHLNLRAAGTIAACFGMANIVARPMGGYLSDLGARYFGMRARLWNIWILQTAGGAFCIWLGRASALPASVTAMVLFSICAQAACGAIFGVEPFVSRRSLGIISGLTGAGGNVGAGLTQLLFFTSSQYSTGRGLEYMGIMIMACTLPVALVHFPQWGSMFLAASADATEEEYYASEWSEEEKSKGLHIAGQKFAENSRSERGRRNVILATSATPPNNTPLHV

SEQ ID NO: 32109 - protein, 639 aa, Photorhabdus luminescens subsp. laumondii TTO1
MTTETEISFADLGLSAPILSALEDLGYEKPSPIQQQCIPHLLNGRDVLGMAQTGSGKTAAFSLPLLHNINAELKAPQILVLAPTRELAVQVAEACADFSKHMRNVNVVALYGGQRYDVQLRALRQGPQIVVGTPGRLLDHLKRGTLDLSNLSGLVLDEADEMLRMGFIEDVENIMSQIPAEHQTALFSATMPEAIRRITRRFMNDPQEVRIQASVTTRPDISQSYWSVYGMRKNEALVRFLEAEDFDAAIIFVRTKNATLEVAEALERNGYNSAALNGDMNQALREQTLERLKDGRLDILIATDVAARGLDVERISLVVNYDIPMDAESYVHRIGRTGRAGRAGRALLFVENRERRLLRNVERTMKLTIPEVELPNAELLSQRRLERFAANVQQQLESSDLDQYRTLLSKLQPAEDLDIETLAAALLKMAQGERPLILPPDPVRRPRREFNERDDRRRNGFDDRGERSDRPRRERRDVGEMELYRIEVGRDDGVEVRHIVGAIANEGDISSRYIGNIKLFATHSTIELPKGMPGDLLSHFTRTRILNKPMNMQLMGDAQPFERRERRGGGRNGNGNGNSSGSGPRRDRENFNGGGRRFNGERRGGEGRGEGQSRSNFRGRGDDHGSSAPRRRYNNSNAQ

SEQ ID NO: 32110 - protein, 365 aa, Triticum aestivum
  misc_feature (251)..(251): Xaa can be any naturally occurring amino acid
HQLVRVITPRYLCDTIEYSSYASNALGALPYGRPAGGRTSDFERPPGQVSGINAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACXKAADEAVKMVLDAVEQVGGIYLVTADHGNAEDMVKRNKAGQPMLDKSGSIQILTSHTLQPVPVAIGGPGLHPGARFRSDIQTPGLANVAATVMNLHGFQAPADYETTLIEVVDK

SEQ ID NO: 32111 - protein, 211 aa, Glycine max
  misc_feature (193)..(193): Xaa can be any naturally occurring amino acid
  misc_feature (201)..(201): Xaa can be any naturally occurring amino acid
MSVENSSTSVSVAEGQSKNAMKPKYSRFSQQELHAWQPILTPSWAISIFTVIGLIFIPVGLASLFASESVVEVPFRYDDECLPPDHKNDAVAYIKDVGSNKTCTKKLTVKNKMKAPVYVYYQLDNFYQNHRRYVKSRDDKQLRSKAAENDVGSCSPEDYTPNDMGHKPIVLGPYCWSLFNDTYKLTSNNKDLXVINKKNIXAWKSDQNGKF

SEQ ID NO: 32112 - protein, 727 aa, Photorhabdus luminescens subsp. laumondii TTO1
MTQAQHDAAPITTGTNQTASVFSFDVRPDKIGIITINVPGEKVNTLKAEFVDQFLNVFKQAQQSSGLKGLILISGKPDTFIAGADISMIAGCKTKEDARDLAEKGQKLFSQIANYPLPVVAAIHGACLGGGLELALACHWRVCSQDDKTRLGLPEVQLGLLPGSGGTQRLPRLIGVSSALDIMLTGKQLRAKQALRLGLVDDAVPLDILLDIAIEKVKKGIPVRKPLPWQQRLLVGPVGRYFLFNIVRKKTLAKTRGHYPAPERIIEVVKEGLEKGMSQGLRAEAVAFGELAMTRESAALRNLFFAATSLKNETGSSEKPAKIKHVGILGGGLMGGGIANVTATRGKLPVRIKDINEKGISQVLKYTWDLLSKRVKQKRLRPAERAQQMMLISGTTDYRGFAQTDIVVEAVFEDLSLKQKMVAEIETNAKPETIFASNTSSLPIHQIAEKAQRPEQVIGLHYFSPVDKMPLVEVIPHQGTSEKTIATAVSLAKKQGKTAIVVGDKAGFYVNRILVPYISEAAHCLVAGEPIDHIDGALVNFGFPVGPINLLDEVGIDVGTKIMPVLVEQLGPRFAAPESLDAVLKDGRKGRKNGRGFYLYAPGPRKFWQFGKRDKKVDSSVYTLLNITPESHMLSSEIAQRCVMLMLNEAVRCLDEGIIRSPRDGDIGAVFGIGFPPFFGGPFRYIDSLGCARVVEILRRLESQYGDRFVPCECLVNMAEQNKSFYP

SEQ ID NO: 32113 - protein, 407 aa, Pseudomonas fluorescens PfO-1
MSQTSFAIQQAAVIGAGTMGRGIVMCLANAGVSVQWVDNNPQMLEQALSSVAETYAHNVRQGRIDQAEADARIARVSKAADYVAIRNVDLVIEAVYENLELKQKIFRELDGVLKPEALLASNTSALDIDAIAAATRRPTQVLGLHFFSPAHIMKLLEIVRGAQTAPAVLEAALELGKRMGKVSVVSGNCHGFIGNRMLHPYVLEARKMLLEGAYPHQVDAALQSFGFAMGPFRMYDVVGIDLEWRARELAGKGQDAPEVQVDNRLCEQGRFGQKSGNGYYHYEPGSRQAEHDPEVDALVLSVSEGLGFHRRDIGSEEILERCLLALVNEGAKILQEGIAESAHDIDQVYLNGYGFPAERGGPMAWADDQGLADIHKRLLALETRQGDHWRPAPLIGELAARGKGFYL

SEQ ID NO: 32114 - protein, 439 aa, Oryza sativa Indica Group
MNGAGGNHQQQQQQQQRLRQQQQQQALLMQQALQQQQQYQSGVLAAAAAAAMTQMEPISNGNLPPGFDPSTCRSVYVGNVHPNVTESLLIEVFQSSGLVERCKLIRKEKSSFGFVDYYDRRSAALAIMTLHGRHICGQAIKVNWAYASTQREDTSVMLESCGITKPDAPEVMVLSPSVINRHEQLRPFSISQMFTNFCPVGDEAETAITEMTGKWLGSRQIRCNWATKNNAEEKQETDNHNAVVLTNGSSSNPGMEASQDTGSKENPENNPDCTTVYVGNLGHEVNRDELHRHFYNLGVGAIEEVRVQQDKGFGFVRYSNHGEAALAIQMANGLVVRGKPIKCSWGNKPTPPGTSSKPLPPPLPSYQPVPMAGVPQGFSAADIVAYQRQLTLSQVAAGQIAGQHGLAGQVSAGLLAAGSQALYDGYPNQSSAQQLMYYN

SEQ ID NO: 32115 - protein, 515 aa, Chlamydophila pneumoniae J138
MTKTEEKPFGKLRSFLWPIHTHELKKVLPMFLMFFCITFNYTVLRDTKDTLIVGAPGSGAEAIPFIKFWLVVPCAIIFMLIYAKLSNILSKQALFYAVGTPFLIFFALFPTVIYPLRDVLHPTEFADRLQAILPPGLLGLDAILRNWTFAAFYVLAELWGSVMLSLMFWGFANEITKIHEAKRFYALFGIGANISLLASGRAIVWASKLRASVSEGVDPWGISLRLLMAMTIVSGLVLMASYWWINKNVLTDPRFYNPEEMQKGKKGAKPKMNMKDSFLYLARSPYILLLALLVIAYGICINLIEVTWKSQLKLQYPNMNDYSEFMGNFSFWTGVVSVLIMLFVGGNVIRKFGWLTGALVTPVMVLLTGIVFFALVIFRNQASGLVAMFGTTPLMLAVVVGAIQNILSKSTKYALFDSTKEMAYIPLDQEQKVKGKAAIDVVAARFGKSGGALIQQGLLVICGSIGAMTPYLAVILLFIIAIWLVSATKLNKLFLAQSALKEQEVAQEDSAPASS

SEQ ID NO: 32116 - protein, 98 aa, Spirulina sp.
ATYKVTLIDEAEGINETIDCDDDTYILDAAEEAGLDLPYSCRAGACSTCAGTITSGTIDQSDQSFLDDDQIEAGYVLTCVAYPTSDCTIKTHQEEGLY

SEQ ID NO: 32117 - protein, 117 aa, Oryza sativa
  misc_feature (52)..(52): Xaa can be any naturally occurring amino acid
PEGCGYEFQMQYGSIGWSVGALLGYAQGAKDKRVIACIGDGSFQVTAQDVSXNGEGKCWTSKVKCEEELTEAIGMALGEKDCLCFIEVIAHKDDTSKELLEWGSRVSAANSRPPNPQ

SEQ ID NO: 32118 - protein, 364 aa, Burkholderia xenovorans LB400
MKTYRIATIPGDGIGKEVIPAGAQVLEALARTSKSFAFEFENFGWGGDYYREHGVMMPADGLDAIRNKDAILFGSAGDPDIPDHITLWGLRLKICQGFDQYANVRPTRILPGIDGPLKRCKPGDLNWVIVRENSEGEYSGVGGRVHQGHPIEAATDVSILTRAGVERIMRFAFRLAQSRPRKLLTVITKSNAQRHAMVLWDEIALEISKEFPDVKWDKELVDASTARMINRPATLDTIVATNLHADILSDLAAALAGSLGIAPTGNIDPERRYPSMFEPIHGSAFDIMGKGLANPVGTFWSVVMLLEHLGEFDAAQRVMQAVEAVTADTSLHTGDLGGTATTAQVTAAVCAFIENAVSSAARAA

SEQ ID NO: 32119 - protein, 540 aa, Streptococcus pneumoniae TIGR4
MLTVSDVSLRFSDRKLFDDVNIKFTEGNTYGLIGANGAGKSTFLKILAGDIEPTTGHISLGPDERLSVLRQNHFDYEDERAIDVVIMGNEKLYSIMKEKDAIYMKEDFSDEDGVRAAELEGEFAELGGWEAESEASQLLQNLNIPEELHYQNMSELANGEKVKVLLAKALFGKPDVLLLDEPTNGLDIQSITWLEDFLIDFDNTVIVVSHDRHFLNKVCTHMADLDFGKIKLYVGNYDFWKESSELAAKLLADRNAKAEEKIKQLQEFVARFSANASKSRQATSRKKMLDKIELEEIVPSSRKYPFINFKAEREIGNDLLTVENLTVKIDGETILDNISFILRPDDKTALIGQNDIQTTALIRAIMGDIDYEGTVKWGVTTSQSYLPKDNSADFAGGESILDWLRQFASKEEDDNTFLRGFLGRMLFSGDEVNKPVNVLSGGEKVRVMLSKLMLLKSNVLVLDDPTNHLDLESISSLNDGLKNFKESIIFASHDHEFIQTLANHIIVLSKNGVIDRIDETYDEFLENAEVQAKVKELWKD

SEQ ID NO: 32120 - protein, 275 aa, Arabidopsis thaliana
MVNYSSISCIFFVALFSIFTIVSISSAASSHGEVEDEREFNYKKNDEKGPERWGELKPEWEMCGKGEMQSPIDLMNERVNIVSHLGRLNRDYNPSNATLKNRGHDIMLKFEDGAGTIKINGFEYELQQLHWHSPSEHTINGRRFALELHMVHEGRNRRMAVVTVLYKIGRADTFIRSLEKELEGIAEMEEAEKNVGMIDPTKIKIGSRKYYRYTGSLTTPPCTQNVTWSVVRKVRTVTRKQVKLLRVAVHDDANSNARPVQPTNKRIVHLYRPIV

SEQ ID NO: 32121 - protein, 341 aa, Prochlorococcus marinus str. NATL1A
MRIGINGFGRIGRLVLRALWDRENIEISHINDPFGDAKGAAHLLEYDSVHGRWNKAISNDQNNLSIEGQPISFSQESDYTKVPWNEKGIELILECSGKFKTPQTLNPYFDTLGMKRVVVACPVKGSIQGEDTLNIVYGINHDLYEPNKHRLVTAASCTTNCLAPVVKVVNQAFGIKHGSITTLHDLTNTQVIVDSFKSDLRRARSGSQSLIPTTTGSAKAIGMIFPELQGKLNGHAVRVPLLNGSLTDAVFELEKEVTQEEVNHVFKEASEGELKGILGYEEKPLVSIDYVNDSRSSIIDAPSTMVINKSQLKVYIWYDNEWGYSCRMADLVCHVINLEKD

SEQ ID NO: 32122 - protein, 353 aa, Neurospora crassa
MGCGMSTEEKEGKARNEEIENQLKRDRMQQRNEIKMLLLGAGESGKSTILKQMKLIHEGGYSRDGAESFKEIIFSNTVQSMRVILEAMESLELPLADQRVEYHVQTIFMQPAQIEGDVLPPEVGNAIEALWRDAGVQSCFKRSREYQLNDSARYYFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 32123 - protein, 132 aa, Helicobacter pylori
SNIKYELDKKSGALMVDRVLYGAQNYPANYGFVPNTLGSDGDPVDALVLSDVAFQAGSVVKARLVGVLNMEDESGVDEKLLALPIDKIDPTHSYVKDIDDLSKHTLDKIKHFFETYKDLEPNKWVKVKGFEN

SEQ ID NO: 32124 - protein, 380 aa, Picea sitchensis
MASPLSPQTITCKAAVAWGPGEPMSIEEVQVAPPQPMEVRIKVVATTICRSDITLWESRGHIPIFPRIFGHEATGIVESVGEGVTDLREGDHVLTVFQGECKKCRHCKSDKSNACETLGVEGNGLMHSDQKTRFSINGKPIYHFVGVSSFSEYTVVHSECVVKLSPDVPLGKISVLGCSVATGFGAAWKIANVGKGSTVVIFGLGAVGLAVAQGAKLRGASRIIGVDINPDKFERGKIFGVTEFINPNDYKQPTQEVVKEITTGGADYCFECVGNVELMRTALESCCDGWGMAVLIGVPSGKMELSAHYGPLLNGRTLKGTLLGGWKTRSELPTLVEMYMKKEIQIDEYVTHELPFADINKGYQLMKEGKCLRCVLHVVI

SEQ ID NO: 32125 - protein, 268 aa, Triticum aestivum
  misc_feature (153)..(153): Xaa can be any naturally occurring amino acid
  misc_feature (173)..(173): Xaa can be any naturally occurring amino acid
  misc_feature (206)..(206): Xaa can be any naturally occurring amino acid
  misc_feature (218)..(218): Xaa can be any naturally occurring amino acid
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAXGKIKDWTNVVVAYEPVWAIXGTGKVATPAQAQEVHANLRDWLKTNVSPEVAEXTRIIYGGSVTGXASCKELAGHPDLDGFLVGGASLKPEFIDIINAATVNLPKQDLDVVLSALE

SEQ ID NO: 32126 - protein, 604 aa, Neurospora crassa
MSMYPHRPIAGAPIQNMGRLNELLDGIRMEFESQARQYETCQHDLATQLQELQVIREKVFQMEQHQMNVKQKYEDEIALLRRQLEARGGAPGNMNPPPQHPGQQQPPAIGLGSNVFSAIMAGQGGQALVPPPPPPQQQEQPAHMPAPPGLQGPPPPPPPPSQQPPFQQQYQGPQGPGNFPPQPPQSTASPGPAGKRGIGRPPAGGPATPQINTPIPYNGGPAQSPQVPTHPTPDHTRMAQHHQPPPPPPSQTNALSELDPDRLPNHIKKMKDDWWVIFNAAVPRVLDVELVHTLQHESVVCCVRFSMDGKYVATGCNRSAQIYDVETGEKLCILQDENIDLTGDLYIRSVCFSPDGKYLATGAEDKLIRVWDIQSRTIRNTFHGHEQDIYSLDFSRDGRTIASGSGDRTVRLWDIETGQNTSVLSIEDGVTTVAISPDKQFVAAGSLDKSVRVWDMRGYLAERLEGPDGHKDSVYSVAFSPDGRNLVSGSLDKTIKMWELSAPRGIPSSAPPKGGRCIKTFEGHRDFVLSVALTPDSQWVLSGSKDRGVQFWDPRTGHTQLMLQGHKNSVISVAPSPVTGSNGVGYFATGSGDMRARIWSYSRI

SEQ ID NO: 32127 - protein, 107 aa, Arabidopsis thaliana
ALSAAFMVGAQFDGADLPGVAMSIAYAVEASSKGVNFPNAVIDRVDFGESNLEGSVFTNTVLSGLTFQDANLEDVVLEVTNVGYIDLQKICRDAFIHEEGSLVLGCL

SEQ ID NO: 32128 - protein, 432 aa, Saccharomyces cerevisiae
MNKRTQEYKNTRAIMSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYTIEAKL

SEQ ID NO: 32129 - protein, 410 aa, Blastopirellula marina DSM 3645
MQFRHEVLDNGLQIVAEINPNAYSLSSAFFVKTGSRDETAEIAGVSHFLEHMVFKGTPRRSAADVNRELDEMGSQSNAYTSEEQTVYYAVVLPEFQEQVVDLLADIMRPSLRVSDFETEKQVILEEIMKYDDQPPFGGHERIMASYFGQHPLGNSVLGTAETVGALSADRMMDYFNRRYSPHNIVLAASGRVDFDALVEQAKRHCGDWERSETSRDLSRPAGKTGFEVIHKETAAQEYLIQLADCPASEDADRFAARLLTTIFGDDTGSRLFWALVDPGLAEFASSDPYEFQSAGVYMNYLCCSPEEAASNLAILTEEIAKLEKNGVTLAELEQAKNKVCSSTVLRSERPSSRLFSVGNGWIQRGKYHTVAESVAAYKSVTLDDVHAVLAKYPLSKSNTLAIGPLAELSR

SEQ ID NO: 32130 - protein, 219 aa, Alteromonadales bacterium TW-7
MFDYVGSGNSDISQYNKQRYKKLEGYALDVIEVCTELNLSDVVFVGHSVSGMIGALAAVERPDLISKLIMVCPSPCFLNFPSDYQGGFDKEDLQELLSLMDKNYIGCADYLAPLVIGNTNSAELIGELSGSFCSTDPVIAKNFAEATFFSDYRFLLTKIIQPTLILQSEDDALADVSVGQYIEKEIQSSSLIVISAQGHCLQMTHPEIVSQSITDYVKQ

SEQ ID NO: 32131 - protein, 863 aa, Aspergillus nidulans FGSC A4
MPVDLTCYPPLGKVTCLEADKIRFTILIEPASQGQYEFQIWHNIGLSEWAALPLSEYPSAALPALSSRQDPGNRGVFAGEISCPQARYAGRFTVRYREGSEGEWRWANKERGCHDGELVIVSRGLSSELALSSAQDFANYFDGLSPDIQVEVRKSEAPGAALWNISGPVEEARDGHSGLLRLPLGTPSSMSRFFALARVETSWLGPRQGKDKLNFTEDAILLSFLRTDGVHVVLLGVTVDDTLTVLGSGPAGEVVIKSQNDNATPSRFQVLAATAADFEVATSALIYEARRLVRPYENTAQGGPRTQWLSEWYDGLAYCTWNGLGQDLSEEKILSALDDLKTAGIRIRTLIIDDNWQSLDNEGAGSWHRALTQFEANSKAFPNGLAKAVTTIREQHRNIEYIVVWHALFGYWGGISPEGSLAAIYKTREVALNSTTRPSMLTIDPSDIQRFYNDFYAFLSRSGISGVKTDAQSFLDLLADPEDRRSYANAYQDAWTISSLRHFGPKAISCMSQIPQTIFHSQLPTNKPTIVVRNSNDFFPDIDDSHTWHVFCNAHNALLTRYLNGLPDWDMFQTLPENGLDYASFHAAARCISGGPIYITDKPGQHDIPLIKQMTASTIQGTTITLRPDIAARTLDMYHDIKEGHILCVGTYHGRAGSGSGIIGVFNVSNRVESVIIPVADFPGIYDDQEETGYIVRAHRTGRIVGELHSSSAVSVTLNERRWEVLTAYPVKTLTFKMNSKDKENESSMPTADVSVDVAILGLLRKMTGVAALVSSDIYIEDTGRLRVDVGIKALGVLGIYFSCLQDWDIDKHFMVLVSGKPVPRKTIWKEDGRVLAIDVEEAWHGLGLEAGWGNEVWISVLM

SEQ ID NO: 32132 - protein, 759 aa, Coprinopsis cinerea okayama7#130
MAAANLTVPTKASPFPYGATALAAYTNTATIHFDNAATDLALTLDGQSASNEDEIIQILAKAGNVASDSAKSASYFALTTNLRTLAAFPEIVAALDSLDDYLAYRTYLVGHEPSAADWAVWGALKGNIKVLGLLKNNQHTHLLRWFSHLESLKPIQKLIADFTAAKAQKARSNKTAAGFALGLQDAVEGQVVTRFPPEPSGYLHIGHAKAAILNQYFARMYRGKLIIRFDDTNPSKERTEFQKTILEDLQLLDIHGDKVTHTSDYFDQLYELAVKMIKDGKAYADDTEKEQMQKERFDGIASKHRDNSVEDNLKRFEEMKSGSEEGQRWCLRAKLSVDSPNKALRDPVIYRCNLTPHHRTGDKWKIYPTYDFACPLVDSIEGVTHALRTNEYRDRNPQYLWMNKTLGMRKVNIWDFSRLNFVYTLLSKRKLHWFVDNGHVSGWDDPRFPTVRGIRRRGMTVEALTQFMLSQGPSSAVVSLEWDSIWALNKKIIDPVAPRHWAIISDKSVPVTVNGGPSSPEIKSLPRHKKNPDVGEKKTVYASHILIEQEDAASFDLNEEITLMDWGNAIVRTKSIDAAGTVTEIVVDLHLEGDVKKTKKKITWLAAPKDNHPLPTVSLVDFDYLITKKKLEENDEFADFVTPVTEFKETALADANVLDLPKGEIIQFERKGYYIYDGEKDGVKEFFKIPDGKAAGIASKAATAAAAGAQKAATPAAPANEIADPSAAVTSMYKVKPINPDENPTVETGMYKVKSLYTA

SEQ ID NO: 32133 - protein, 461 aa, Mesembryanthemum crystallinum
MQSQSNDEDNNAHYDFDLFVIGAGSGGVRAARFSAKFGAKVGICELPFHPISSEVIGGVGGTCVIRGCVPKKILVYGASFSGELQDARNYGWELNENIDFNWKKLLQKKTDEILRLNNIYKRLLSNAGVKLYEGEGKIVSPNEVQVTQLDGTKLSYSAKHILIATGSRAQRPDIRGQELAITSDEALSLEELPKRAVILGGGYIAVEFASIWRGMGATVDLFFRRELPLRGFDDEMRAVAARNLEGRGVNMHPRTNLTELVKTDGGIKVRTDHGEELMADVVLFATGRSPNTKRLNLDAVGVNVDKTGAIKVDDYSQTSVPSIWAIGDVTNRMNLTPVALMEGTCFAKSLFGGQPTKPDYKDIPCAVFSIPPLSVVGLSEEQAIEQSNGDVLVFTSSFNPMRNTISQRQEKSVMKLVVDAETDRVLGASMCGPDAPEIMQGIAVALKCGATKAQFDSTVSR

SEQ ID NO: 32134 - protein, 362 aa, Candida albicans
MSSASVTAPVNIATLKYWGKRDKSLNLPTNSSISVTLSQDDLRTLTTASASESFEKDQLWLNGKLESLDTPRTQACLADLRKLRASIEQSPDTPKLSQMKLHIVSENNFPTAAGLASSAAGFAALVSAIAKLYELPQDMSELSKIARKGSGSACRSLFGGFVAWEMGTLPDGQDSKAVEIAPLEHWPSLRAVILVVSDDKKDTPSTTGMQSTVATSDLFAHRIAEVVPQRFEAMKKAILDKDFPKFAELTMKDSNSFHAVCLDSYPPIFYLNDTSKKIIKMVETINQQEVVAAYTFDAGPNAVIYYDEANQDKVLSLLYKHFGHVPGWKTHYTAETPVAGVSRIIQTSIGPGPQETSESLTK

SEQ ID NO: 32135 - protein, 271 aa, Alteromonadales bacterium TW-7
MTQRLIEMPSLGVGTFRLEGDTAYNSVKMALDVGFRHIDTAQIYGNEEQVGQAIKDSNIPRSEIFLTTKVWNNKLNKTDFIASVEKSLEKLQVDSVDLLLIHWPAPSNDEPMSEYLTELLKAKQLGLTKHIGVSNFTIANLNEAMQTLDSREIFTNQFEVHPYLTNTKLRAFCAQHGIHVTAYMPFVVGKVLKDETILDIANKHNASPAQIVIAWENANDMTTIPSSTKRKNLEDNFNDHVKLDDEDIASIDALDCGDRQATPDFAPQWDQ

SEQ ID NO: 32136 - protein, 218 aa, Mycoplasma mobile 163K
MKLISPSLLNVEESKRAEIATKMIELGIKWIHYDFMDGKFVPETAISFENYMEIKEKSPSHIKDIHLMVQDVSFYVEKFLNKAEYITFHFEALNYNEIKKILKKYHGLQKFGIALKPKTNIEQIYEYLPYVDLVLIMSVEPGYGGQKFIPNSLEKITKLKKYLLERSLDIVIQVDGGINEESGPQAFESGADILVSGSYLVKNLTKEQIDSLFPKEKN

SEQ ID NO: 32137 - protein, 250 aa, Oryza sativa Indica Group
MAWKDSYLDLVLIPAGIVFPIVYHVWLWHVVRRRPLSSTVGINTATRRLWVLGMMKDNEKKAVLVVQSMRNVIMGSTLMATTAILFCTGVAAILSSTYTVKKPLSDAVFGAHGEYMMALKYVTLLLAFLLSFLSHTTAICTLNQATFLLNTLPSSSSFAADIAGLPVTKDYVADVLERGFLLNLVGNRLFYAGVPLLLWIFGPVLACLCSVVMIPILHSIDVVYVDGSSKGEANARVEMVYESDESVMQV

SEQ ID NO: 32138 - protein, 540 aa, Coprinopsis cinerea okayama7#130
MLTSRGAVARLSRRALNSAKRTNAFFSTAALAQRVAVPASTQQRVSNTRPRAAAPAPARSYATEAKPGSIGTVKTVIGAVVDVQFESDNLPPILNALEVQDFHGGRLVLEVASHLGENSVRTIAMDGTEGLVRGAKVVDTGAPIMVPVGKGTLGRIINVIGEPIDERGPIKGEKMLPIHADPPAFVDQSTTAEVLETGIKVVDLLAPYARGGKIGLFGGAGVGKTVLIQELINNVAKAHGGFSIFCGVGERTREGNDLYHEMIETGVIQLEGDSKVALVFGQMNEPPGARARVALTGLTIAEYFRDEEGQDVLLFIDNIFRFTQAGSEVSALLGRIPSAVGYQPTLSTDMGAMQERITTTKKGSITSVQAVYVPADDLTDPAPATTFAHLDATTVLSRSIAELGIYPAVDPLDSKSRMLDPRIVGQEHYEVATAVQKILQDYKSLQDIIAILGMDELSEEDKLTVERARKIQRFMSQPFQVAQVFTGYEGKLVTLKDTIRSFKEILSGQHDSLPESAFYMVGTIEDVKAKAEQLAKEMGN

SEQ ID NO: 32139 - protein, 469 aa, Idiomarina loihiensis L2TR
MSANKIFDTIKEHDVKFVDLRFTDTKGKEQHVTIPVSQIDEDFFEEGKMFDGSSISGWKGINESDMVLMPDNESAVIDPFTDEVTLNVRCDILEPETMQGYSRDPRSIAKRAEDFLRSSGIADDAYFGPEPEFFLFNDVRFHTDMSGSFYKIDAEEAKWNSGREYSEGNLAHRPGVKGGYFPVPPVDSAHDIRGTMSLVMEDMGMVVEAHHHEVATAGQNEVATRFNTLTKKADELQVYKYVVHNVAHSYGMTATFMPKPLVGDNGSGMHVHMSLNKGGENLFAGDQYAGLSETALFYIGGIIKHARAINAFANASTNSYKRLVPGFEAPVMLAYSARNRSASIRIPLVSSAKGRRIEVRFPDPSANPYLAFTALLMAGLDGIRNKIHPGDAMDKDLYNLPPEEAKDIPTVCHSLEMALDALDKDRDFLKQGGVMDDDMIDAYIDLKYNEVETLKKTTHPVEFDMYYSV

SEQ ID NO: 32140 - protein, 510 aa, Pseudomonas putida GB-1
MNITQLKAALPRELLASVVVFLVALPLCMGIAIASGMPPAKGLITGIIGGIVVGFLAGSPLQVSGPAAGLAVLVFELVRQHGMPMLGPILLLAGLLQLLAGRLRLGCWFRVTAPAVVYGMLAGIGVLIVLSQVHVMFDTAPQPSGLQNLLTFPSTVAAALPQERAGAGWMAGALGLGTIAIMWGWERLRPQRLRFVPGALLGVASMTAISLWLALPVNRVQVPADLSEAIDWIRPDDLMQLADPTLLVAAFALAFIASAETLLSAAAVDRMHSGQRSDFDRELSAQGIGNMLCGALGALPMTGVIVRSSANVQAGAQTRASAIFHGLWLLAFVVALSSVLQQIPVASLAGVLVYTGVKLVDFKAFRGLGRYGRMPMFTYAVTALAIIFTDLLTGVMLGFALTLLKLAFKAARLKINLVSLEKAGDMELRLSGAATFLKVPALTQVLDTVPAGTTLHVPLGNLSYIDHSCLELLEDWNRSNGANGSRLLIEQRRLKRRIEGRLRTTAGIGA

SEQ ID NO: 32141 - protein, 64 aa, Pectobacterium carotovorum subsp. carotovorum
MSIVNKKVKKAVIPVAGLGTRMLPATKAIPKEMLPLVDKPLIQYVVNECIAAGINEIILVTHSS

SEQ ID NO: 32142 - protein, 970 aa, Pseudomonas fluorescens PfO-1
MSFATLIHRASLPSPQVSVEQARHLLAQHYGLNGTLQALGSQQDLNYRVDSDRGRFVLKICRGDYSLVELQAQHAGLKYLAEKGAVKVPRVMAATNGADLLTLDVGGESVHVRLLDYIDGQPLTALDHLGHEVVAGFGRLCGEMDLALVGFDHPGLERTLQWDARHASALIEHLLPVIEDERQRTLIAEVAEQARLRLQPLVEKLPVQAIHMDITDDNVVWQRDARRHWRLQGVIDFGDLVRTWRITDLSVTCAALLHHAAGDPFVILPAVQAYHAINPLQHEELLALWPLIVARAAVLVLSGEQQVSIDPGNTYSRDNLTHEWEIFRVATSVPLALMEAAILTAVGQALPAIDSEGFAPLLPDLVGREFALIDLGVLSAHFEAGNWEQPGIDQRLLSEAAVIHGLAASRYGQYRLSRTRPDSADEPETFPLHVELHVPKGSAVEAPFAGVLHLSADGALRLDGPQLSLRLLGVKPSLHGGAALVKGQVLGSVDGPLIVQLIRGAQLEAPRFCTPTRAAAWQALSPSPAALLGLACDAEPELDATTLLARRDASFARTQKHYYVDPPRIERGWRNHLIDMQGRSYLDMLNNVAVLGHGHPRMAAVASRQWSLLNTNSRFNYAAVAEFSERLLKLAPEGMDRVFLVNSGSEANDLAIRLAWAASGGRDMISVLEAYHGWTVGADAVSTSIADNPKALSSRPDWVHAVTAPNTYRGEFRGPDSAPDYVRSVEQHLAKLDEQKRQLAGFICEPVYGNAGGISLPPGYLKKVYEMVRARGGVCIADEVQVGYGRMGHFFWGFEEQGVVPDIITMAKGMGNGQPLGAVITRREIAEALEAEGYFFSSAGGSPVSCQIGMAVLDVMEEEKLWENAQVVGAHFKARLEALIDQYPLVGAVHGSGFYLGVELIRNRATLEPATEETTLLCDRLRELGIFMQPTGDYLNVLKIKPPMVTSRQSVDFFVDMVAKVLEEGL

SEQ ID NO: 32143 - protein, 368 aa, Pseudomonas fluorescens PfO-1
MTTLKSTPRADGFYMPAEWAPQTQTWMIWPERPDNWRLGGKPAQAAHAAVAKAIARFEPVTVAVSAGQYENARARLDVPNIRVVEMSSDDAWVRDSGPTFVINNSGEVRGVNWDFNAWGGFDGGLYSPWNRDSQVGGKILEIERSPRYRTEGFVLEGGSIHVDGEGTLITTEECLLNRNRNPHLGREEIEAMLSENLSVDKIIWLPDGLFNDETDGHVDNFCCYVRPGEVLLAWTDDPQDPNYPRCQAAMKVLESSTDAKGRPFTVHKMPIPGPLFATEEECAGVDPVDGTQERNPSVRLAGSYVNFLIVNGGIIAPSFDDPMDAPAREILQNLFPQHEVVMVPGRELLLGGGNIHCLTQQQPAPHKE

SEQ ID NO: 32144 - protein, 227 aa, Pseudomonas putida GB-1
MGLQKRVVRSHGLDTLAEETLPHLNYNRRRPQQAACLSAQMRDAIMAIRNFQQHTPKVGPRAFVDRSAVVLGDVEIGEDSSVWPLTVVRGDMHRIRIGARTSVQDGSVLHITHAGPFNPDGFPLIIGDEVTIGHKVMLHGCTLGNRILVGMGSTIMDGAIVEDEVIIGAGSLVPPGKRLVSGYLYMGSPVKQARLLNDKERAFFSYSAGNYVKLKDQHLAEGYDQPE
